United States Patent 6,812,339 (POLYMORPHISMS IN KNOWN GENES ASSOCIATED WITH HUMAN DISEASE, METHODS OF DETECTION AND USES THEREOF) - sequence listing, part 59

SEQ ID NO: 15770 - DNA, 211049 bp, Human
agggtgggacgttaaaggaagacattttaagaatcaaagagtcttagctgtgtttattggggtagagcccttgggtgcagaaacatttagggattcgggagaaaaaagggatgatgtttgaaggaggcaggagggaagtggacggtgtcaggaggttcagctcctcccctggaatggggaaccctgaagatttgaaatggatgtgggagctccagacagatggcttccatgttccaagtaaagtacaacttgaagtacgacgtgatggtgtttgacatttaacagatgtcatctgttctctgcagagtcactcagcagcctcccctgttgcagacacctccttaggtttggaacacactgtctatacagggcctaagtgcaggattttggtgtgttccttatttcatttatttttgtttaacttgtggcagataaatacaggttatcaaaagaatgggacaatgagtaagcacacaccaaactaaacaaaacaaaacaaatagaaacatcacaagtcttgaattttttttttttttttttttttttttttttttttttttttttttggtcaaagaaagaactcattggttgatttaagtcggtggtaaatcagaaagttgaaaataaatcaccctccttctccagggttcttccggatagttcaactctaaattcagctgagagtatttctgatgctcaaagaaaagtgtcttaaactctgatgttttaatgtagttaaaaaaaacacaaaaaatctttgctgaggcccaagctgaggtcaaaaactacctctagccatctggtgctttatttttattgattagaagtctctgataagactgatttgaatgtgatttaggaatatcacattctaaatggtcagtttgcctattccattatagaaatgacactacgggaaaattcatcatcacagaccacagcagaagtgttctttagttaaagctctacctagtcatccagaaagccagtaagtaaaccaaataaaaatagttcactgggctcagagtggcaagttttgcatgcaaagatcgtgaaaattgtaaccctaacaataaatccaatactgttctcgactctcttgtgtgtccagtgctgctgcagtccttggaaggcttttaaactgttcagagcttgctggttatcttcagccaagccagagagtgggagtgcagtgcattttagtgtaaccatgcggaactggtcgctccttgattttgtgccgtatgtttccatttgtgtaggctttttcccccctcagtattttgttgcttatcctttagagcgaaattggtttttcctcggccaataatctgtttctttaaaaaaagaaaaattcgttacctattgcctttttttctggtcttcctgagcaagccagaagtcacaaggtcgtttactaaacggaaactaagaaaaagaaaagccacatcagccggcacaagcctctctaacttgtgtgccctgaggctcatcagatgcgaagtcctggcgacaagatagggtcgcccgcagtggcttcctaaagcgcagatccaggccggctcccagcgtggaatccgacccatgtacttcgcctctccacgtggcatcagatgctctgccggctgtcaccgtgaactccagccctcgcggagccgacactgacctggctacttcagagttcggagggaaatagcgtctccgtaccctcgccccacctgggctgctcctcggaccgccgctcgtcccagactccaggaggcgccaccaggcctcgctgaccccgctccatatctccgggagccctcagctggtcggccgcggcgaccggaagctccggactgaggtactggttccgcccgccgctcttccagccgagactcggcagcggcggtcggagcggctgccacgccgcacctgcccgcgagggggcgcgccaggcccaggccgcagccgactgccgcgctctctgtccccgccctccgccatccccggactgcgctcacctgtctgggccgctggcctgggaggcgggggccggcgggagccaagccgaggaaagggcggagcggctctccgggcgcgtcatcggagcaccatggcggagctaggagctggcggcgacggccacaggggcggcgacggcgcagtgcgaagcgaaacaggtgaccgcacagcggggatagtgggggtcccgtcgggcaggggacggcgagcggggccggcgggctggcaccgaaatcacccggcgccggcagccccctccccgcccgcgcggccgcggcccggaacaaccggccctgcgcgccgcgcaccctgctccgagagcgccttcccccgcccttcgccgccgcggctcggccagcccggctcggccccggccggggttgcggccgccctcgggcgctccaccgcgactttcccgcaacaggtggaggcgagccgggggaggaaacggagagaccccggccgctgccctccccgccgcggcctcgggtctaattcagttgaatgggaaatcgtatcccccagaccaaaccagtggccagagagtcgtcggccaggtgcgactggcaggacgagcagtttctgggcacctcctcccgccttccctggtcgccccgggtgccgggggctcctcagcggggtcggtgtggggcaggaccgcggggtgagcggcccgccccccaatctggtgcccgcagtggcgacgaccgtcgtccgaggggaccgagctcgggagggccggggcccagtgcagcacggtgggggtttgcgagtgcgggcttgacgggatcagactttcgttgacttgtcggagttctcagagttttttgtttttagtctgtgcaggagcccaaaggaggattgttggctctgcagcccgggatttggtggtcaggcctctgtgttgaggatacccctcccccacaacctccaggggcacacttagggacaggggatcacgtccccaagaccagcagcaaggcttcccaagaccagcagcaaggcttcccaaccccgcccatctctccatagtatgaagccgatttttctccctcgtgatttttttttctccagaggctatcttgcaaatccgtccctctccactggttccctcttctattcttggccagtaagctgtttctatatcttcctacacttggggatgggggcagtgaggcagtttcttactttaaaaagaaattcaattcttagactctccaattgcaagctgttttccacttccatacggtcacaatcggaagcatttgtttcctaaatgtaagaatcactgtctccccaccatcaagtatgcttattttaacgtgaaaggtccagagagctctgaaacagtatttgcaaattatgtatctgctattgctaggaagaggttgggtacgtaaagtctaatgatttaatcccttcagccaagatacctgaggttaagactgacaaagtatcttgaacttgtttaagtcatgctccttcctgtagggagtttgtcttaatgtgttcgcaagattggtagatcattattttgttttggggtggagaagagatgcctttgtaattgctttcgggaatttgatgagctagacgctgggacggggctcccccaagtgagggccccgggagaggagcatcctcatttgtaaatatacggcatgattttcgttcctaaccctgacccagtaactgcatgtgaaacaacattgttctagcgagctaagtgttagtttgtgctcaaaaataaactttctagaatctgcacgtgaacaacttgttcagacataagtgaactgactacaaactgtaggatattcagtgcctgagcatgttaaggaataggccgtgcttccaacaattaatatacaaatcaaccatgtgcctgtcagtgtaatattttcttttattaaaaagggagttaaattggctgttatctccttcatagaaaacatttcttccacacttttgcctaaaaacttcattttccaaaggacattttttatatatggtcttgaataattatactttataatttcactgaaaacttaattctggccccgcatctctttcctatttttctaccccaagattactattaatgtttttagtgttcagaagcatttgtgtcagcaggtgccaaagaaagaaggaaggtgtaaatgtatttttttgaatctaggtggtagttattttgagagaacaagtgagattgtttgaatttcaacaacttaagttattccatatatttaaaacacatgacctatatctgaatatgagactttaatttagcacttcattctggtgaacatatttcacattatacacatccaaatactgcaagtctcatttttttaaacaatcagaagtttgtatggaattgttgggggggtgggggggggtggtggtggtgggtggccgtggacagagaaactattaccatcaagagttgaaaattgccaccttaaatggcaacatttcttgagggattaattttatttctttttagaactcattattatgaggtagagtccactcttaaataactcttagtttttgggtctctatacaaagactggtctaattttagggcactttagatgagaatatcaggttattataaaaatgatacctgtaatgtgttcagaattatatgtgtgagtgtgtgtgtgtgtatatgtgtatcaaagatgaattgacagtggtggcgtgtggcctatgaaatgagaccgttcttaagcatattgaaagctattatataaacccaacatttaaaaaccctatttctgtgggtatatattctcaaagttagtcaaatcacattctttgtggcgaaaacatttatttttcttgaggatgaaaagttcttccaatataatatttttcttgccaacagccaaagttaagagctgggaaaaaaaaaattgccttggaaacaagtttaagacatcaccactagaggatgtcaagtcctttttcagccttttttgagtagtcgacctacgatgggtgatattcacaaaactgcctctacccaagctttgtatatttaattttatgttcatgttcaagagctgtggaaagcgagtgtacagcactaatttcctagtctgatagcctgttttaaaaacctcctgaactaaaagcaaatttaaagctgcttttgattaattcatgaagctttcatgcacgaaggaataagttaatgccaataacctgtcaattctgttgatattttgggaagtgggtcatgacttagaatctggaattgggctttttgtccattttagcaacctgtgtggtgaacatggcctctttcgtgaccatcctttcatgaacttttccaaatcaaaaagtgatcttgtaggtgtcacttaactctaagggtccacattaaatatctgcaattaaataagggctcagacgtcaatttggtattaagcttgtcccctttgaaagagatgcttcattcacatagctagatagcttttctcccatcctatatggctgttacctttacatcttgctaagtaggaggaaacgttattattagactaggcaattgtgctcaggagcatgcatttatgtaatattgataggcttgtgtgaaatatttttacacagtttatttacactggcattttctctaaaaaaattctaacatctttgcctcccaatgcatgagaaacaatcatttggaagagttatttttaaaaactcgggcctcgtattgatgtaagaattgaaaatattgaggcttagaataagaaatgtgtaccttctgtgtattcagcattatggtggttagaaggctgttgaacaaatgatccttgaatttagcaaggaagacaaaattcaccaacaaacagttgcaggttatgaggagttcagtgaaggaggaatcacttccggctgtggtcagcaggaagaacatactggatacagcactgaagttaaattttaaaaagtggtggaactggagatcattatgttaagtgaaataagccaggcacagaaagacaaacattgcatcttctcactcatttgtaggatctaaaaatcaaaacaattgaactcatggacagagagagtagaagcatggttaccagaggctgagaagagtagtgggggtagggggtgggaggtggcagggaggtggggatggttaatggtttgaaaaaaaaaaaggccagaggcagtagctcacgcctgtaatctcaccactttgggaggctgaagcaggcagatcacatgaggccaggagtttgagactagcctgggttacgtggtaaaaccccatctctactaaaaataaaaaaattagcctggtgtggtggcgcacgcttatagttccagctctttgggaggctgaggcagaagaatcacttgaacccaggaggttgaggttgcagtgagccaagattgcaccactgcactccagcctgggtgacagagcgagaccatgtctcaaaaaacaaaaagttagaaagaataagaatagtaacaaatactatttgatagcacagcagattgattatagtcaataacttaattgtacttttaaaaatatctaagagtgtaattggattgtttgtaacacaaaggataaatgcttgaggggatggataccccattctccatgatgtaattatttcacattgcatgcctgtatcaaaacatttcatgtaccatataaatatatatacctactatttacccacaaaaataaaaaaaaattaaatttgttttaatttaaaaaataaaaaaataaacttttaaaaatgggtaagtgggatataaaattagatggaggaaagggagaaaaagatgcaggtgtgaaaaagagcaaagttttggtcatattgacacatgtgtaaagctcaaagaaagtcctaggtcagttaggaatgattgttcatcgaagtcaaattgtggaagggctgaaggccaaactgagaggctagtacatttttctggggtagggtagtgggggaagtgttgaggattcttgagaataaaggatattgattaaagcaggaataatcaggtagttctgtgcccatgaatcttgaaatattgattgcaagttctaacaagagctcagctgtgcctttagctaatgaaagcaaagttcctccctctgggaaagtcattctcttccattgatttttttttttttttcttttactgctttgggaagggtgcacctggagggatgagaatgcatgaggaatatctgcctagccagattagccaaatctctggagatcaatgaagggctaggtctactcagctggtcctcatttcaaagtagcaacgtggacttgaggatggactgaagaagagttcagcgacatacacaccaactttgagattcctgcagaaatccaggcagtcattagcatggcaataggaagagacgattaatttaaggttctgcaggggcatgtgtcaaaggattgcaggtaaaaaggtgacatatgagacttttccaagtttgagtttggctcattgacttattggaaaatattcatgaggaggacctgttttgttctttaccccaaagagatggggggcgggtcttgctatgttgcctgggctggacttgaactcctgggctcaagtgatcctcccggcttagctgttcgagtagctgggactacaggcatgcaccactgtgtccagcagaatcaggttttggtgggagaaacaggaaaaaaacctctctgctttagacatgaaaatgtgtggtacaagagagatctgtaagtggaaatgttcaaaaggcaactggaagtataggactaaaagagaaaaatagaggtcaggactctgggattcactccataaaggaataatagctgaaggtttgggagtgaggagagctcagaaaaaccacaaaggggtgagacgacctgtaaagcatgggaggaggaagagccagcaaagcagacagatggaaaagcacagctgagcaatgtcacacctgctgagagggatggagaggtaagggattcaaagactgatgaagacattttataaaaagctgttggtttggttacaaatagtcactgaccaaccccagaagaggaatttcagttgttggtgcaagagttggggctacatcagattagaagtgattgtgagataagcagtttgggaagaaaggtagccaatttaatagaccctcccataaagcttgctggtgagaggaaaaaattacaaatccttgaataggcagagggattttaaaaaatctattctaaaatttgcgtacagtccaggtgcggtggctcatgcctgtaatcccagcactttgggagaccaaggcgggcagatcgcttgagctcaggagttcgagaccagcctgggcaacatggcaaagccccatctctactgaaaatacaaaaattagccaggtgtcgtggcatacatctgtaatccgaactacacaggaggctgaggcaggagaattgtttgaacctgggagacggagggtgtagtgagccgagatggtagcaccacattccagcctgggcaacagagcatgacaccttctcgaaaaaaataatttgtgtgcaaaaaaaattacggattttcttttattttctttttttagttttgttgactgtataggtaatgtaagcaccaccgttaacattatcccaaagagtcctctgcctccaacctaaattccctaatgctgcacctttgtagtgagactctcttcctacacctaacccctggcaaccactgatctgtttaccatcttcctagttttgccttttccagaatgtcataaaagtggaatcatacattgtgtaacctttttttctttttttttgtgagacggagttttactcttgttgcccaggctggagtgcaatggcacaatctcagctcacaggaacctcctccgcctcctgggttcaagcgattctcctgcctcagcctcccggatagctgtgattacaggcatgtgccaccatgcccggctaattttgtatttttagtagagatggggtttctactaaaccccatcaggctgatcatgaactcctgaccaaaggtgatccacccgcctcagtatcccaaagtgctgggattacaggcgtgagccgctgcacccagccccacattgtgtaaccttttgagtctgaatttttcacctggcatcatgtttttgagattcaggcacactgttgtgcatgttaggatgtggtacatcctttttcttgatgaagtagtttgccattgtatggaagtatcacagatggtttatcaaagaacatttgagttgttcccgggttttggcaattatgaataatgctgctgtaaacacttacctacaggtttttgtgtgagcatagttttcatctattctgggtaaatacctaggagtgggattgctgattcatgtaactgtatgtttaactttataagaaatggccaagcttttccagagcaactctacggttttacattcttacaaacagtgtatgtgagttctggttgccctgcatcctcactaatacttagtatcgttagttttgtttgtttttaaaactttagccattccaccaagttctttgagtaaagcaatgtaatcacctcaaagtaaaatagtgcctttttaatgctaacccatgctcacatgaattaggaaagcctggaggtggtgttgatcccagagcctaggtataatacggaatttatatttgactctaatatctttattctccttcattcttttttccccacagtatttctttttttttttaattttaacacaccattgcttgcttgaagagccatagtatctcttatttcctgtggagtatgcattctgaagttgattatagacggaagtgccattatatagcacattccctgccaattcaagttctctcttcctccttaatggtctctgttctaatcccttgagatatggctttctagaacttggaaataacttgttttgttgttagaaagctagacatattgttcatatactttgtttattatcctgattaattccttattggaacatcttatattgtcaaactgaatacttaccagttctcagatacagtgctttgtaaagccttgatagtctgtcattggacgtttcatcagttgctcatggtctaaggttctgtaagctaaatgtgaatggtatttaggcttatacttttttataaaattcagttttagggtttgtctcgttctctagcggtgatgttgtctacctctttactatcttagctcttgtaaaactctgagttacggttgttgacacatttaaatggcatttggattttctcttcagtaattattattctctttagtatctttttaatttgagaaatagcctgttgaaaaagatctgtaagatttttttattaggtaccactttgaaattttttttaaatatattttttgagacagagtctcgctgtgttgcccaggctggagtgcagtggcacgaacttggctcacggtaacctctgcctcccaggttcaaatgattcttgtgcctcagcctcccgagtagccgggactacaggtgcccaccaccatgcccagctaatttttggatttttagtagagagggggttttgccgtgttggccaggcttgtcttgaactcctgagctcaagcgatctgcccaactcagcctcctaaagtgctggaattacaggtgggagccaccactcccggctccactttgaattttgatttgaagagtaatatatagtatttgacactgagaaaaactgcattcaactgttcttcatccttgatgctcctatagaaatagttgtgaaaaaaagaatcatgagaaagtgccaaggaggattgacacacctgaccagatggcacagaggagcacggggtataaaacaatgcagggaggaggctgggagcagtgcacttggcatatgtgagctgcacttcataggcactgttagtaaatgatatatctttaagtttagagtattgagatttggggtatcttaaaatttctaattctgtgacttttaaaattaaatgatatgtaagcttcctttttggagttggctttctagtaaagagaactatccttcactatggcataacctctgagtataaaactcatttccccaacactgttgaatgtagaaaagttctctaggatcagtttaaatgtcaaggtgaagttctagaaaggagcccttccttagcacctccacccctcatcatgaagcctacttggtggcaataacatgcataataattggctgtaagatgtgttcctgtagcaaaacttttggctgcttctcaagattcgaatctgggcttctggttctcagaagctcctgacccaagcctttggggtggcaggcgcaccagacaggacctggttgcttacttcttgcattccagctggactggtttctattcatggtagatgctccaaattagttcagtgacaacttcaccacaggcgtggtgggttcatttaaatatgggtcactccttgaccccaaggttatgttgttgaaatgattattgcgcccatgtgctggagtatcattgattcacatcattggctctcaatcttggcagtgattaaaaatcacctggggaccatttaaatatcaggatgcccaggtggcatccaaggtaattatctgagaatcttgcaggatgggagtcaggtggcagtgtttttaaaattccccagatggtctggtgtgcaatcagtgctgagaactaatgattcagaaccatttcctattgtattcccttccatttgactattgtggtgtgtggtgtcaagtgtgtgcaccttgcttatggaaaccacatggaaaatcgtaatagcaattgccctaagtctagtgagtttactcaggttgtctcttattttgccccaggacttttttgaaggaaatatagatgtgaatacagttatgagtacaattgaatagctaagtatgcacacatatactcagtgtccacatgtacgcacatttctgtatgaatatgtgcagtgagacaaaataccattcagcttttgttttgactttgcctagctcctacactgccttcctctccctcctgccccttaaaaccaggaaaggttaaattggggtagatattaaagtattttgtagaaaattacatacttttcccagagatctttctagtgacccctgacctctgatcaccaggtccctggctctggagactggaccttgtttcttctgtctataaatagttgacccaagtacgaccttttcccttccgtgtgaccagatgctaatacccttcaggctaatctttctttccttcacctctcttgtttctcctcaccgcatgctgctgtgcccaaggcccagctggtaacctctgcggtttttaatgtgcatttttttctcagcaggattattcaacttgtgctttgattatcacctcaaattgtcatctctggctctacacactgaaatgtctacaggcacttctggttttgtttttgagacagggtctcgctctgtcgcccaagctgggatgcagtggcacaatcctgacttactacagccttgacctcttggtctcaagctattctcctacctcagcctaccgagtacctgagactacgggtgcatgccatcagcctggctaattttgtttattttttgtagagatgagatttctctatgttgcccaggcgggtttcaaactcctggacacaagcaatcctcctgcctcagcctctgaaagtgctggaattataggcatgagccaccacacccagcttacaggcacttctgagttgcattcgtgcctgctcctgaggttttgtggtgccatcttttgtgatttgaagctttttctgggagggcttacctttggcagcatggtttcctatccttttctcctctttgcagctagcatatgtctaactatgaagtccaaggcaaaaatgaagaggtcagtagtggatattggatgggactgattcctaaataagagtatctttgatttctctttaagattatatggaaactgagcatgtgtgaggctgtgaggtctgaagctcaaaactaacactaattgtttaggggtaattctaacctactattttgtgcaaggtctctggagtctggctgcctgggttccaatctcagctccaccacttggtacctgtgggatcttgggcatgtcatgtaagcattctcttcctcagtgtcttcctttttaaaatagggtattggtaatatcgtcacagggattaaattagttgatactaaagttcttagaacagtgcttgacacagcataggcaccaagtgtttgttatggttcttgtcatgattactgaagattagtattgcattactgtgaaacgatgggcacaccctggcatgctaagtttcttccttaagccgttttttatttataatagtaagctctccatagtgaaggcatcagaatgtaatgatgattcaggcctcattgtagctgtgtgatcacactgtcataggctggcactgggatcaaaggcatcattaaagcacttgggatgatggtttttacctgtcaaatgttccaggaggttgctgtacactggcctgtgagacccttagattgtgttatgtgatcacgctaaacacccataaaagcccttcttggctttttttttttttttttttttttgagacaaaatcttgctctggtgctctgtcacccaaactagagttaagtggcaccatcatggctcactgcagctttgacatctgggctccaacgatcctcccatctcagccccctgaggtagctgggactacaggtacacgccactattcctagcaccagctaatttttttttttgtctctttttgtagagacagggtgtcaccatgttgctcaggctggtttcgaactcaagtgatcctcctgcctcggcctcccaaagtgctgggattacaggcgtgagccaccgcacctggcccatagttttaaattttaagtcctttgctaaaatattgccacataggttatgttgctttaagccatagagagatggacctcctaacacccgttgtgactttaaacaaggcactatcaccacattgaatatgcttctctaccaggaaaatagaggaaacatacaacttgccttccacgagatgttcatgagaagcaggaggcagtttgggtttcttcaagcaaagtacatacatgaaatagaaaatatcagtaagttattaaagtcacaaattttagaagaaactttcttaagttgtagaggaccatttacaaggtgtatcctgggtgtggtgtgtgggcatgtgggtgaggcacatttctcactaagaaaatgatatcttgttcaacttggaatttagaattttatatcttttaaaaaatttcagccaggcatggtggctcacgcctgtaatcccagcactttgggaggccgaggccggctgatcacccgaggtcgggagttcgagaccagcctcaccaatgtggagaaacctctgtttctactaaaactacaaaattagctgggcttggtggcacatgcctgtaatcccagctactcgggatgctgaggcaggagaatcgcttgaaaagaggaaggtgcggtgagccgagattgtgccattgcactccagcctgggcaacaaaagcgaaactccatctcaaaaaaaaaaaaaaaattcataacttcgtaaatctgaaaatatgtcatttcctcagatgggtcctgggtttagattctcccagcaatgctcccaaattgtctttttgtatacagtagccactgtggaaattgattaaacaagtgttcctgatgccacctttgaaatattaaaatgtgttattcagtaaaaatagaactgaattattattgaaaataagttttgtatggatttacttaacactaggaataaacccatcccaatatcctggtgaagatgccctccctgtgtatataaaaagatacatccatatgctttgtgcagtgactgtataaggcccagatagagaaaaaatacaagagatgtctcaacagttgaaagtattgaaataaattgagaagagggaagctatttttagtctagaagacctatgagactcgaacaactttggatagaaaaaccccataatcttataatccagtgaggcctcacagggaagagccctaggttggcatttcagattcaatcctcggtatcccagctgtgtctaaaatggacagatttgagaatgtcagttcttcaacttatttacaaactgatcaggtccaatatttatctgctgcttgctgagaacagcatcaaagtttaaaaaaaaaaaaaagaaagagaaagtttccaaccatcaagcaagtgtgcaacacaaatctaaaccatatatgtgatgagacccacatgtcattgtgagagtgttgcaggactcattaatgacacccacagtagcaagtaagtcttcaagaaacctttggaagagagaaggcctgtatatgaaatgccagaaggaaggggcaaaaggttcagaactaggactctgggtatggagttcagacacctgtgaattgggcattctgaaccacttgtacaatgtgcaaagctgattttttcttaccatagcacagggttgctttctattacagatgtacctatctggaaacatgttcattcaacagtttgcagtcctgcagttattttcaaaacagtttttgcttccctctttttgtagtaaacacggtctttttccagtgtgctagataaagtctggctctgggcagtaaagggacatggctgctgcttatttcaggaacttaggggcaagtgtcttcatgcctgtggaaacaggagccagctagtactatttccagcaagaaatttaagagaaaggagagatttttattatgattttgatttctttactacaacattgcatgtgtctggagtatagccattacactttatgaaaaaggcaaaatggtcatttggggtgttttaggaagtttgccaaaaggctcctttgtcattataatccttcctaagctgccatccacgggtttaggtcatggatatgaaaagtgaaagggtttagagatgaagtagtgtcccctgagtgcttaccaacctgttaatctttttgagatgttaattttttcatatagagccccctaaaatcttgatggctctagatcagtcaagcctaagagaagacgtatttatggaaaaaaacaaaaaacaaaaaaaccttgctggattgctagtaatatctacttcttggaaattaatacttcatattttttaaaaaaattattgatgcattaggaatattttttgcttagcagttacaaattttaagaggcacatatacaccacggaatactatgcagccataaaaaaggatgagttcatgtcctttgtagggacatggatgaagctggaaaccatcattctcaacaaactatcgccaggacaaacaaccaaacaccgcatgttctcactcacaggtgggaactgaacagtgagaacacttggacacgggaaggggaacatcacacactggggcctgtcgtggggtggggggagcggggagggatagcattaggagatatacctaatgtaaatgatgagttaatgggtgcagcacaccaacatggcacaggtatacatatgtaacaaacctgcacattgtgcacatgtacactagaacttaaagtataatttaaaaaaaaaagaaaaaaaaagatgacaaatactaaaaaaaaaagaaaaaaaaagcttctaagcttggcactcaatcctaaatatcttatatctttataatttagcttaaaggcttttagtgttctggttggttactgacaattctcagtgtggctttcactgaaggaaaatggaccaagcctcaaacttacccaccacaattatataatttggcatttctgtgaggcacttccttcctctaggttggtttcagaactatgctggagaattgtatgtaatttttttttcttttgtcagaattggtgtgttaggcctttttttgtgtcacttaaacacctgaggctaggcaatttataaagaaaaaaggtttaattggctcagggatctgcaggctgtacaagcgtggcactgacatctgctcggcttctgctgagggtcccaggaagcctacaatcattgtggaaggtgaagcgggagcaggcacattcacatggcaagagagtggtgtgaggggaggtcccagacttttaaacaaccagaccttatgtaaactaactgagggagaacttacttatcaccacggggaaggagctaaactattcatggaggttgcaccgccatgatccagtcacctcccaccaggccccacctccaacattgggggttacatttcaacatgagatttggaggagacaagcatccaaactgtatcaattggtttcagttaataaataaaccaaaaaataaagtttaatgcctcaaaccttcatacgcttttctcatgaaaagcgttttatccaaccctctctccatccccatgtacggatctatgtactttagtttctactgattgagaaagtggggttacttcattataatagagaaggattttttgtaatctatatatctgtacttttgaatcatttaatgttcagatgaacaggctgcttagttctcattaaaagggttcatttgataatgcttttaagctcaccagtacttgattctcaaagggtgatcattagtgaaaataaagagggatttaataagtctaagatatcctgaccccaactgtaggaacattatattaatagagcattacagtattggaaaattatctgagtaaatagaatccatcctattcaatgaagattatgatcattgatacataagcctttgacttttgaatggcatgctttcgttcgcagcatgttgacttgaatgtgggaatggagtatcttaatctctctgaggtcactgactgataggttaagtgtcagctgggctcagcccaaacattagatgttgctgggaaggtattttgtaactatgattaacatttacaatcagttgactttaagtaaaggggattatcctggctatgggtgggccaaatccaatcaggtgaaggcctgggaaagaagaagaaggaggaagtctgccttaagactgtgacatggaaatcctgcttgagtttcgagcctgccagcctgctgcacagatttcacacttgtttgtccccacagtggcagcagccattattccttaaaataagtctttatatacaatatatttctctccagagaaacaaccaaaaatactattggttctatttcgtggaagaatcctcactgatacactcaccctcaagaagaaaattaacagtttttacccagaatcatacaaatcgctttatttaagagataaaatttaataattaatctttcctgatttttgaaggtaaaaacaggatattacgctttcagtaaaaaaatggatgtcttttaatttcaggggggtttaggagaaagaaatggaaagagtggcaaagtagcaaaggatggtgatacggtttagatatggtttcatgttgaaatatgacatccaatgttagaggcagacctagtgggatatgtctgggccatgggagccgatcttatgaatggcttggtactcctcttatggtaatgagtgagttctcattctgttcgttcatgtgagagctggttgtttaaaagagcccgatatctctcttgctccattgccatgtgacacacctgtttccctttctccttctgtaaacgtcctgagccctcaacagaagcaaataccagcactgtgctccttgtacagtctgcagaactctaagccaaaacaaaactttgtaaattatccagtctcaggtatttatagcaacacaaaacggactaacacagatgggattgaggaaaagtcttaaaacattctgaaatgaatgttcttcacctgtccgatgctttgctgtcctaaagacttaatgctgtcactatccttaaaatgcccaaaaagtcatacactgaattggtttgctgttctttagtatcgctcttcatttagatttcatctctcaagtcacatagctatagggatccacctataacaaattggctcattgaggggaaaactctcttattcatctttatcagtaggttttttgttgttgttttagatggcgtttcactcttgttgcccaggctggagtgcaatggcccaatctcggctgactgcaacctctgcctcctgggttcaagcgattctcctgcctcagcctcccgagtagctgagattacaggcatgcgccaccatgcccggctaattttgtatttttagtagagatggggtttctccatgttggtcaggctggtcccgaactcccgacctcaggtgatccacccgccttggcctcccaaagtgctgggattacaggcatgtatatcagtaggttttcattacattgtgggtgagagaatgtgggaagtctggaagccgcaggtgcggagatcagagtagtgtggccctcttctaacccaaacacctggagaaggttcagttgtttctgtgatttagcatttaaggctaaaacctcgggaccatcagttgaataagtaaaataatgaaacgcagagttgcttacaaaatgaagccatgcgagtaagtatgtgcacaggtacagcaaaggagagggctttatctcagccttgctttttccctctgcctgagtgttctctcttggttatataactcgactttccatttgcatcaagtcatggaatctcaggatcagaagaagctctagagattaaaaaaaaaaaaaattcaacctgtaaacagtgcattaatccaacatcatcattccaaatcagtgtttgtgcacagctatcttcaatgtcaagaaacataactttttacattctgataacttaacagtccctggtcccagttttctcttccagaactaaatttacacttccactaaaagtgtaaattcttccatatgttaacctttaattctgttattttattcctctggagtcttgtcttattttcttctatgttatgtctcctatgttatggcctagaatatttatggtaagtcctaggtcactctcttctgaaagtgttctcatttatcatcctatttcaaatatcttgcgagtaccatgtagtatgaggaccagtaaacagagaacgcttgtcctcctattaggcacgctggtgtctgccgattccactgtgacacttagggtttttacttcctcagtgcgctgatgatgtttagtgagcttgttgtccaagtgctcgctttgtttctggggcagcttgggtaggtcttcattttgtacctgtccagttgaactttttttacatataaaaagatatgttcctgtttattcttactgaatggataagaatatagcctattcagtgggaataaactgaataggctgtatcctgtctaagtatagctcattatttcattctttgagatcattttggacctgagtctatccatctcttagctttcttttttctatggatatagagcacttgttctcatattaatctttaataaaaacataactacctttctttgcattgcccacttctccatctttcatctggactattgcaggagcttggtattcacgttcaagcctatggataagtttttcacactgctagaggggtgtctgttaaaaaaacacaaacatgattgattctcatattcctgtttttacgtctatccctatgaccaccatttgatcccttttctttacttggacgaagtagttacatagctagtctctgtcccgtctctctctttctcacttcaagttcatcctggcctgtctggatcacacatttagctatcaatacccttcagtggctccccactgcctctgtttggtgaaaacattatgcctttggctctgtatcctctctgatggcatgccccaaagcaccccatctgtcatctttaacatgattttactactcctaaagcaaagcaagtcaaggaaccatagtttcattttctttctaatggtgtggctcaacaataaaactaaattaaacactaaattaaactgctcacagaccctcagtgaattaggtaacttacagaaacacagtccgggcatctgtatgaatcttctgttgaacccagcgattgatttctttccctcatttggaatctataaaattggatttcttagcctaattatcgtgagaagagaggacagtctttgcacatttaacttttatcaagtaattcagaagttcatgtagtgcacattaataaagtattatcaatgagagtaatgaacaagagggctgagaggcattccattatgtgctactgggttaaggtttaatgtggcatttcacacctaacatttaggaaagggttttaaagcttagtatccacaccttacatttgtataaatgaatccctagcgtttgaaatttgtttatgatagagcagacatgggaaaatggactctgtaggcaccatgaagtgttttgcagtgaagatttatagaaatgttgtaaaaggcaccacagggacctggtacttctggctgatggcatcaccgctactagggcagtatttactgtttttcttatatgcctgttaacaaaaagtggtcaaataaagaagatcaaagcaaatctgcctcttcctttcaaagggatgatatttctttgtgcagtatttctttatccagcctcttctatgctatgcatgatgctgcaagatggcagaatgttgtgcctttatcgtcacaaaagccatcagtaagtggcataattctaggaaactctgaggctgccctttaacttcaagaatagagtggcaaagaaccagctgggaccctttgttccttagtggttgtttgattccatgtcaacctgtgctggctttgtcattttcaaaatcatgcaaagtttttaagttgcataaaaatattgttaaaactcctgctagaagtaaatttcagtttatcttggggagatgcattaaatacttaaaagattgctgaagtccggtagttttgaagaattaaccatctcttcgaatgttgaaacgtggaaaagaattttggcacttctggaccctgatgaaaagtaaataacttatacatacgtggaacttgtaatttactggtgacaggccattcaatccagcagtaataatttctgttttcagctacagccattgaatagtacaaattaggctcttttttctttcaataatgtttttgtaaagctcactgggcttttagaaagggaaattttaggtatgtttctcactggttaagcagatttcttggattcattcatggagtgtgctgttttccaactttatggtcacacaagtctaggaagcataaatgtgaacagaaagctgactctatgtgtgcgtatgtgtatgcaggtgactacatgttagtcttttatatagcattgtgacagctaggcccaagtcatgagcttacttccccaaagatcagcaagtttgactctgtttcatattcatccaactcacaggttggacataggccagagatgccaaccagccagggtaggaggacaaagagacataaatttattgtggaccaagcgggtggggcctgcagttgctcgggggcctattggactgttttaatcatagtagctgagtggtaatgtttttacccataaatgtgaatacattttgaaattatactgcagaatatttttacgcaatataaagccaatctagttgtaaaatctaccattttgcactaggcagtgcctcatttctctcaaatttgtacaaagcctctattaatacaacatttatcactttaacaatttaaagaaagtaattgcaaaaccttactgattgttggagggctgcatgcccatttcccatggggactgatttaagcctctgtatctgcatgtgacatgcaaggatagttgtgccacatctaattgaaaatgctccttagtgctggagaagagttcaggaggctgggcgcggtggcttataacctttaatcccagcactttgagaagccaaggtgggtggatcacttgaggtcaggagtcaaagaccagcctggccaacatagtgaaaccccatctctactaaaaatgcaaaaaaaaaattagctgggtgtggtggcagatgcctgtaatcccagttactcaggaggctgaggcaggagaatcacttgaacccgcgaggtggaggttgcagtgagccaagactgcgactgcactccagcctggcgacagcgagactccatctcaaagagttcaggaattcagagtagtgtttattttactttggcggatatttaaatttaaggtctcaccatatccctttccgtatttgcctttggtttggatcaaaatgtaaaagggaattgcgagaagatggtacccacacctctacagggatcaagccacagtattcctggaattccccaggagctaacccctatatccattaaagattgggtgtgaacatttaagaaactaatctcaaatgaatttatgtcttaagtgaaaaatgtgtcctttataagggaaggaaaaaaatcctttattgttattatttgatcttgtgctgtttgcttttctgtgacagtgacacagctagttgatgttggggtcaggatttacacgacagcaggatgagagcatcttgactcagtggagataatgtgttagttattagagcagcagctagctttgtttggaagctgtaagctgtatttgggtgacaaacatttctaaatgaaattagtcatttgcttaatacagattttcattttctttaccaaaaggtagtttcaagtatgcttattttgtatgtggggttttttttgttattattttgcttttttgttttgttatgcttttgctattgtaaatactgacctgactctcttgaagtagaggaaagaagctaatgtggatttgaaaatattttcatttcacaaatagtatgatattgatgtatattacacctgtgtttattgatcatctgattaaagaaaaataataggaaataacaaatcatgtctcattcaagaataaaagtttacaaatatagaaaattatggaagtatgttacgtttacaatttgtatccatttttttatttcttaaacaataagatcttatatgcgtcctccctttccttccatctccacataaattggagatcgatctaggattctaaaacatctgggtcaaacatttgtcatcgggagaagcactggactaggaggaagatggtctaaattttaattgtagacttgctgccaactaacatttgacctaggcaaggaatttcacttcgtgagattcagcttcctcgcatgtaaaacgatgctgactcacttgctttctcaggcccattcagctccaaaactccattctattttattccaaagacccactgcacagattgacacaatttaaaataaactctaaaactgaaatttcctgcgtttcttcatgccagagatctaaatacatgtgaacttaattaaatcaagcagcctgtggagggaaagagttcttaagattcatttatttttttcagcatgtgtttgctcacaatttagtacatcccccagcaccatgctggacaataagagtagatacaaagaagtacttcctggtagcattgatagttgaactggaaataccttgaaaataattacaaagcaaaaaatggactagttacagcaaactattataaagtataataatagttggtatttattaagcacttcaagttgctagcactacacgcatttaatcctcaccctaataccataggtaaatgatagtcatcaccccaattttacagagaaaacggaggcactgagagagttaagtgaattgtccaaagttactgttccacgcaagagatttagagaggatattgtacttgccttagactcccttgggccctcttttgggtaagtaggtttaagtactgagaaaaagtaagggagtagttggggagtgggaggattgcttttgacttgctaagcagacttgatttttattaaaacacaaaagcaaaaaaaatgttttttcttaatttggcagttggcatgttttaatgtcatttattgtaaattttttttggagacagcacacattttaagcagtctagaagtggagagtcttaaagtgagatagcttatttcaggagaaaacaatagtcacatgattctgtgctttgaagaaaacgatccaaaaaagagctaaaattgggtcaagtgttgagcattgctcagcaccgctggtagcaactgcccagagcggtagggattgagggtgggggggtgtgctgggtgtaatagagacaggtttttctcctttggagaattccccagtataggttctgtccttgaaacttgagttgcagaggagacactccacgttgtgatctctggtgggagccagcatagttcttcccttgcctgtcttcaccagagggtttcagggacatggcactggtggccctcatgactggtgctgccaaccctgttcttatacatgctctggggtggtaagaatgtcaggaaagtaaagtgagctgctctgtgggtaccagccatgccttcattcatccaggggcttgcaaacattgttatgatagacaacctggcccagaaaagaagaaaaagcctttcttcctcaggcttctgtctccatactgaggagtctactgctgcttgtgcaagcaaaactctttctcctcccatcctgctgcgctgccgctgagaggaagagggagctgcccagcggcctcacgctgtaaccctctgctggtgagttcccagaacccagcatcctgcaagctgccgcttctcagctggggagatggagccgctctgggcccttcttgattaggatatgttagggttgtcagggcaactgttaacggcagcatatcatattttcccctctctgctgtgggctgaatattttactgtgtggtagcaggaagaagattggaaaaaggtgctgcagcaggaagaagctgggatctgattgaacaggttgtgcagtggtgggaggcatcagaccctgcgtgtctgtagtagggcttttctggaaggagtgtgtgtgtgtgtgtgtgtgtgcgcgcgcgtgtacgtgcatgcatgagccggagcaatcaccagcgcatgtgcctgtcggggagtcagtgggagggggctggtaggggaggtggggaagctgctgctaggtgaggggaactgcagggcctcagttgccaagtggctggtactatctgtcagctgtttgcaaactgtttacccataggggatctattacaagtgctcaaatgaacaggcagcttaggaactagcagcttcctgggagctgcaattacataagcatatatttttaatataatcacaattaaaaaaaaaaaaaacaagtagcagcggtatgcctggatcagctacagctctccgacatgagagactgaagaagaccaatgcaaggccaattcctcttggtttattcaccattaatgaggaagacgaacagcaaaagaatggaaattccagaagaccaaaaggtatgcattagctccaccctttggtcggagccagatccagcccttgtctcccacactgcctatagaacgttttataaactgtgctgctcgtgcatgctccagggagtgcttgtgacctcctagcacggtttgctggtagtgtttataccctctgtagggttgtgtatgcatgaaatgggaaacagtttttgtagattcggtgtatttcagatcagttgccttttttgacttaagctactttcttggcctagagatgtttaatttttcccatgctcacttcagcagtgaccagtcactctgtcctcatcaagaggaggaaatactgagttatcaaggtttaaacgaacatctccccaccttccttaggtgcctcagataatttttgcttattttaatgaagtgagtttctgctttaaaggatgagttaaagtgactcaagagtgcaaccttttctaggcagagggtcaaaatgtcacttccctttctatactaaaatgtcaagagtaaagaggagcacagcaaacattgagggcgaatgtggagggtgaagctagggagcagggaggagatcatgaggttgtataactgttgatgataactgaattcgtgtatggcagttgaaatgcacaggttacagaaaagggaagtctgacccttgtgttgttctttcacagtatgaaaggtagcagcagcttaccagcttcttgagagcctgtgtactgcatcattgtcagcattgtctcacagctgccctcccagggctgtaattatcagccagagacagcaacatcagacatttttgaaaaaggagctttaaggcctgtgttttacattttccagcatcctaagtcttgcttccccttccccaaaatatataagctgttcttaaacagatgggttatgagttttcttgcttttatgtgctgattaatttttagcttgctcttaaattattctgtcactgaggtatcaaattttcttctgtgatgcagagaggtagcatgacaaagtagaaagcaaatatttaagcaatgataaagtgaagagtgttaaatagaatccagtgtctgaggactcgttttctttttcctgtttctcgaattaatcttactttgcttttcttaaatataattgaaactgtctacattaaatccaaaagcatattacttcatttttatgagacagtacacagggaagttctaataagtagaatcttactactgtagttgatttttatttactatcagacctggctcctgtctgagaaccaaatgacctcagaaatcaaatgatgctatgactggagggtgacttaatgtgattcttttatttgcctgtgaattacatcattgaaccagagtgtgttgctctggatgaaaactcaggactttaaatttttagcagcaaatcattttgcctctgaaaagttggtaacttttaaaattaatgtagatttgttgaattgttctcatggggtatttttggaaacattcttgatttgtggtacttttccttggatgtcttggacagtaacttaggatagccatccattttattcttaataattttcttttcttttcttttttttgagatggagtcttgctctgttgcccaggctggagtgcagtggcacaatctcagctcactgcaacctctgcctcccaggttcaagcaattctcctgcctcagcctcctgagtagctgggattacaggcacctgccaccatgcccagctactttttttttgtatttttagtagagacggggtttcaccattattggccaggctggtctcaaactcctgaccttgtgatctgcccacctcagcctcccaaagtgctgggattacagacgtgagtcactgcgccctgccctcttcttaataattttcttgaatacctctgcctgtctcctgttgttgtttttgtttagttgtcttttagtatttttttaaaaaggaagagaaaggggaggaaagaagatgcttcgaaaaacctacttatttttggcaatttttgcagcttcttggataagagagacttaatcaaggagtttctgaccccctaccatttttctttctatccctgcccatagtggtgggaagggcaagggtaggtattggaggaatactgggagaaaaaaatcctgtgctgataaggatgtccaaactttctgtggatcaccaattgtctctatgacacattcaataaaataaccagataaccgtggatatctctaattatgctcaatgaataacactattgactttgactgaatttttcattgggtccatcttaacaataggaatattcactttgtagtccagctttgttccatggaaaatgatggaaatgttctgtatatgcactgtccaatacaatagccacagctgcagagcttgaaatatagctagtgcaactgagaaacaaaattttagttaaatagccacatgtgaccaccttattggacaacacagttctggtctgtagcattgttacgttctgaatttgtgtcttctctggttcgttcgtccttactgcttcctgacgttggatatggttgggtcctgaaatgaatgtggttattaagagaacatcaaggagcagacagcctctgtactgcatgagaacacagaaacctggatgtgtagacaatttcattttaccttttccacttaaatgttgttgcactgttctgattattattattaccagtcactagttgcctgtatcatttgttgcaccttttaatggactcttaatttttttttctcctttttatttttattttttctttagtgacagggtcttgccctgttactcaagctggagtccaatggcatgatcatagctcactgcagcctccaactcctgggctcaagtgatcgtcctgcctcaacctccttaatagctggaattacaggcacatgccaccacacccaactaattttttaaaaagctttttgtagggatgggatcttgctatgttgcccaggtgatcttgaactcctgtcttcaagtgatcctcccaccttggcctcccaaagggctgggattacaggcgtgagccactgtgcttgaccatctcttattttctaaattaagtattcccaaagcatcatagcaagatgacatacagtttattttttgtgtgtgactattgcgatacacaatcagaaacttttcttttcctaccccatggcctcatctgccaaccatacccaaacctggttttcatgcttagtgtcttttttctaccagtaataaagaagtttgccatctaaatttgatgagttgaatgtttctgttcaggattatcctggctaatgatgagtaccatcttttcaggtaccatactgttgggcaaacatcaaataactcagtaagagagaacatggagattaacatctggccttctatggtggcttcatagttatctggtggggtgacaatagtttgtttagatggcagactagataattcttgaaggagtgattactcttccatgtaatcggtaggagtgtaatgttttacatacctgactgttattaccacagtaattaaataatcactgggagcgagctgggcttatgctgatgctcttatacctcggaacctcaagcctccttgtaatgctgacttcaggactggcttaggagagactgtttaggtgctgcagtaactaaatgcccttggataggtctcaaggcaaacctgccttagacggtgaattttgctgagcacagcgattattaagtaataaggcattttcctcctaaaccagcatttgttaaatgctcactctgtggcagattactctgctggggttttgtggaagtaatgcaaagataattgacatggtttctgctcacagaagtggaggaagaaaaatgtgtacaaataatgcaagagtataaattgaagtcaggaaagggagaggatgagagtggcagaaatgttaagtgtgtgccaactgtgaagccattagcttcaagattttaatctgaaacagggcgtttaagggatatagactcctatcccatcccaaatgtctggctgaggttggaagctcacacagaccttaaaggcgggagcacagaataatgggcaaagagtcttttaaatttcattatagaagcaagacatccacacaatgtttacctgtggatagacacttctagaggcttcatgactattacacaatacattttacaacttctgctttgtaatggcctcctgacccattctgtgaactgcctaaagcagtcatctgattgactttatactcctgtgttgtttttatataaaacctgattgatgtccagatctaatactaaatttgctcatgagacttgactctaaatgacttttacttgattttatcaaaattatcatctccctcaaaagacgaaagactcataactctctaggtggatcatggtcttcctgctttcagtctttcctctttccaacccatcctccatagcgtgccactatgacatctttccaatggaaatatctgcccattagaaataaacttctcatgaaacagaggtcttgactaggagtcttggagccatatttagtctgtagctaagtttatttgtcccctgcaggtgtttatgagtcaacatttaggaactgattttttcataatctagatttcagcttcccttgaaaaattggaagacacagccacccttgtcctctttcttcaaagcagtcatcagctggagctaagtagcagctgtcaccatatgctatagatgggtcatgcgtgctccagtgcccctcttctagaatatgcattacatggcctgcctcagttatctacattaccgtagtcattgcttttgtgacccctgacctaaggaatagtccaagccccttagcatggcacctagactacctaccagctggtcccttttgccttctccatcctctttcctgccactctttgcactttgtgctccggcagcaccaaagtgcttgttgcatttgcctgctccatcatgttcttgcatgcctctgtgtcctactcatgctcatctgtccattttcctcatcttgcttcctcatttggataactctgacttactctgtagaatcagatcacatggcatcttctccagactttccttgggtgccatctgcaggaaacctcctctctcgctcccagcctcctcattcctggcacaaagggcagcccctcactgtgctccttccgcactgtaaatccattactgacttacatcagtgtaatgaaatcatccatgcacacacccatgtccttcttgacactgtaagctttgtaagggccaggactcactcctctttataccctgtacttttcagagtaaatggaacattatgaaacaaaggtaaacttaacacttaaaataactttcacagactctgaaggtcttcataatatagaaattctaagaaatgttgatagcattagaattgtcctttcaaggtaactacttggaaagagacaattctgtgtttgatacattaatcatattgctctctatgaaactgcatttgtctattagtataccagagattatctctttgttgttgtcttcttctcctcctcctgctcctcccccctttttttttttttttttgaggcaaactcttgctctgttttccaggctgaagtgcagtggtatgatcatggctcactgcaactttgaactcctgggctcaagtgatcctcctcagccttccaagtagcttgcaactagaggtgcataccaccacacttggctgttttttttcttttaattttgtagaggtggggtctcactttgttgcttaggctggtctccaactcctgggctcaagtgatccccacaccttgatctcccaaagtgctgggattgcaggagtgagccactgcacccagccctgttttgttgttttctgtcatgctattcatttttctttggtggaaaaacaaaggtatatagttacaaggtgctattaattgaccactttgtgaatattaaggttaataatgctttctgtcccttttgttagctaatcatagattaaattgtaaagaaatacaacttctccttgagatcgggacacagtggttctgagaaactgtactcccccgcccccactttgttaaaatgtgtatttctggagcctgcagtgacttctcttcttttggcttttccactgtaaaggtagaatttcctccagttaaggtttccaaacgaaatataatctagtgtttaccatttatattcctatcagataagtgatgatctagcaactgtaatgtccttttctaagtcatgaatctttttgttttccaagagaagtcttagaataagaaatatgaatgcctctatagaatcattctcatatatctccttgtttctttttctcttttgttctgtaaggcttgcaccattgtcttttcccagtgtccttatgtgtggcattttagggctaggcaaaaggttttagccgtaaaatttaacagctagggaggcaaaaatgtattttagaacagtggtatcaaagatccttattttgaggaggaaatcttgaggtcaaattcattggcataaacttttatttgctgaagagatcttaaatgtaatattttattcaaaatatttatataaaaataataggggatggagcaaggatcacatcatctaatgtatgtcttgtactcattggattctctgtaactatttgaataaatgaatacagctgttccccaggcattatgtgttatataagtagaaattaccacatgcgttactgtgtacaagaggaacatgatttaacctgtgtataaccaaagtttttgtatagtgaggtacaatataaagtgtaatttgcttgctatataaaactaaaaggctgaaaaattgtgtgcctgtttccagagctataattgatggagctaaaagagctgactcctccaatcataggaaccaaacacaattaagtgtttacttagagcctcccagctgataactcttagatattatttattaaaagattatagtctgggtttgaattgaatgtccatttccattaacatctgtgtgtctccaagagcaactttaattcgttgttacagaaattctccaggtggctccaggcaccttgactatgtttttcatttagcagaaacttaagagcaatgaaggtgattttactgagagactccatcttaattctcagatcatctagacatttaggaaaagcccactttatgttgcaccttccatatgttatattaagtttatgttctagatttgccaatttgagaagataagtcataccccattataccccagacccagatgccgaggcccaaagtgtgtcacagatggacataaggcattgtttgaatgtttaccagagcattatttgacatttatgccaactgtaaaatgcaggtcctgtttttcaggctatctgcccagcaatggtttgttagtaaggaaattctcatataatctttctagattccaaagaatttacaatcccaggtccagtgtggagtgggaatgaagttcaggagtatagacccagaaaaattatcctaacagttttgatcttgaatatatatggtttgggggactagattcattctaaattaaagttgcaggcctaataaagtagtaaaaagatattaaaatacgaagattcagcagaacctgtcattctaaaaccattattggaacaacagtatggaggctcgagccacctccatactcctaataggattgctttcaaggtcaccagctgagtgcatgaccaagaggtgtcttggagttgggcaggagggaagagagttggaatctctattagccccttttaaaaacttcccaaataatgtagcttaagatctaagtaaaaatgcaactttaagagaagttacccccttacaaaccagttgtcgcctctgagccccgatttagaactatagaaattcagaaccagcccttatcagggatatcagtttacatagtgggaaaacaggatactaggaaagtttcaccacgttcactagtagtcagtggtacaggtcagagtttgccacagttattagaaatccaggctatatttggtgtgagaaactgtgaaaaaagtgcttagaaaaaagtgatagaaaaagtgctacatatggaaatatgcacattactgttattaatatttaaactttctaagcctcagattcccatctgtgaaatgaaatgaataaaatcatgctcacaggtgctggcgggtattagagagaatacacaagcacttagcttattctctggaaaataattggagctgattatgtgacaattataatattggtaatttataaccaaatgtctcacattttctgataacttctactgacatgttctgttgggagaatggcctggtggaaagaccatcatgcttgtctgtgccaaaccttagccagtctctttttatagagatattttccctaatctctttccttaacttgtgagtaaaaatttctaggaaggctgccttctttcttgtgttgttttagtcactttcctaccataggcatatgtgactggatctttgttctgtgtttgttcatgtgaatcagaagtcctagctgccaggtagattgctcatgcagtaccctgtaattttgttgtgttagatgaaggaaataaattgccataatgtcagatcacctcacttgttattttaaatatgattaagggagtgtacctgttattccttgggattaatggaaaactctgatctgccttaatcagggaacagtagcagtgatcatctgccattttaaaagccaattcaaaaggatttttttttttttgcaagggtttttttttccttctgatgtggggtgtgcatgtgcgctcgtgtgcatgtatgtgagttgcttgatggcaatgtcctatgctaatggacaggtttctgccagtggttgagattatggatgcttacactggggatgccaaatgtatccaggcttatttttgcaggcttattttcacatacttattttcagcaccaagacttcttattctaagtttggttagccatcttttctttcaatacttcttgtttctctgtgctagtcttgatttgttctctagtcactcagaagtaagtgctgtgaacacttacgatggagaaagcaccaaattaaatgttatttgcggctataattgaacatatatatgccagcggatctgtgtcctggtgaagtagatactgtctcgcttggagctcttccctctacctggtatgtacttctgctgcttctcctctctccacttcactctccctggtcaacacctacttgtccttcagtttaaatgtcatttccttggccaggcatggtggcttatgcctgtaatcccagtgctttgggaggccaaggtgggaggatcatttgagcccaggagttcaagaacagccctggcaacagagaccccgtctctacaaaaaatacaaaaattaaccaggtgtggtggtgtgcacctgtggtctcagctactccggaggctgaggtgggagaatcccctgagcccaaggaggtcgaggctgcagtgagccatgatcgtagcactatactctagcctaggcagcagagtgagaccttgtctcaaaaaaaaaaaaaattgtcatttccctaaggatgtccccagaccaagctagtctcagattctaggccctttcttactccaggcaaattgtgtattaagtgtttgctgagtcgtttattgtctgtctcctcaactagacgaagcttgcagaaagcaatgaatatgtctgtcagattcacactgtgcccccagcaactaatacagagtctagtatgcacgtactttcttttattgtgcttcatggatactgcattttttttacaaattgaaggtttgtggcaaccctatatcaaggaagtctgttggcgccatttttccaatagcatgtgcctacttctcatctctgcatcacatattggtaattcttgcaatatttcaaactttttcattgttattctatctgttatggtaatctgtgatgggtgatctttgatgtcactattgtaattgttttgggatgctacaaaccatgcccacataagatagcaaacttaacaaatattgtgtgtgttctgactactccaccaacccagccatttctgtctctctccctctcctcaggcctccctattctttgagacatgacaattttgaaatgaagttaactaataaccttacaatggcccctaatctaagtgctcaagtgaagaattacatgcctctcactttaaatcaaaagctagaaatgattaagcctagtgagggaaggcatgttgaaagcctagataggctgagagctaggcctcttgcgccaaacagccaagatgtgaatgcagaggaaaagttcttaaaggaagcaaaaagtgctaccatggtaaacacaaatgataagaaagcgaaacagcctgaatgctgatacaaagaagatttgagtggtctggatagaagatcaaaccagccacacgttctcttaagccaaagcttaatccagaacaaggaccctaactctcttcaattttatgaaggctgagaggtgagggaactgcagaaaaaaagtttgaaactagcagaggatggtcatgaggtttaaggaaagaaagtgtctccataacataaaagcacaaggtgaagcagcaaatgctgatggggaagctgcagcaagttatccagatcttgctaaggtaatgatgaaggtgagttcactaaacaacagagtttcaatggagatgaaacagccttctgttggaagaagatgccatctaggacgttgatagacagagagtcaaagtcagtgcctggcttcgaagaacaggctgaatctcttgttaggggataatgcagctgagtcattgcaatcattgacttggagttgaagccaatgctcatttgccattctgaaaattctaaggcccttaagaattatgctaaatctactctgtgtgcactctgtcagtggaacaacaaagcctggatgacagcacgtctgtttatagcatggtgtactgactattttaagcccgctattgagacccactgctcagaaaaaaagttttctttcaaaatattactgctcattgacaatgtaccaggtcaccctgatggagatggacaaaagaggttaatgttgttttctttttttttttttttttttttttttttgagacagagtcttgctctgtcacccaggctggagtgctgtgatctcagctcactgtaacctctgcctcctgggttcaagctattctcctgcctcagcctcccaagaagctgggattacaggtgtacaccaccacacctggctaactttttgtatttttagtggagacagggtttcgccatgttggccaggctggtctcaaactcctgacctcaggtgatctgcttgccttggcctcccaacgtgctgggattacaggcatgagccactgcacccggccacaaggaggttaatgttgttttcatgcctgccatcacaacatccatttttcagtccatggatcaaggaataattttgactttcaagtcttatcacttaagaaatatattttgtaaggttatggctgccataggtagtgattcctctgatggatctgggcaaagaaaattgaaaaccttctggaaaggattcaccattgcagatgccattaagaacatttatgatgcatggagggaggttggtgtgccaaacccctattgactccagcggggatggcaccaggttcaagaggctgaagaagagacctagagccagcgaatgagacatgggttttactggggacttacgtacaggtgagagagtccagtggtggcagactgggcaaaaccaccaccaccacttgcaaaacacatgcaatttatataacattttcacttaacaccctccccctagcaacttccacctggcaaacctcatttaacccaaaacaatgggccgtgatcccctgtatggcccatgttccacaggatgcgtctggggctcaggtgttcctcatagacaaggaatggatctctgggttggccacttctgagtacacattgaggtgctctgccatacggggtcattctcagggtatactcaggtcgcattatcactgtcaggtgcatctaccatacaaaactcaaaatatcaacattaacaggtgtttgtaagcagttgaccccaaccttcatgaatgactttgaggggtttaagacttcagtagaggaagtaactgcagatgtggtggaaatggcaagagaactagaattagaagtagagcctgaagatgtgactgaattgctgcgattccatgataaaacttgaacagattagtttcttcttatggatgaacaaagtaagtggtttcttgagatggaatctacttacggtgaagacgctgtgaacattgttgaaatggcaacaaaggatttagaatattacataagcttagttgataaagcagcagcagggtttgagaggatagagtccatttttgaaaaaagtcctgtggatgaaatgctatcacacaacatcgcatacaacagagaagtctttcatgaaaggaagagttcatggacttggcaaatttcattgctatcttactttaagaaattgtagctgggtgcagtggctcatgcctataatcccagtgctttgagaggcagaggcaggaggatcatttgaacccaggagtttgagaccagaccgggcaacagagtgagaacctgcctctaccaaaaacaaaacaaaacaaaacaaaacctagcttggtgtggtatcacaagcctatagtcctagcaacttgagaggctgatgcagaaggattgcttgagcctgagaggtcaagactgcagtgacctgtggttgtgctactgcactgcagcctgggcaacagagtgagaccctttcaaaaaaaaaaaaaaagggaagaaattgccgcagcaccccagccttcagtgactactatccttatcagtcagcagccatcaacatggaagcaagaccctccaccaccaaaaagattacaactcactaaaggctccaatgattcttcgcattttttagcaatcaagtagtttttaatgaagttatgtacactgttttgggacataatgttgcacacttaatagactacagcgtaacgaaaacacaacttttgtatgcactgtgaaaccaaaaaatgtgtgtgacttgctttattgcaatatttgctttattggggtggtctggaactgaactggcagtattctgaggtatgccttgttgaggcttcctaaatcttcattacatcaacaggtgtcacaccctagataaaaagttgagaagaatacatccaacaattttttacatccgtaatagtcttagaaactttggtatttactttttccactgaaacagttctctttttctgttgagctgttctgtagaacttgaaggaaattatttctaggtgctgattcaagacctcttagtccatgggtgctaagccagatggcagaagcccaaatctggttcctcataagataactgattggaggcaacacactctggccctgccagccagagaatgagacagcatagctggagaggtagtctgtctaggcctttaaacattccagggttcaggactttgttttgaatctagcaaaggcctggagatatcagatcaatcaccaccctgcctagtgataatgacggtgaattttgtattaacgacctttgtccactagcctttatgcagggatgacttgtttgttttcggctaggacattggcttggacagtctgcagtggcttacttggatcaaattctagagctagaccattccagaagcaccttctaccatcatttttccttgaactgccagagcttattataaaacgttcatttcgtgtttgtggcatatcctcattacagccgtgtttgaattattataagtattttctttccttttgcacagttgaaattcagttatcatgaccatattaagtgtaagccagggagaacttgcatacacaaatccttagtgatttaaactcccactgagctcttgactaatagtgtccctcactcccacctgctgctctgtggattaggaaatatcgtggaaagtgaactggagctgctgctaatttaacaaagtccactgtgtacctagccacattccctctagttctccacctattcagtgcatctcattaagccaccctcacaaatttccttttatgcttctcttttataatactatctctgcactgcctttttttttaaggcccagaaaaacaggttctttgtgggtagacagttcctggtgcacacctttcattcagcactgtaaagatgcaaagtggcaactgagatattaggattcaaaacctcagcactctggatttttaccctgggcttggggaatcaaattttctttttatgaatttgctagctctgattcttctgtgacaccacagtagaaaatcctatcctaattcttaatggtattgttcagaatcctataacttccccttacccatctagtagtttagaataccataacattaaaattagtatgaattttgagtggaactccaaactgacctcttatatcaacacttctaatcatcagccagattttctcacaatctaagtaatttcaaaattattctcactccactgccataagtttcagtgacacacatctactttgatgctgcatgaccttcacttgaacttcattcagccagctgtgtgggtttatgctgggacttgtttccacaccacctacgatatcatgaactcagaaattcccctaggtacccacagacttcagattcagcaaacaatgatttgctccctaccctatgctagatgtttccatacgcagtagtcttccgcttgtccttctaggagcctcagtcgatgcctgaaacttcagatggtaccaacccctatatgtatatactatgttttttctatacatacctgtgatacagtttaatttataaattagacacagagattaataacaataataaaatatagcaatataccataataaaagttatatgagtatggtcgctcccaaaatatcttactgtgttgtactcacctattttcagactgtagttgactgcaggtaactcagaatgcagaaagcaaaaccagcgatgagggtggactgccgtgtgtgagctcatcctcctacctgaagaaaagcctcacaccttctgaaccttcatcctctccaccacccccaggcttctgaaccccctgtgttctcacagttatgagtcctccttcccactcactggtgttttgtcaagcccggaactcacgggtaaccatttcaaagatgcacttgcaatgatgcctgggccttccttgcaggctggagtgtcccctcatagcctcctgtttctttaggtctgtggagtgttactgtgagactcctaaaaaccagctgtgtgggtcgtttctactttcttatcctctcaccatcagctgagcccaatttgctgctagccggttgtcaaatcacatcacagagatgctcaccccattttgtctactgtatgtcactcttttgcccaggctggaagtacagtggcacgatcttggctcactgcaacctccacctcctgtgttcaagcaattctcctgtctcagcctcccgagtggcagggactacaggcacacgccaccacacctagctaatttttgtattcttagtagagacagggtttcaccatattactcaggctggtctcgaactcctgacctcaggtgatccacctgcctcggcctcccaaagagctgggattacaggcatgagccaccacgcccagcatatacctcaatcttaacatctaatatttgctatgaatattgaggatgttttaaattagcttccaggcagggcaccatagctcacgcctgtaatccaatgctttgggaagcagaggcaggaggacctcttgagcccaggagttcaacaccagcgtgggcaacatcgtgatactccatctctgcaaaattaaaaaatagcccagcatggtggtgcatgtatgtattcccagctaactcagaaggctgaggtgaaaggattgcttgagtctgggagattgaggctgcagtgagctataatcatgccactgcactccagcctgtgcaacagaatgagaccctgtctcaaaaaaaacaaaaacaaaaaccgaaactgggtacagtgacacatgcctgtaatcctagcactttgggaggcccaggtgggaggattacttgaggcaaagagtttgaaaccagcctgggcaacatagcaagactgcatctttacaaaaaaacttaaaaaaataagtagcttctacatcataatttactctcttgactagagggagaaaataggtggaaagacatatagcctgtattattctaatttaaagttcaacaggaaagagaagaatgaggaacttctgttttcatttgatatgattttgaagaaggaagaggttaatgtttaaaaaggactgttggccactgacactggatttcactaaatcctgagtgtcaaaggtaattgcagtcatgtggctagtgacatagttttttggtgaagcattatcaagaggagcaaattgaatgctccagccccatctgaggatttcttggttatttattgtgagccattataactacagatgcttcatgagagagttaatataattactggtctatatctttttactttaggagaacagagttaaagaatgagtccattactatttcaggtgatgtgtttagaaagcagagctttaattcaggacttaaatggtattaaatggtgtttcttgaattccattcttctgacacttactgtcataatcatttgtagtgaaacctatgtagtcattcccagcatcccggatttggtttcttccaagattagatacactttaatgagtaggtaaatttcctatttcagtttctctttagtgtattttatcttcaaactttactgtgatattttagtgtgaacattaaaacaaaaaaaggaaaaccatcctgggttttgactgatggttcatcctggaccagtctatggcatttagcattatcttttcttttattgggaccctgaaacttacagtttatgagacttagaagttgactgaagagaagcaggcatccctgtatgaagtcatagcaggtatatcaacacaaagcttgggacagttaggctcacaaaaagtattggtgtccaaattcagaatgcttgatctctgttaagttaacatttgataaaaaaattaatttctttatcctgatgctgatgaagatctcttctgagaatcacagcgatgcttcaggactcataatgatgtgacaaatctttgttactgtggtctctgatgaaaaccaaattttcttttctttcttttttttttgagacagtgtctcactctgttgcccaggttggagagcagtcgtgtgatcttggcttactgcagcctccacttccccaggctcaagcgatcctcccacctcagcctcccatgtagctgagagtacaggcatgcgccaccatgccccgctaattttcgtgtctttgcaaagatggagtttcaccatgttgcccaggctggtctcaaactcctgagctgaagcgattcacccacctcagcctcccaaagtgctggcattacaggcgttcaccactgcacccagcctgaaaaccaactttctaacaggcaaattgggcaagttaggttttaatgtactaggagtagctctgaaattttaaattggaatgtgtgtcaaagaatttgtagaattgagggagcttgcagtgtgttgtggtgtcttggaggccatacggtgtaggagttaaaacttggaccctggagccagtccagagcccatttttgcctcctcctaaacatatgcttcaggcaaagtacttacaatttctgtgcctcacttgctttatccataaatcagggctagtagtgacacctatctcatagggttattaaagattaggtagaataatatctaaaacatgcttgtaactgtgcctaatcaggcactaatcaagcagcctgtaaatggtaacgaatgttattaatatttggaaagctttcttagttcaacagctttatcttagtagttttaagaaaccaacatttctgctaagatgtctaaattttgtgtttttttaaatgtcttctcttaaatttaaaaagaaaagaattctttaaaaaataaaatttgttttttctttttttttttttttttgagaatcttctcctggaaggatgtctaaattttggaagacttgaaacaagttaaaagaaatttgtttctggtctatgagaaaattgaaatcagtaattctgactttaggcaggttactaccccccttcccgtccttctctcttgttttctggatcttctgcttggcctccaggagtccagagagggaactgtgggatgtgaagactcattaaattcacatgaggtatcctttaagccctccattgagattgacccccgcttaagtacatttcagctcaaaacgctgccttcccccacttttctggggagcagggattacttttcttatagcccctgttaaaagaaaactccagaaaagttaaattcagtggagtttaattgagcaaaaaaacagaaacgattcacgaatcaggcagcgtccagaatcacagcagatttggagactccggggtgcctcgtggtcagaacaagtttatggacaaaaggggtaaagtgatttacaggaattggaagtgaggttcagaaacagtgcgattggttacagcttggtgtttgccttatttgaatgcagtttgaacactcagcagtctatgagtgattgaagtatggccgctgggattggccaacactcagctattgttacaggtgcatattactagttaggttttcaattttgtctgcctattaagctaggttacggtttgtccacaaggactcaaatatagaacgaagtcttcaggccatatttagtttgctttaacacccgcctcaagcttcattcctttttggaggtgaaaggaatttatccagtgttcttgcacgtcagtgaaggaaacctttccagtgaaaaggagtctgttgacctgcctaggctggaccagttccagtatcaacctgggccaactcccagtactgaggctggaagagcagatgccccctgataaataatcttttattgtttccagaaatttcccaaagcttataaaccttaaaatatcctgaattatctaaaactgtggattgtgtcctctaaaaactcctaccaatgcccttccctccccacatttctcttcccttccctacaggtgactttcaagtgtggtttgtgtaaagtattattagttccagctatttagtgacctcttcgttctcagtgaaacctaataccatccacagtaatgattatgcatgtctttaggtagggattaacttgttacaagttttctttgattaccacagtcatcttatgtatattcaattctccctatttgatattgttatattatacagtatatcagtggcaagatgtgttgaattgagatgaggctgttaagaaaaggttttctaggaaaacataaattggcatttactcaagaattttctttaacattacattcaattaaaaacacagatttttttgttgttgatttgacaaacaacaaagaaatttctcaaggcttaaatacattattaaatcttctttaccaatcactttggttttgttacatcagcatgtttataaaggttttctgaaggaaaagattatatcaacatacacttcacaggcaatgtctaatggttgtttttcccacagtggaaaagatactgtggttacatgaactacatttaaaattccttatttttgctacttgccagtaataagtcctatatataaattattagatttttatttttttcaaacttttaagttcaggggtacatgtgcagatttgctatagaggtaaacttgtgtcacgggtgttgtacagattatttcatcacccaggtattaagtctggtactcatatgtttctggatcctcttgtcctccggtaggccccagtgtctgctgttcctttcgatgtgtccctgtgttctcatcatttttcttttacttctgactttttataacttgaaaataatctcagatgcctagcgattgtctagctatagcaaatatttttattggaacttattatccttgacaaccacttttataatagcattgtgaggcaaacagtacttttacatcagacacacaaaaatggggacactaaaattaggacattatggctaatgttcatctctctctcccttcctctccctatctccctcccgagggggagaatatgtacccttgcagccaatttctgtaattttactatatatatatatatatatatatatatatatatatacacacacacacacacacacacacacattacatggaaatgtaatatacaattgagttcttaaaacagtgttcaggaagatactattttatggcttgcgaactcagcttatttcaccttataccttgttgtaagattatatgcctttctcagtcttttattttatcgtctgtttggccctaaaaaagggagttacaatgtttgcaaaattattttaaaaaacaaaagaagcagagggccaacataataaatactcatggaccccaggacccagaccttttaaacacattttaaatattttggctgggcatggtggctcatgcctgtaatcccagcactttgggaagccaaggtgggaggatcacctgaggtcagtattttgagaccagactggccaacatggcaaaacctcatctcttctaaaaatacaaaaattagccaggcgttgtggcacatgcctgtaatcccagctccttgggaggctgggcacaagaatcgcttgaacctgggaggcagaggttgcattgggccgagattgtgccactgcactccagcttgggcaacagagcgagactatgtctaaaaaatttttttaaaggtaaatattttatattaaaagatatatttatgggaaatgggctggatgcggtggctcaggcctgtaatcccagcactttgggaggccaaggcgggtggatagcttgggccaggagttcgagatgagcctggccaacatggtgaacccctgtctctactaaaaatacaaacatttgctgtggtggcacccacctgtagtcccagctacttgggaggctgaggcaagagaattgccagaacccaggacgtggaggttgcagtgagccaagattgcaccactgcactccagcctgggtgacagagtgaggctctgttcccccccaaaaaaaaaacaaaacaaaaaacgatgtatttatgggaatacaaattattatggctaatttcgtcatttcctgtgtatccttccgtagtctcacctccttccatctctctccctgtttccctatttcccttcccagggagataatatgtacccttgcagcccatttctgtaattttaccacatatatatatctataaataatacatcatttgtgtgcttaaattgacataaattatgtcatattaacatatcagtttgctacttttacttcccctactgaagttttaaaatacccatcccaagtgataaatatagtttaagtgctgcctagaattctgtagtgtgactttactgcagtttatttactattccccaactgatgaatggagaagttgattatagttttgttttttcactttgttgtgactacaaatcggtgctgcagtaactttttatagtgctctcttttagcatatatgcaaatatatattcctagaagtggtatgtgctgtgcattttcacatgccaaattgccttccgaaatagtttgatcagcatacttctgcctgcagctcatggcagtccctatttccccatattcacttccacttgatttagtaagacactttgatttttgagaattggatggctataaaatggtatttagttttaattagcaaaattaaacattggttaatgtagatttttttaaataatggaaaggacagcactgtttaggtggtttttttccccttaggggaaggcaagagaaattgctgcatcagtaatctggtataaagctaattgttttcctaaggtatgccgagtcactgggggaggaaacagatggtaccagcactgtgcggatctgtgggaagggcaattatcatctccattgacatggcgggtcagggttagagccaggtttcagattcttcttcccccacccccctttttttttccccctcagaaatccttgtttggacagattcttcttttggaaccacatcgagttgacagacctgagcctttggttttctcttcttcttgcttcacttccttttggtcattcagcatcaatactattaggtgggcagagaaaaagcaaagtacataaaaagttaagttggccgccttctttcagaataaaggagggaaagggagaaggcaccatttggggaagatttctgaggagagcatgtattgaaaactttgcttaagattagatttggtaattatttctgggtttccattattcatgtagtccttgggcctgattagcatttgtaaagtataaactctacacatgcaaggcattagcatgaataattaaaaggtagggagttagctatccatgactgtggttttcttttattattgtagagtctattttagttaacaagaggaagcttagacttgcagactgctggtctggcaacctcagttttgctttcagctcagccatatatcatgatgcattgtatggctgccttattttcctggaaaaagaaagttactttgctgggaaaaaaaaaatcagtattctgtgcactctattcatatcaattataagagtgcagtctgaattcctgagaggagagctctgcttagagtaagcatatcaaactaagtgtaattattattgtacttataatttaaaactaccttggtctttgttataacccattgattcaggacccatcagcccctacaaaatatcgctccccaaattttggacatttcccaggggtatctgatgtgctcacaaaccagtcctctgcaggaatgccacattcatcctggaagcatcttcctgccggtgctctgtgtgccactccactacttatgctttgcagttatgtttcccatactggggttccacaaggcactcctagtgcaggcctttaatgactgtgccaacaaaagagtgtttctaattcaggttacttttgaacttgtaagagcctttagtattttattacgaatcacaaagaaaggaatgtagtatacttatctggccagggaataattctgtgtgggatgtctatgtgtgtataccactttaggaaattatgtagcatgtgtatgcgtttgtgtgtgcacacacagagcacttcctaagagattcttcatttgctgctccttggtacaaaagccatgagctggatctattgttgcaaatggatgaattacacttttaaaatggcttttggtagattccttgacaagccctggtgtatttaattttaaagtcaaaattggacccctgctacataaaaaatctataaatctaacttggctgttggtgaaaaatgcacaaaaaggcatctcagcattttctagttcttggtttggaatctagtggcaaatactactacctctgtgaatgccaggctctggtccatgaagccatggctgcctgtggccctctgaattcacaggaggaatctttccttattctgcagcctcacacccagactgtgatcctcccttcctactccagatgttccagtgagtagaggagaagagaaaatttgtgatgggaacttaatggcttcatctggagccttatctgagagctgcatgtgagcaaaccatggtggatctgtctattctctctgttctggaaggatgagtgcgatgaaagttgtcatgctgtggtctgatcattgcgtaacttaagtttgacatgtgcaatatataaaaaaagccatctgggcataaaaattggataaataactagggtaaaataaatgataaataagattaatgagacaggagtggaagggaaaatctgaaaaaatttccatttccagcattataatatttagttagtaagagaaatgacaaccaccatcatgagtggagcacttaccatgtggaagccatgagggtgttctcttaagggaggtatttaccccattttacacaaggtaatacctaaaccccagggtgaagtaactagcaagaaatatacacagctagcaaatggtggagcagctttcaggcccctctgactccaggccacctcctggccctgtgataagaatataagaactggagaggaagtgagtgcttttcatgagggaacagacctccaggggtctgttgcccgaagcttcatagtgactggtcactgttctgcttctctggctactgaattagtgtcaattaaaataaatacatgtggcaaactgtttcaacatggaagagaattaagggaaacatttcaggtttttagttctactttggaaataatattattctttatttttcttttctcaaaaggagcatgtgattatgtttagaaagtttgtaaaacataaaatttacattgcaatgagggtaatcacaataataagattcttggaaaactcctgttgacatgtggatgtattttttttccgtctttttctgtgcatcttcccaatgatttggaaattagaggctctgctttaaaatctactaatggttatactgtaaaagatttttcttcaaataatcttacattatctgacagtgacaaaaatatttttattctgctttgtaatagatgagctttttctcttcttaaaataaaaaattagagaaataattaagacctggaatatgggattactcataaatcaaagcagatgttgaaacacctgatttttaagaagctgttagaagtttgctttttcccattcaaatccctttgggattcaggtagatgcacttagtgtaaccacaagtacaacactttgctacgtcagcattcctacgtttagaggacgatagtatgtctaacattactacaaaacctgaaaagaatttgatttatttagagttactttcaaagtgattcaagatcagtgaaaagatgtttactaaacttagggcaattctatgcaacagcgagacagatcctccataagtgtacagacgcacttagatgttaagagattaattaaaaaacaagtcaaatattagtatgttccataaagaaggaattgagaaggaaaattccatttgaagaatcaatgttgagactgtgagcaacagttttcctggcctgggatgccaacgaaaactgtagaatttgaaatttttattgggataattgtttataataattgccagtatttattgaacacttgctatgtgccaggtactttgtatagataatttaattttaatcctcacaataatcagatgataaaggcagctactacaatttcctttatatatgactaaattgaaactcaaagaggttaagtaacttgctcagaatcacacaactaggaagtgctggagtctgaactagaatacaggtctgtctgactcaaaagtccactcaactgtttttgtttgtttgtttgtttttgagaaagggtctctctctgtcacccaggctagagtgcagtagtgtgatcatggctcactgccagcttgacctcccaggctcaagcagttctcccgcttcagcctcctgaatagctaggactataggcatgtgccaccatgcccagctcattttaatttttgtagagatgagagctccctatgtcggccaggctggtctggaactcctggactcaagcaatcctcctgcctaggcctcccaaagtcctgggattacagctgtgagccactgcacctggccatcagggttttttaaaactgtaaaaggtttgtaaaaacaaaacacagagaagaatgtacaacatacttgtggcccggaagcctaaagtatttcctgtctgacactttatagattaggcttgttgacccctgtcttagctctttctctgtctggagagataagtagtggagtgatcaagggcatcagttgtggaattggagggctctgcattggcttcaggctgttactgtcatcagctgtgtaactaggcaccgttacctaacctctgagtcttgtttttctcaaaccctgtaaaatggtgataacagtacttaccttggggttatcgcatgaagccccatattagttaggattgtgaacaataaatgaaactattggcacttgtaaatcatgtgttcagaggaggtgggtgggttctttttctccttggaagtgaaaaagtcacagagcctcagggctgctagcccaaagaggaggccagagctaagaaatctcaggccggacaggatggcttatgcctgtaatcccagcactttgggaggccaaggcaggcggatcacctgaggtcaggagttcaagaccagcctggccaacatggtgaaaccccatgtctactaataatacaaaaattagcagggcgtagtggtgcgtacttgtaatcccagctacctgggggttacctggggggcagaggcacgagaatctcttgaacctggaaggcagaggttgcagtgagctgaaatcatgccactgcactccagtctgggtgacagagtgaaactatgtctcaacaaaacccaaaaaatctcagcgaaatggagctagtatcctaatgacttcctgaactttcagatcaaactgaagccttttctacttttgggcctgtcagttgtgaatgcctataaatttctttattatttaagtcaacttcgttgggttttccacacacacacacacacacacacattgccatataggtacaattgcccaagccacctgtgaccgaatggcttgtgggatctcttggttcacacagtctttcatctcctccatcttccatttttccaaactcttaggtgatgtttgggactctacctttcatctccctctaaccaccaaacattctcaatccatttcctctgcacagataagcatgttcccttagacacaggtgcatgtgaacacctgagtctcaactcacagagacttctggttttcatttcattttagaaccagcgtctgcactgtcttgtccaaagtcagttggaaagaaaagtacataaatttgtgactgtttctcctttcatctcccttcctatccatgaatcgggcaggtcctggtgttcccagtgtcctcagttacttgtgctactctatgtacgggccctattccctctactcctatcctatcatcatgctgatgatgaacatcacagtttttaagtgttcctctaaaaggcagatgggtttaactttacagtgtgcaaatctaaatataggattctttctttgtatctgaagagggatccctaaaacttttggggtccacaaattatcaagtatatgtgtatgtcctaatgtgcatttttctggggaaaaggtgtagctttcatcatcttctcaaaaggacacatgacctaagaaaaggataaagtctctcacctttgtcagttgagaaaaataacaagtctccatcattttaggaggtttatttgtcaaagttaaggatatgtggtcaggagtcaggtctaatgcctttctccaaagatgattttgagggctccaaatttaaaggggaaagggtggtatattgagaagtacacaattttcatgtaagagaggggctagggaaaaacagtcattcatgcctttgtctggctcagtgaatctgctttcttttttttttttttttttttttgtgacagagtctggctctgtcacccaggctgagtgcagtggcacgatctcggctcactgcagcatccacctcccgggttcaagcgattctcctgcctcagcctcctgagtagctgggattacagatgtgtgccaccacgcctggctaatttttgtatttttagtagagacagggtttcaccatgttggtcaggctggtctcgaactcctgacctcgtgatctgcccaccttcagcctcccaaagtgctgggatctgcattttttttttttttaagtaagatgacatagacatggggtagaggaaaaatgcagggaatatgcattttacataagataacaaagacaaaatggggcaggggaacaatcagattgcatttgcatctggtgggtggtgtggggaggtggctgcacctgcaaagataaactaccaatttacactgcggtggtgaaattttaacaaaaacaccttaaagatcttgcagctcactaggaattttcttgtgggcaaaaatattggggaggcctgtagcttttcatcttgtagccatcttatttaggaaccaaaaaaggggttcctaaataagccagtcattctacaattccttccttttgggagttggccttctcttcttacccccaaggttctgacagccatcactgctgctttggagttaggagaagctctgtcctcatacagcaagagagagatatgttcctggcagctcaggttgaaactctggcccagggaaatatcactacatgatggcacagaaagcagtactttacgttataggttaggttatggatcaaatgggctttattttattcatttatttttttttttgagatggagtctcgccctgttgcccaggttggagtgcagtggcgcgatctccgcttactgcagcctccacctcctgggctcaagcaattcttctgcctcagcctcccgagtagctggaattacaggcatgtgccaccactcctagctaatttttttttttttttttttttttttttagtagagacggggtttcaccttgttggccaggctggtctcaaactcctgccctcaagagatccaccctcctcagcctcccaaagtgctggaattacaggtgtgagctactgcacctggcctcaaatggactttggtcagcctaggagccaagttaacatatgtaatattgtttctgttggggaaatatttttaaatgccagttaaatgccatgttcacatgtaggggactaccagtactggtaagtatatatgtataatggtgtatgaaaattgataggatcttgtggaatagtatcttaagtaaaaagaaaaagagaaccagagaaacatgacattgacaaatgtttacactttttccccattgtttgttgagtgttaactccatgtagttttcacatgaagctcatcctatccatttattagttgtatgacataaaggaatgagggatgtgagaggatgcttaattgtctgtccttttgtgacaactaaggcttctcttcttttccaaccacaggtaattaggagctgctactaagaggaaacttaaacaatgtcccccagtggatatcttttcttcccctgggggaaaatacctaaatttttttgcaaatagttaatttccctttgccccaccctggggtagggagagatgggtccagtatattcatatgacaaaagaagtatacctgttcagtaacataacatggtttggggatgtaagttatgccctttataatttgtagcttaaggaacatcctgttataacttattattttaattgttccacagactgaaacattccttaccaattaagccctccttgagccattattttgaggggactttcagctttcttattaatatcttctttttccagtatttaatttttctttgttttgatatgtataaatcaaagagaaaaattcaagacctgtgatccttaaagataaccgtaatataaacttgaaaatgttatttccctagcaaaatctatagattctgttggtatctatagattctatccaaatgcatatcgtttttcacactggggacatgtggacctatagaaacccctgtagagaaaacctttccaagaaagtttaatatacctatcaggaatacattttttaaaaaaacttatacaggttgagtaaccctaatctgaaaatctgaaatccaaaatgctccaaaatctgaaactttttgagcacccacgtgactttcaaagggaatgctcattggagcagtttggttttttggattagatatgctctacgtgtgtgtgtgtttatgtgtgtgtgtgtgtgtgtgtgtgtgtgtgtattctcacacttctcacttgtcatgaaaataaacctatgtatttaaacccagaatctggaagactagagttcaagaatgaacttaagtaagctatgaccaaattggaacggtccacacacaatcacctggatatgcatttttctgagaggattcagagctcctggtcttctcttggagaaagttttaacaccatttaggaaagttttcggagtaagttagataatggacttaaataaggtctttctcctcttcttggaagaaccatcaattttctacatgttcaagctttcagggtcttagagattcaacggagatagaaggtgctggctataggtagaagacagtaatggtaaagataaagagggtcagtacaattccagaggccaagtagagcttctgctaggcctcattttgtgttttgagcaggttggttctgctgtataagaagttttagtgatgaccttagtgttataaaatgaggtgtcacgctgtctctcatttctctctgtttgtgtgtatgtgtgtacaggagataacctttcatctgtggtatctatggacacccatgctctgtattgttggattcaaaggctctcaaggaaatattctgtccactgatttaatgcataggatttgacacagtgtgaaattgtcatctcaagttttgtttttaggccccttcttaaggagagagacatcttttgaggactagtttttttctagtttgtctatatcctgtcaatacaatctttcatctcgtgtagacatgacttaataatgagggatccctgtggattagttgtagcctcagtgtacatgaaatgagagatgataatggttatttaaggatttttcttaatcatggtaaaagacataacagaaaatttaccattttaaccatttttaaatgtatagttcagttgcattaagtacatttaccttgttatgcaaccagaggatttttttaacagtgaatttttctgcacaagtatttctatcttgcctagtcagagatttctccccagaaaaccatatatcttaccccaaggacaatataagtaaaatatgtttgctaaaataactgagcacatcagtgtaagtttttacaataaataaaagactcaatgttacaactgccaccaaatctgttactaaatctgtcagaattctaatttagctactgcatatcacaccctatgaatgcagcctttcttgtagcaaatcttcacatttcccatttctgtttcctaagtaacagtctatttctaggtaggctgcaagactgaaggcacacaactcagcacgcttggttctactaattcgttgcaatgatactgattgcctgttacactaagataggctatttccagttatcttccatgtcatagatttcagcctctaaaaaagaaaagtggttttatatggtacaaataaaaatggtaaggtattaagaactctaaaggttgtaattacttataacctgagaggtcggtaggttgtgccttccccattttacagacatgaaacctgaagctcaaagcttaaataatagtctcccattacagctggatttcaacttacgttgccttgctatagagtactatagggtgttagagtctaatgccattcttagacttatggggagataaaactgcagatgggaagcctttatcacatatgtctgagagttttgaaaaataattgaatcccaatgagaacgatacaatgctctcggtatgggtttttcaacatgtttcataggaattactttgcaaaactttgagataatcattgtagaattatgacttctaaggggagggtttaactgacagatggtctcttagtctcccttcttcaaaagttgaaaatagaagccaggtgtggcaagtgcgctcctgtagccccacctgatccagtgtctgagacaggatcccttgagcccaggaagtccaggctgtagtgaacaatgttcaagccattgcactccagcctaggggacagagtgagacctctttaaaaaaggaaagaagaagccggtgcggtggcttatggctgtaatcccagcactttggaaggccaaggtgggcggatcacctgaggtcaggagttcgagaccagactgaccaacatggagaaaccccgtctcttctaaaaatacaaaaattagccagacgtggtggcacatgcctgtaatcccagctactcgggaggctgaggcaggagaatcgcttgaacccaggaggcagaggttgccgtgagccggatcgtgccattgcactccagcctgggcaacaagagtgaaactccgtctcaaaaaaaaaaaaaaaaaaaggaaagaagaaaagagcacaaaaaaaaaactgggaagacacatgagacaatgctttcacatcatttcttggcactattaagtataacagttttatggtttatattattttattcaaaagaatttttccaatcttattttcttcccaaaaacaatttttagttctaggacaaaggatttattaattttacataataaaattatacaaatatatatacactatttctgtccagtggtgtttcttccttccaagtagacagacattaagtactttatttaataatactctaacaggctttggtgtaagccactgcctttgctcctgagaatactttgaatgaatatatcattcgccatttctttatctcttggttttcaggaaaatttcttgggttcatctagctaagttaagatgcataattttattttcattacttttctgtattttattcttttatggaaatattgccctttatactgtaatttcaaaatcagttaaaccctactgatgcagctcagcaatcagaatgaatcttccaattttcaaatgataaaaaccagacaacagagaaatgtaactgctttttcccaaactcccaaaggaaaacattagagctaagattatatttacatgtgtttttaaatcacatacttttgcaacagatgacacttatttgaaagaaagttttccttttcattcatcagaaaattacatgggagggttcatagttccaggagtttaagatgaatatatactttgagttcaaaaatacttaatagtcactgtaaagatactaggtgtacttcccggcttagagataactgtgttcatattactgaatccaaagactgtaaaggaagtgattacaagtgtgttgtatttactgcctatagtatatatattccataatgtctgctcacgcaagggatctaggttgtgcactccttatgagaatctaactaatgcctgatgatctgaggtatgacagtttcatcctgaaatcatctctccccccaccccctgcccctggcccagagaggggacctctgtcttgcattatagctatttgtttacatgtcctaatcaccttcttttggaatataaactcatgggttgaggagcataacagagaaaatgtatttccccccgctctccccagtttccctagtaacttagctgaatgttgagatacagatgattaattatggagtagctctgggtgactatttgttatgtagacttaatgcatttataacatgtttattctgctgttttcctgtaaatgccattctttcagatcagaatctgaaaccaaagagagccagccaatcacgtgggcaggattacaggagcatcattttaatgtattgacttttcagtctatttctgtatttaaatctaggatttccattcaatcaatataacccactaattgagtgttagactcacattataaaaatgattttgaaaagaaaataagataggagagattatagtaaagctctacttttattatgttttattcttcagttttgttccttgcacagggatacaggtttgcccacagggtggtggttcttcatctctgctgctgtgtgagtaatggctgcccaccgcctgaagtagttgtcatgataaaccgggtgatgccattgaacagactgggtttgggcaccacagggtgagaaatctaggtcactagtcataaacagctttgtcctaggaagaagaggcttgctggttgtcatctgtctttgcacaaacagctcatcctggcacttaaaatcattggcataaattgggtcagatattagattgaattatatgaaattgccctacttgtccatttttgacctaacatgacaatttcatgttgttcagcttaacacaaagtacaatgaagaaaacctgttcaaatgttagtctcttatggtgtaatttttacgttttttaattaaaaaaatgctaccagttaaaaacaggtttaatagtctgtgagaatttatatagttaacacctttcactttcagaagcatcattattctaggcagaaatgacataggagagtagagatggattctaggacttcataaaaaagttcaaagacatcacaaagtcctaacaacagtaatgccaaagtctttgcagcatgaagtctgcatctgaaagaggagtgattatggggagaagggaaagggatttttgggggataagatgagctctggaggggatgtaggatgagagtctacaggcaagggcctgtcagacagacctataggtgtgagagagcgggactcaggcccacagaagcagtgatgatgggaatataccttagtgccgagcttggctcatcttccaagcagcacaggtaggtagctggggagacaggcacatatgtttttccacttccacttatcccaaaaggatgaattcagactcacaccctgaaagatcatgctatgtgctgacgtctgaaatcaggtacctgagggatcccatttttgctttgctactagagaagtaaaattcaaatgtcctaaagaagcaattcatgtgttggttgataatattgaattgtagtcaacttaataattagagtgagaaaacactcatcagatcctttgtggcttgaattattgagaaaagggcattaagagtgtactgaatcaaaaaacaggtgatgaggtgtgagaataatatgagagcatgataaccagctaagtttaactaagatcatacagtatcttaatgacatcgtttggcatatttgtatcattaaaacaatatagtaagtatgatggaagtggcttttccttggatcttgtatttgtcataactaaattatattattaagattttattcagctacttaagaaaatcttcctgatggcttttaagtgtgatgttcctgaatcttataataatgattttctattcttggctctttgggttgcttctgccacttctattttgaaagaacttaataataaccacagggttaataataacagcatgtgattgttgaaggcttaatggctagagcatttcattgtgacttttcatgtagacatagaaggattttttactttttacaaactcacaggctatcttgtgccagcttatatatatatctggaagaggaattgtatatatttggctgacttcagttcacaagtgtcttatgaatctctgtggcaaattgatatatccatccatggtagaaggcaggagactgccatggggatttgtctccaggatcatcaaggtcctcagtataagaaacctgatgttacaggccaggtgcggtgactcacgcctgtaatcccagcactttaggaggccaaggtgggtggatcacctggggtcaggagttcaagaccagcccggccaacatggtgaaaccctgtctctactgaaaattataaaaattagctggatgtggtggcacgtgcctgtagtcccagctactcaggaggctgagacacaagactcacttgaacccaggaagcaaaggttgcagtgagctcagattgcgccactgcactccagcctgggtgacagagcgagagtctgccaaaaaaaaaaaaaaaaaaaaagaaacctgatgttacagagcattgtaatgaggtaagaatttcctagagtatattgttgccaaataaactaaataaatagtatgaagaggtaagacaaagttacaggcctaggcaagaatggaaaagaaaaaaaggaatcattaatgttcgggataaaaggacagatattaatcgagtatttgctggttaatagcaaaagaaacatacttttttttctagctgaggattttcatgagttgtttttcaggatacaagcgaatttatacaattccttacctgtcagtacaacatgcattggttccccttccccccaacagatggcaaggtgaattatgaaatctcataaaaaaaaaatacaactagtctactcttggaaggtagagatatgtccttatttgaaatggtttgcggtgtttttcaaggagatgagcacctactgatctctttctgtgcctattaaaaccagaaatcggagctggatgtggtgggcacctctgtagtctcagctgcttgggaggattgcttgagctcaggaatttgaggccagcctaggcaacatagtaaaaccactgtccctaaaaaacacatttttaaaataataaacatcagaaattggtaaaaacattgcaaaaaagagggatggtgagggtaagcattgtctgtttggggattgagattatgcctaaaattttaagattcctaacgatgacttgcatgtgtttcctattatgtgctattagttatttctcattgcatctaagaactttattaagaagtacctagcggccaggcatggtggctcatgcctgtaatcccagcattttgggataccaaggcaggcagatcacgagatcaagagatcaagaccatcctggccaacatggtgaaaccccatctctactaaaaatacaaaaattagctgggcgtggtggcgggtgcctgtagtcccagctactcgggaggctgaggcaggagaatcgcttaaacccaggaggcggaggttgcagtgagccaagatcgcaccaccactctccagcctggcaacagagcaagactccgtctcaaaaaaaaaaaaaaaaaaagtacctagcatggcacatagcaagaatcaatattttgttgctttactggaggagacactattattttttcttttataaacaaaagtagaattttgtgtgataagttttttcttggagcatattgtcttcataaaataaacatggaaaacatattgttttcttctcctacagttgatacccaaaaaaagctttgtgaaataatgccaagatagtgtcactactaccataaaactttaaaaagtgaataaaaatgtgagagaagttaacacttagcatatggtttttcccaaaactggaaaagcttgtacaagaatattatctagaaactacttaaaactttaaaaagtgactttgaaaagaaaatcgtcatagaaatttgccttttgtaagatgttacaattagctaaatatgaacataatgtgaaagtaaataaagcataagccgccctttcgcaataatactgtccttttgaaattttttgagaggcccttttcccagaataagtatgactcttaacagaggactttccgctctgtatattagcgtatgaagtgcgtgtccatgttaatggtccaacttcaagcatcttttgtgccatcattaacaactggaacacagaaaattgtgaacagaaatcgcctctagacatctctcagttgttaactgcctaaatattgtgaatgtaacatgcatttttctgatgagaaaagaaatacaatttttttttttttcctggagatcaagtcatgctctgtctcccaggtgggagctcagtcgcacgctcatagctcattgcagcctcgaactcctgggcttaagcaatcctccctgctcagcctcttgaatatctgggactacaagcacacaccaccatgcctggctaattttttttttctttaaatttttgcagaaacgggatctcgctatgttacccaggattcctggcctcaagcagtccttccaccttggtctcccaaagtgctgggattacaggtgtgagccactgcacctggccatatttatttagaaagtaaaaaaatttaaattgtttctaaatcatctataatccctaccatctctgtataactatgtcaacattttggtatttattattctggtctttataaactctatcgtatgtgtgtgtttacaaatctggcatatcattacatatatgattttacaacccattttctttacagtttacagcagaagcatttttgaaacattcttctgcaatggttaagatgggtatccacttatttaggatttcttcattaaggattcaaacatacttttccacctctccccaccacttgtcaatgtcatgggcaaagaaatggtggtttattttatgtttttgatttttcaatcctgccccttccataggtggtttatgttttagtttgcatttatttgattactggtgatgttacatattttgtatacttgttagcactttcctttcttttgtcaattacatatttcttctgacatttttattgggatgtttaaccttttataaataaagtttacttaccttttgtcaaatgtgttatagatacttttccattttaacatttgccattttgtttatttaaatttttgttgttttgagaatgatgatttcagatatcttcctattacagagagttgattttgggatagccttaggtggttcaatcagatccgcaccaaaatggtttcaaatacccaagtgacctgtaaactgtaaattcacaagacccaatgaaccctaaggtctgagctctggggcataaccacagcctcaaagctagggcaggattaagccagctcagatgcactcagcctgcagaatctaactaggtcagtctgctgtggctctctgagattgtggggctatttttgtcagtgtctcttctgcctatgaaaattagaattgaggaaagctacagatgcttcccatatggttgctattagtgaaattatatacagagaatttaatttgaaaacagttgatacactcacattatttagagacttaaagggctgtgaaagatactctagctatcacacctgcaactctcctgtttgcagggagccttcatcttacatgtggtagccttctgtcctgttcttgcttttgccagggaaggagccttcattctggtgttcatgattttgccgggcacataatgtagatcttcattaaggattcaaacataattttttcacctttctttcccctccccacatcacttttatttaaatatatagctcctagattttggcattgactttagtgaactcagcagatagctgctctagttcttcctgtatctaggatttagagaattttcatttgcaatcagttgcacttgttcttacaacagtttgtgtagatacagcagcaagcaggctgtgatggtttattactctaattggtctattagatgtacttgatgtttcacaaggttctaggaggagaaaaaaatgtttgtccacaacttgtggagcctactaatggagtttaatatctatttttgtcatctgtgaaaatgcattataggttctatttaaagcattaaaaaatctgaagtggccgggcgcggtggctcacgcctgtaatcccagcactttgggaggccgaggcgggcggatcacgaggtcaggagatcgagaccatcccggttaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaatctgaagtggaattgatcattaagtcatcaaactttgttaccttctactaaagcaatcaggtgaccctctaaatttgatttcccctaaatttccaattaatgtgcttatcctggtacatttgatttacaaagagaatttactgccacatggtattcattttatgggaaatgtcgtgtcgaaacaatattgtgtaactatatcttttaaagacaatcctgcaataataaaactaataaacataatgtaatgacatttgtaaagtgtatcccagaactatcagtagattaataaatattgaggaaaaggaacatcctcagtcaagtaagtttagagaccttattgagttgcttgctttactgtaagattcctcaagacatttaatatatgtgttaaaattctctaagagacacaattcataccatttttcatatacatttaatatcagaactttccaatatcagagcacactcttggtaaatcctgagctacagtagaagctttgaaataagtgattaagaatattaatgttacgattcacagcttaagaatcgttgaacatgggtctgggcacagtggctcatgcctgtaatcccagcactttaggaggctgaggctggagatcatttgaggccaggagttcaagaccaggttgggaaacatagtaagacccttgctctacaaaaaaaagataaaaattaacctagcctggtacttgtctgtaatcctaactgggaggctgaaacaggaggatcacttgagcctgggagtttgaggctgcagtgagctatgataacaccactccactccagcctgggtggcagagtgaggaccttgtctaaaaaggaaaaattatgatatttttgattcacagtttaagattaatcacagtttaagcaatattatgattcacggtttaagaatcactgaacaaatatctatattcaagtacagaaaacaaccctcaattgattaagaaaatgacttcccaaccctaaattctgttgtgcaagatattggtgaagaaagccgaggaattctacttattgtctaagagtttaataatttaggtggcaaagaaagcattaaataaatacatctacatcataccagaatgaccatgggcagagagaaatgggactcttttcttccattgcaaatggccgtcacaacaataatgatgctaagttatgccaggatccaactaaagtagcctttactccataattcaaaattactatactttactatttaataagataatgtttagttagcttttattttactttaggagaaaaagtatgagaaatatttctttttgcttttgtgtttaagaatagtgccagttcttaatagggctcaagctgctcaatgtgaggtctgtcctggccctaggaggggaatgctggactcacttgagatggatatttcagggcttcgcgtgagccaagaataagaatctcaagtcaactgatgcgtggtctcaagaaattgctcccagaaattcccccagctcagcacctgctgctctagataagagagattctatcaccctttgccacacagagccagcaagtttcaccttcaaattgctctttgctcaattttcatatttatttctggccagttttaaattaggcatctgacaatttattccatctgatcaaatcaatctgatttttttctgttgaaaaaaggttaaaaatatctgaaggtaggccactatgtaaaagaatccattttcctatttcctctgaagtttacagcaagacagttgtaatagaaatggagaagggagtaggtaagaagtttactttctttctttttgtatcttttgctttggagaaaacgtcagtgtatttttagaaaaacttttttttgttttgttttggtatgttttacattcaatttttttccattttaactaatgttcctgtgagtataaaggagccaaatgtcgcattcattttttttaactatcaataataaatagggattcagtggccttggtttaaatatttttaaatttaatttaatttgtaaaatacttttatatcaagggtacatgtgcaggtttgttatgtaggtaaataatgtgttcccggggtttggtatatagattattgtgtcaccaggtaataaagcatggtacccaataggtagtattttagtcctcacccccctcccgcccttcaccctcaagaaggccctggtgtctgttgttcccttcttggtgtccatgtgtactcaatgtgagtgagaacatgcagtatttggttttccgttcctgcattagttcacttaggataactgcctccatctccatccatgttgctgcagaggacatgatgctgttcttttttatggctgcatagtattccatggtgtatatgtaccacattttcttttcttttttttttttttttttgaaagatacttcactttttattcacttaaaatagcatggtcacaaatatatatacaactaaaacaaacccacaacaaaaggaatacatctctcagtaattaataagacaagcagacaaagaattcaatcaatagggacgtggaaaacttgtacagaatgaaaaaacctgatcaaatagacactgcatacaacatctgcacaatatatatgccttttagcagcaaaatggaatatatattttttttagttgaccaagttctggagcaaaaagcaaaactcaacacagtttagcggttttaaaatacacagcttgttgcctgccaaatcgatctatcatcttcggacctcatgctgagatccagacctgtgtatccaaccaacaatgtgctggaatggtcttgtaagagcagacagtgcccattttctttatcgtgcctaccattgatgggcatctaggttgattccatatctttgctattatgaatagtgctgtgatgaacatatgcatgcgtctgttttttttttttttgagatggagcctccctctgttgcccaggctagagtgtggtggcacgatcttggctcactgcaacccctgcctcccaggttcaagtgattctcctgcctcagcctcccgagtggctgggattacaggcatgtgccaccacacccagctaatatttttgtatttttagtagagacggggtttcaccatgttgtccaggctggtctcgaactcctgacctcaggtgatccaccctccttggcctcccaaagtgctgggattacaggcgtgagccaccacacccagctctatgtgtctttatggtagaacaatttatatttctttggatatatacccaataatggtattgttgggtcaaatggtactgctgtttcaagttctttgataaatcaccaaactgctttccactgtgactaatttacatgcccaccagcaatatataagcgttgccttttctctgcaaactcacccagcgtctgttattttttgacgttttaataagagcctttctgactggtgtgagatagtatctcattgtggttttaatttacatttgtctaatgtaaatctttctaaaaattttcacatacataatgtcagacctacagaaaagctgaaaagttgcaagaataggacaaagaattcccatgtacccttcacttggatttttcaaatgttaataattttaaaaaaatttgttgtggatctctagtggctatatatatttatggggtatgtgaaatattttgatacaggcatataatacataatcacatcagagtaaatggggtgttcattaccacaagcatttattctttctttgtgtaacaaacaatccagttatactcttttagttatttttaaatgtacaataaattgttgactgtagtcaacctgttgtactatcaaatatgagatcttattctagttatttttctgtaccgttaaccatccctactccctccatccccaccaccacttgcactactcttcccagctgctgataaccatcatcctaccatttatctctgtgagttcagttgttttaatgtttagcttccacaaatgagaacacacaaagtctgtctttttgtccctcgcttatttcacttaatttcttccatttccatccatgttgtagcaaatagcaagatctcattcttttttatggctgagtcgttctccattgtgcatacataccacattttcttgattcatttgtctgttgatcgacacttaggttgcttccaaagctgttgtaactagtgctgtaataaatataatagtgcagatatctctttgctacatttagtttcctttcttttgagtatatacctagcagtggtattctaggatcatatggtagttctattttcaggattttatagaaccttcatactgttctccatagtagttgtactaattaacattcccaccagcattgtacaagggtttccttttctctacatcctcaccagcatttgttattgcctgacttttggataaaagccattttaacgggggtgagatgatatctcattgtagttttgatttgcatttctctgataatcaatgatggtgagcaccttttcatatacctatttgacatttgtatgtattcttttgagaactgtttatttagaccttttgcccgtttcaaaatcagatcattagatattttcctatagagctgtttgtgctccttacatattcattattattcccttgtcaaatagatagtttgcaaatattttcttccactctgtggggtgtctcttccctttttgattgtttcctttcctgtgaaaagctttttaacatgaagtgatcccatttgtctatttttgctttggttgcctgtgcctctggggtattattcaagaaatctttgcccagaccaatattctggggagtttccccaacgttttcttttcttttttttttttttttttttttttttttgaggcagagtctcactctgtcacccaggctggagtgcagtggcgcaatcttgactcactgcaagctctgcctcccaggttcacacctttctcctgcctcagcctcccgagtagctgggactacaggcacccgccaccatgcccagctaattgtttgtatttttagtagagatggggtttcaccgtgttagccaggatggtcttgatctcctgacctcatgatccacccatctccccaatattttcttttagtagtttcatagtttgaagtgttagatgtaagaatttaatacattttgatttgatttttgtatatggcaagagatagagatctagtttcattcttctgcatatggatatccaattttcccagcaccatttattgaagagacagtccttttgccagtttatgttcttggcaactttgttgaaaatgcatttactgtagatgtatggattcattattgggttatctattctgttccattgttctgtgtgtctgtttttatgccagtaccatgctattttggttactatgactctgcagtataatttgaagtcaagtaatgtgattcctctaattttgttctttttgcttaggatagctttggttattggggtcttttgtggttccaaataaattttaggattgtttttctatttctgtgaagaatgtcattggtattttgataggaattgcattgaatctgggcactatggacattctaacattttaacaatattgatttttcatatttatgaacatctttccaatctttctttttttgtgtgtccccttcgatttctggcatcagtgttttacagttttacttgaagatatctttcacttttttggttaagtttatttctgggtattttatttgtagctattgtaaatgggattactttcttgattttgactgtttgctgttggtgtatggaaatgctactgatttttgtatgtttgattttgtatcctgcaactttactaaatttgtttatcagttataatagtattttggtaacgtctttaggcttctccaaatatgaggtcatatcatctgcaaacaagaataatttgacttcttcctttccaatttggatgcactttatttctttctcttgtctgattactctagctaggatttccagtactatgttgaatgacagtggtgaaagtggacattcttgtctttttccagatcttaaaggaaaggctttcagtttttcctcattcaatatgatactagctgtgagtctgtcatatatggcttttattatgttaaggtatgtttcttctattcccagttttttaggatttttatcatgaaaggatgttgacctttatcaaatgctttttcagcatcacttgaaataattatgtggttttttattttgttgatatgatgtatcacgttgagtttgcgatgttgaaccatcctttcattcctgggataaatcccactgggtcgtgatgaatgatctttttaatgtgttattgaatttggtttgctagtattatgttgaggattttggtatcagtgctcatcagggatcttggcctgtagtttgttttctttcttttcttttcttttttctttttctttctttctttcttcatttccttctttttcttttctttctttcttttttttttttttttgatgtgtctgtttgattttggtatcatgcctcttagaatgactttggaagtactccctcctccacttttttttctggaaaaaatttgagtaggattagcattagttcttctttaaatatttagtaaaattcagcagtaaagccatggagtcctttgcttttctttgctgggaaactttttattattactttgatctcattacttgttattggtctgttcaggttttggatttcctcatggttcaactttggtagatttgtgtgtctaggaatttatccatttcttctaggtatattattggtatatagttgctcatagtagcctctaatgatcctttgaatttctgcaatattggttgtaatgcctcctttttcatttctgattttatctggattatgtctctttttttcttagttgttctggctaatgttttgttgattttgtttatcttttcaaaaaaccagtgcttcattttgttaatcttttgtatttttttaaagaagttatgtttctctttttgtttggtttgtttttttgtttgtttttgtttttgttttttggtacagacagggtcttgctgtcttgcccaggctggtcttgaactcctggcctcaagccatcctcccaccttggcctccgaaaatggtgggattacaggcctgagccaccacacctggccaattttatttatttatgccctaatttcttttcttctattaatcttgtgtttggtttgctcttgctattcttgttctgtacaatgttgttaggttacttatttgaagtttttcagcttttttgatgtaggcacttagtgctataaactttccttttatagttttcactgtatcctataggttttggtataatgtgtttgcattttcatttgttacaagaaatttgttagttcattgacccactggtcattcaagagcatattgtttaatttccatgcatttgtgtagttttcaaaattcttcttgctattggtttctagttttattctattgtgatcagagaaggtccttgatattatttaattatttttgaattttaaaatacttgttttgtggcctaacatatgttccaaccttgagaatgatccatgtgctgaggagaagaatgtgtattctgcagccgtaggatgaaatgtcctataaatacctattagatcaatttgatctatagtgcagattgagtgtgatgtttgttgattttctgtctgaatgatctgtccagtgctgaaattgtggtgttgaagtgtccagctattactgtaatggtgtcattctctctctttagctctaacatttgctttatatttctgagtgctccagtattgggtgcctatatatttgcagttgttatatctgcaattaatgaattcactcctttatcattaaataatgaccttctttgtctctttttatagtttttgccttgaagtctgtttttgtctgatataagtttagttactcctcttttgggggtttccattgtctaatctatagactttataaagatttcatcatttgtcccaatatcttttctaacaaatgaaaatcaagattatgtattgtgctattttgtctctttaatctttatcacttcctctctgtctttgtagttcatgatattacatttttgaagcattcaagggcagttgttttgtaggatgtctctcaatttggatttgcctgatatttccttatgattagactgaggtaatatatttttcgcctgaatgccgcagaagtgatgttttgttctccatgtatcgtatcaggaggcacatgttgatttgttccagctttaacctccatcacgtgtttgaggtggtatctgctaagtttctccactatcaggttaccaatttttccttttcagttagtaagtatcttatgaggaattattttgaaaccatgtaaatattctcttctttcttatatattcatccattaactttagcctcagtgattcttgcctggatcaattagtatttgtattggttgccaaatagtgatttttaaaaattaattccttccacatttattagttggctttctaccataaagaagaggtctaacttctctcttgtttatatcagtgtagacttgtgaatatttattctatgagttataattctttttgctaattacatattttgatgctcaaattgtctcagatttgtatatatatacacacacatgtatacatacacatacacacctaaaatgtatgcatacactcactggtctttgcttttaatgtaactgattccttttctcttacacagtggaattcctggagcaggtgtgatagattatgaattgtatgttctggttctgctcatccattcattagtcatacgaacttgaacaaatctcttatatcctctattccaactttttctatgttaaatattaggaaataaatgaagatgatcttaaagaagctttcatttttgaaattctattaatgagttaaaatgtttgaagttatatttttataaagttttcagagaaagcaccttaaaaggaacttcaaagccacaaaaatcattagaatttagttctagaaggtactttagaaattatctaaactgtggctactgcaactaagaaactgaatttttaattaatttaaatttaaataggcacatgtggctggaggctaccctactggacagcacagctcttgagaataaatgacaggccccatgttacatgggccctactgtcagaagcaaagcaggatccctttgcatagtgcacactcaagtaaattaaaccaggctagggaggagacaagggcactgtgtgggacaccttacatttctttgatgtgcagaaaagactggaccataacaaagatcattggatgacaatccatgctgaattgccccacgagctttctgcttaatgctatgctttcaaaaaagaatgtataagtggaattggtagtatctaggcagagaaagagtacaagatacaatttgatggtttcatagaatgtatgtttcaacagaaaatgatgaaacataagtatcatcaagaagcagcaggctgcgctcataaaggaagggaagtataccccttcattgccacatgcgcaaggaggatcttaggccccgagcagagctgctgatgatggctagaggctgattttcatgttctctcttctccattgggaagatggtgtattgaaaacctctttatcaaagcatataaaagtaaaggattgctccatcctaaaaaaaaataaaaagtaaaccaaccttctcatacacctttcataactaattataatttttgataataaaattctggcatattaactttgtagcagattatttaaatcacaggaggttgaacatgatgttgtttagcagtatgtttattatatttcaaagaaagtttaaagatcaacaacacatcaagaaggctgatctgctctcagtagttcatagtaagagctgtaatctgagagtttatataactattttcagtagaaatgcctttgttagagaatctacagtactactggcaaaatttgtattaaaatgataatatattctccaaaaatgctaattctcctgtatgttcaattatataatttatgttcatgaccttttataaatgctataccaagatttatgtttgcttttaatgagaatatgcaatacatttagataataactcacctacagtgttggtaagagagtaaattggtaaaacctgtcaggaaattattttgggtgctaggtattaaagccctaaagctattcctacttttgacctactaattccccttacaatctaatctgcagttaaagctttatgtataaagtcatagtaaaaattgaaataacttgaatgtgcagaaggccaacatacttagcatatttggtacatctatgaagagcttttattgtcatggaaagtaattataaaaattttagattggccttgtatgatggctcatgcgtgtaatcccagcactttgggaaactgaggtgggcagatcacttgaggtcaggagttcaagaccagcctgggcaacatagtgaaaccccgtctctacccaaaatacaaaaattagccaagcataatggtgtgcacccgtggtcccggctacttgggaggctgaggtgggaggatcacttgagcccagggagagattgcagtgagctgagatcgtgccattgcactccagcctggatgaaagaacaagatgctgtcaccaaaaaaaaaaaaagttttagattgacatgcagcatagaagacaatatttatagaataaactacataaaatatagagaaacagtgtgattacatctttgtctatcacattgtcacagattttacctttttgatgcatcttcttttctttcttgattcttttcctcacacttgtttggcgctgaggccgctctgttgtagtagtactcagccaactgccaggtgtcatccaatccattaaaaaacgctgttggcactacctccaaagtatatcacagttgtctacttatgtccatttctggtccagacgtcatctgctctctcctcagattatgatatcagtgactgaactgggctcactgctctacactcgcccctgccgtgtacaccctgacttctagtcagtctctacacagcaaccagagtcaccttttagactaataggacagattttggcactcttctccttaaagctttttacctgccaaaggtttcccattggtgttaatataaaatttttaatatgaactacaattccctgcatttgttctttctcaccactttttaacccagagtgactttctttctaccctcttaatattcattttcactctggcctcagggtctttgcccttactcatccctctatctgaagcactcatttcttggcttttggaattactgggtcctccttaacctgtactgctacttcctcagagaggccctccctgaccacccccacaaacatctcctcctcccacccccaatattgttttttcataatattgatctgatttattaacctgttctctcatatattatctgtcttcatccagtggatgtaagcgtcttgaagaacagctcctggaacacagcaggcatttggtaaatgagagacactagtaaatgaatcaccaccatcaatcaggatgaagcaataagggttctctttggcaaaatatatcactattctttttaaatgttcgtaaccaaagatttagcaattcctcttgaggaatttacccttcagacattgataaagtttgtacaactctataggcagccttgctttataatattgaaaaattggaaacagtctaattttgggaatctgctacataagttagtgcttccctatgattcaatattatacagccattaataaaggcattttagaaacatactttttacatggaagatgtcagatgtcaaacagattctaaaatagtgttacatggaagatcccattttcatattatacacatgtacatatttatacttcaaaaaatctacaagaacagatactaaaatatttatagcagttatgtctgaactttgagattgcagcttgttattatatcccagtgccactggaattgactcatactggagggtaggccattgcagtttagggtgtttcttgagctatacacaaagcctttcagggactaaacagatgagtctgataaccctctcctcctgcagtaatgctgttagagaaggttaatcaatgtgtttttggtttctatagagagaagacgagcacttctgtttgggagaattgagatgtactttagagagggtgagggcatgtgccttggctcttgatgtgtttggaagatttaacagaggtgattgaagagacatttcaggtggaaagaagagccagcatgaaagaaggaaatagagaaggaaatcatgaggcatattaaaggaatagcaagtgcatccattctgtaaaaccatgggatatctgggaatgggaataattcttgaaaagtagatggaaagaaattgcagtgacctggatttagtgggcacttggaagatatgatttgagcaggggaatgatgagctacttgagctgtttttttaatttttttatttttatttattttttttttagggagactaatctgacaagttataggaatgagttggtaggctaaagctggaagcaaagtggtaatgctggtttaagcctagactgtttgcccaatatgtcaagtaggctgtatgcaaattaggttataagagaagaatttcttcttttgggtatattagacttgacttttttccttccatctattccccagtttcattgtggcattactggctgctactcactgaggagagtgtattgtctagggctagtggttgggagcaatgagtgaatgttcatagcctgggatataccaaaaaggaaacatcaaattatatgtgttttttaaagtcaaagatattttgtacaagagtttcttacacatatggataatgtgtttttgttccctatgataacataggtattttagccccatattctgaaggcaaataactgaaagattacattggtttgttttaaggaaattaacaaatgtcccttttgaaagtaggtcaagttccttattttaatttctaacctaacataggactccagctgtcaggctctcccattaatcctctgtatcagtgaaatcctctctgaaatacattgtaattaatttgtaggaattgacaggaaaaggtagtgagttcagacaatatttcactacaagtttcccatgtgaaaggggacaattgaatctttgagctgttgcaaaaaaatggttgagaaatagtattttggcagaaattatttccattgaaagaatcaattgactcttgctagcaattgactcttgctagaaagagtctagcatttgactcttactggatttcagccccaataatctagactgggcaacctgattttgctgaaatgttccataagaactttcgcttcaatcataaatatttaaaagtgacttcattgtaattatccctaaaccagcatcagtctcacaagtgccacaggaaagccagtcatagctggtgatatgcctgtagtaagggtaggaagaagagtgggaagccttgattataggcagagtagaaaagtattaatatagaaaataaaagtatcttttgttatagttttgtctgcttttgtgaagtgtagatggttctgcaattcaaggaccgcgtgcaagattccagggtaatgtaaatgcagattttgggaaacagtcatatgcggggtacgtttgtaactgaatctttatttagtgagtgtctcctaaataaacagcatgggtagcttttgtcactgtccaaggtactatataacttgggctaaaaaaacccccagcaacttccttttccagcatcttgaaaagtgtgtcctctagagactctctaaaggaaaaagaaaagagaataagataactgttgaaaaggaaagtaaaacccgagtgccagattagattgtaaatgttgaaaacaaacaaaaaccctcccaaagctccacttactacttttcaaacacaaaagcaatggcaaataaagaactacgattaagaagggagtccagagcaagtgatgtgctgcagtacccctgggttgtcattgggatttggaacaattcaggtgtgttcaagtaagacccaccatgatcaaaaccagcttgcatcaaataatagactgggtgaactgggtcctttaataatgtatattgtatgtgtgcttttagcttttcaatttttcagcaaaaaaagcacaaacttctttataaaatgaatctctgcttttacttttctataaccataaataaaatataagtgaaatgtttctcagcatttgcctgttaaaataacaatagccaagctccccagcatttatgttagataaacgcaattctaccaaacaccaagagtttaaactgtaccattttgataatgatgataatgaaatttagtatatatgattctagtgtaaaatatgtgaaactctgcaaggaaaaaacatttaaattcttgtaaataatgagaatacactgtaagtgcaattttttttttcagaggaagtgcttagcctatccatatgctttcagttatctggtagaacaactagatcttcatcttttcatttatacattcactatcacacacacacgaaaacgcacacacaccccttttactcctcccacctctgatgtgttctaaggaatacaaaagaatgcagaaggacacaattctttgtggaataaagctttgttgaaagcaagcagaggagggtggggaaaatgagatattggccaaagggtacaaaatctcaggcaggatgactaaattctggagacctaatgtgcagcatggtaactatcattaacaatgctatatcgtatactttgaatttgctaagagagtagatcttgtgttcttaccacacacacaaaatgataactatgggaggtgatggaagtgttaattaactcgattgtggtaatcatttcacagtgtgtatgtagagcacaccattatgttgtacaccctaaatatatacaatttttatttgccaattatacttcagaaagctggggaggaaacaataagcaggactgctactagatatttcataacctcatggaattcttgctgcaacttcagagttcccgttttacaaaaaccagtttctctcttagtagccaaaagttaagagggagaaacaggaaagaagaaagaacaaagcagagcaaggtgtcagattgcagatttgatgagagaatcggaaaggatgggaagggcctccacatgttagcggggcaagacaaggctttcttcagtttcgagggtggcagcatagacaagaatggaggaaagagctgttgaatcatgaacttgactagagagcagggttagaacgactctgaagaaagcaggtaggcagtgaacaggaaatgaatccatgcacaaaaggggaggacgtggaccctcagagttctccccgaactcctctgtagtcaagtttataattcaccaactcccattacaaaatgtttattgtattttacatttgttagggattattgtgtgatcttgacttgaacaaatttttatttccccttgatttccatttctttacattaaattgtaagctatcagtttgggctttatccatctgccagtatccagcactgatgtagttttgctatatagtatattgaaaatgaaaccaagccaggagcagtggctcatgcctgtaatcccagcactttgggaggccgacacgggagggttgcttgagccaggagttcaagaccagcctgggcaacatggcaacatggcaaaaccccttccctacccccctccaaaaaagctgggcatggtggcatgcccctgtggtcccagctactcgagaggctgagatgggaggatcacttgagtccaggaggcagaggttgcagtgagccaagatcacaccactgcactgcagcctgggtgacaatgagaccttcaaagaaagaaaaagagagaaagagagagaaagaaaggaaagagaaagcaagcaagcaagaaagaaagtagggaggaaggaaggaagaagaggaaggcagggagggagggagggaaagaaagaaaagaaaagagaatgaaaccaaaagcggggtgataagctgataccttagtcttgagaaaataccaagaatgatgtgtggatttaggatcatgcctctttctatgacagtggctgtgcagtgtacagtttaagatgatacataattgatagtacccactgctccatgcactgggacagagaaattggcttgagccacttgtcgtatacaaaaacctttattctcttttctctcttgttgtcattcagctgtttttctggatgaattcaccaccatttagttaaaaaaaaaaacaacaaaaaactgtttttgctaagggaagagtggtgcactgtctccacacaatgtcctctgtctttccctgcctttcttctgtccttgtggtaccagtcatttcccatcagcaggcagcactggcctgaatgtctttgttgctcggaagtgagaagtcacctccttacttagagggagggtagatgctgcagcagaacatagtgcagccaggtcccgacttaagagttttcagctttatgatggtgtgaaagccatatgcattcagtagaaaacacactttgagtacccatacaacaattctgtttctcactttgggtacagtattaaataaattacatgagatattcaacactgtattacaaaataagctttgtgttagatggttttgccaactatagcctaatgtcagtgttcttagcacatttaaggtaggctaggctaagctatgatattcagtaggtgtattaaatgctttttcaacttatgatatttttaacttataatgggcttatcaggacataaccccattgtaagtcgagcagcatctgtatcgggatgaagagtctgccacttaacatcttcagcagttcttctgcatctcagagtttcctcatctgtaaaactggcgtcataatagggttgttgtgagattagaccagttcatatgtgtaaaagcccttaaaataatatctgacacataatagatgatcaataaatttcagctgccacccacaacaaagaattatccagtctataatgtcaggatcagtaccataagaaggataaaaagaaaaaaaaagtcagtagtaccaaggtaaggagccatgcacgcaaggtgttgcccatgtctatataggctacttttgaaaatggagtgggtggggagtggtggtcacacgctctgatgctgggtctctggggctgtaggggtggtgctgggctagaaggggcactccactggctcctcctaaggagtcggtagttccaagggtattaacaaggttagttgccaagtccagtgcccacacttgaccctcacgcgtcttagaaaccatgagtggccaatctctttattgggtcaggtccaactgctcaaaggggctagttcagaggggcttggcaggttttattttcttctaaaaattgtgttttccttttcacattgggcccactgctcacccaaactcattaagttaattggttgtaatcaaagtgttctggcccccaagtcacatgtttttaaatgctgtgagggcaaggcaaggttttaacctgatcctttctcctcggttcccactctatgaccctaaacaaaaagcccttctaaagataatcccaagtcaaaagtgtggtagacatgttgagttcacagtttacaatgcaatatatcactgactaaaaaatgataaactctgaggaccaatatttaacatatatagaaataacttctaaaactttagcatttaaattcactagttcttcttctcccctgggaaagccttcagaattattcagaacttactaaagcaagtcaagtttttggactttctgaacagggcacctaaatgtcattccatacactttctcagtgactccatgtctgttctcagcagtgaagggagaacagaggccactctgcctgactgattttaaatgatcgcctttttcagatgcttttagtatggaaacaaaatcagccataaccttcagggttttaaatgtcactgttaatgcatcaggaagcccaaagacagacagtctggagaaatagtatgtaatgtttagatgattttggtaaacagctaagtttttaatgtatgtttaatgtgcattctgtttggggcctctgagtttgaatccctgagaccgagctgatgtttagcaaccatttcttaaccaggaaaagcctcccctactcccagcccatagccatttgagcttcactggcttttttgaacagaagcatttcccagtttttgcttggttcagtgaacacggttactgtttaaaaacagtggctgtcgagttgtatgtctcaccaccctttgctctcctcttgagctacctcaagctgtgtgagagataatagttagcatgattaaacggccccttcactgatatttggtctttgcctggctgagggacacaaagcaagaagagggagacatgcagatatgttgcaggatattcaagaaagaaggattttagcatggaagacactaaactgtactgtaagttcttgggctcaaaatgtgttttgaaaaccttaataaggacgttcaagaatcaggcaatctttaaatccattttgacaaattaatacttataacaagtggaagtacagagtaggaaatcttctaatctttttttttttaatcattgttttaatgtccttagaaaaaggagtgggaatttaattaaataaaatgatatttattatataaactatggatttatacttctaccttcatgtcctagagccgtttgatagtttccatgaaaattaaaggcaaaccatcatcattctctattttccatacttctttctttttttgacaaaaacaaagtgagaagctgaacagtagcaaactagacaaacatacacaattatgctgctgtccaaaaaaaatttcagtatataatttactgataatttcttagacctcttaatatttgtgtctagatcagatcagggtttttgaaaaatggttgcttttctatttagagaggtgtatttggggagtgctgttgtttgcttattaaaaagaaagatcacatttatcttgcctacttatttttttattttgttttgttttatatcagaaacattatttgtgctgcccagttatgtctttccccagaatgctctcattttcatgatatgtaaacagtgagtcacacatgggctttacagagaaaatacaagcattggaactttatagactacatttcggggagtaacttttatcactttattttcttttctagaagtttatgtggatgttctatcaagtttaatttttagaataataaagctgccttattcactaaattatttgccttttaaaaatataaatcttcattttcacagataacatttgcaaatttgtgttataaaaacacacctcctacatttcatgtaggagacatacgtgaggtatatacttgccagtatccagcaactgttagaagatggattagtgtcaataagtggtttgcttttggtattttatgattataaaatatagagtccgggcagcatattagaaatatctttggggttggatctgaatttgtcttttagctctgacatttactagttctgtgatttcagacaggtgatttatattctataagtgtgtcaatatcattaaacaatagaataatctcaaatgttcagggttgtatatacattaaagaagagtaaaaatgccttgcctgatatttaatcggctaactgactttccattttttttgcccttaatgattctgttttatggagacgtatctttctttgcagaaagcatgtttacatatcttttcaagtattaggataagacatagttgatgcataagcactgaatttcattattatttgaatgtgataaaataggattgcttctatcagatgaaatagaggttactcagtaagaaaactggataaatgtccaattaagaaatttaaaattgaagggagaattttttaaaaatccagataattggtcaaaaactcctagataagtggcttaaaatactcaatttttgtatgcttgattttggtcctagttttccaatttcctgcaaaagtagataacacagaagctgcatgtttccataaattcaaatttcagtggaggtgcagggggagctgtcctctgcacacttcgcagctgtgtgtgtactcgacatacggcagccctgctgctcattcatgaaagtccacatggttgtgggagcagaacctgttttcaccatcaagctgctgtggaataatgaacagcatggtacacgtgacctcctctagacaaaaagtgctctctgtcattgtttggtctgacttcagcacttttcactacctgatgctttaatgcttattgtctttcctcacactagaatatatgctcatagagggcaggggatgttatctgttttgttcactgatgtatcccaagcacgtagaacagtgcctggcaaccagtaggcacttaattatcaaattaatgaatccatccctagttttcaatagcacggcaaagtaggagagaccacacctaatctctttattaaaagacaaacaaaatgaccaaaaagatatggttttatataaaatcaggagtctcactgcagtggaacatgctaattgtttttgtacagtagtccttccatccatggttccaagatccccagtgcatgccagaaatggcagatagtaccgaaccctgtatgtactatgtctttttctaggcatatatacccatgacaaagtttagtttataaattaggcacagtaagagattaacaacaatagctaatgataaaatagagcagttataacaatatagagtaataggagttacgtgaatgtggtctcgctctctctcaaaaatatcttattgtactgtactcaccaattttcagactgtggttgaccacaggtagcaggaacctcagaaagtgaaaccatggataattataactcctgtagttgatagaccactactggtttgttctaacttttggaagaagaaaagaaagtcagcatgcaatgttaatatcttctgttatcatagatgattcaaacagtgtttcaagcagaaaagaaaaaatcaagaagtttacttccttcatgaaagatagttaaattgaatactccagaaagataatttcatggtgaaatgccaggtcacaggccgaataacatctctccttgtctgaagcctgggtgaggccaacgttctgctcagccactgcaggagggcagccccttccacatacacaatgaaggtcatgtggtatggccaactcaagctcttttaccaggcgttttatggttggcatattttttagaagctacaaatcttgttaagcaaggcactcgaacactagctgttctcaaacttacattgcctctgtacctttaccaagaagacagaatgttgtacttgaaagtcagaaaactagatttcaaaactcagctccaacacttcatgtttgcctgaccacaggcaaatctcatttaacctccctgagcctcagtctcctcctttataaagtggccctaatttaagatgatcaaggaagttatgcacaagaaaaggatctataacccataaagcaaattatacagtgttactccaatataaactaaaaaacaatgcaagttctttccttaataagattaaaaattttgactttatattgtgtatttgccaaaatatcactagttaaggtggaaaaaacacctcagcaaaacagtgaaaagactaaagaacattttggaaaaaaaaattctttagaaaacattgtagcatattggttaggataatagattttaaagtcaaattgatgtggattttattcacaatttagccatttatgttgacaaattacttctttgagcctcagtttccatttctatagggtatggagaatatttcctaacatgcagtctttatgcagtcttactgtgagcagtaaattgaatgagacaaagtatttaaagcatttaatacattctgaaacatagtagatattcaataaatgaaaattgtatttctggttagtattttaattcttcataagtatcattgtgtatatggtatgccttttaaatgatatggggccaaactcttaagatgtattaattgactacaactatgctgcataaaactctggtggaaatttcctcaaagaaaatgattctttgattttcaataacttttacttttctgagccttatgatatttagaataggtggtctttgaaacatgcatcaataaaattaaagggttttttgttttctttttttttttttttttgagataggatctcactctgtcgcccaggctggagtcacgatcttgactcactgcaacctctgcctcccaggctcaagcaatcctcccacctcagcctcccaagtaactgggactacaggcatgcaccaccatgtccagctaatttttgtatttttagtagaaacagggtttcaccatgttgtccaggcttgtctcacactcctgagctcaggtgatccgcctacctcagcctcctaaagtgctggaattacaggtgtgagccaccacactcagcctgtaaaattaaagttttaaataccatcatccactcacctaaacctcctgagacctcaaagtatattcggttaaatggagtttaactttccctccacctaggtattcacaggcaaagagcactggcaggggcatgtcaaggacagaacttagagattctttttctaggaaatgtgttgcttgtgaatctgctatgctgtccaggcaaagagttgctcaagtttaaacataaaatctgctgtgtatgttctagaaatgagataaaatgaaagaactgggagaaacttaaatcaggaaggacattgagttggtaatacatactgtcacacaacctaaaaatgctcaagttctgagatttaccatttatagtctaagatataaatgatacattaaaagcccccaatcctttctcatagcgtttcactgagtcattctttagtgactagtctctgaactgaaatttttgtactgaagtgcaaccactggtataccatcttttttttttttttttttaagagaagggtcttactatgctgcccaggctagattggaacccctgggctcaagtaagcaatcctcccacctcagcctcctgagcagctgggactacaagtatgacactatgcctggcttgatataccatcttgacaatgtaatttatttatttttaatcagagccttaaggtgacataaataaatacattttaagtgaactacaagccaattggccttttaaaacttaaagttttaaaatatgtgagaatacagatttgaaccaatagcatatgactacttagcataaataggagtttttctactttttaatacccaaggcagtttgttcaccaaaatctaaaactcctaatagtgtttagagagaaaaccctaaaagcgtatgagtaaattccactatatttccagttatatgtgttgatccatagttttcttcaaaataccccaaacagtccttaaaggcatcagtattctcaatcagaggatacttttctgcaaggcatattccattttaaaagataatgccttaatccatttctggatcgtaacccattaggttatataagtgtgtttctaatatcacagacaataaactcatgtggcctgaatagcaagtaacatgcgatgaaggaccaaggaaggtaaatgttaatatttaagctttctacttacttgatctaatattaacaatgcaaaggtttcatgtttctctttagcataacagttataaaatagtcaaagatcaacatttttatataatgttttattgagccttcttgctttgagatcttgaaatttgtatttttacttttctcataagtgaaatacacaatttaaatatgtaagtattcagtaataatgtttcagtcattgtcgaggtaaaaattaaatatgtcattcaggatttttgtttggattcaaattaggtgaaatcatcaataactaagcaaaagctgtttctttacatgaattgtagctatacataagtgagaattctcttagttataaaacatggagtttggagttttcgtaaatacttcttaattatatccttgactatgtattttcttaaatatttttaaggtgtacaatgggataaaatggagctgttaggaataagatggagaaattcttaattgtgtcagctgtatagagggttttagccttttcatgtaagttatgctcgctatacccaatagcaactgagttgattgaagtcctgttattggaacctaagaggtccatataccttaggacaagtataatgaaaatgatgtgttctcattgggtctagtggagggctgtattcctcaggaactattaaattaagtgttctgtgggtttaaagcagttaattaaaaaaaaaaatcttcagatgcaccttggatgttgcttcactgtggtgtttattatgacagcaactctacagctacctcaacccaaaaggaagagtctagtcccaggatggcaagtgaggctgcattctacaagtcacagcccaggaaattgtaaatctgcttgtattgaaggatgaggtgtgacagaggacccttctaacctagaagaaatcagtctttccaaatgaaaaactacagggcaggcttgtttccttttgctttctatgatatgtaaactgtttttaggtgacgaattaggaagataaaccagtttcagctgacaaaaatgtttgttttccaatcatctttttataaacagtgcttcatgtgtataataagtaaatgtatttattttaatgatccaaatataacatagcattacagaaattttggcaaaaacaaaaagaaacatcatccataatttcttcaccctaatgcagctttagcaattttcatgtattccctctcagcatcaatgtgcatattaataatcaaataattgttattaaatattatatgagaaattatccatggtactgacttactttaaatacatttattttcactggttagatacaaatccatggaaggaatagtcccccattgactattactgcttttgcttttttatagttacacatgttactttaatggatgtctttaggtataagacttgttccacatcttacaacattttgttaagttggtccttcaaaagtgggattcaaaagtgggtgcctcaaaagtgggattgtggagtcaacaattttgaactttttcatgacaatagataaatattgctaaattactttcctagagttatgccaatataataatatactatagctctgttttgttcattgtggtaaaaatacttgacatgagatctgccctcttaaatattaaagtgtacgatacaggatcattaaccataggcatcatgttgtacatcctatctctagaacttactcatcttgcataactgaaactttatacccattgaatagcaactccgcattttctcctccccgtggcccatggcaaccaccattttattctctgcttctatgagtttgactgttttagatacatcataagtgaaataatgcagtgtttgtccttctgtgattggcttatttcacatagcataatgtccaatagagatatccatatggcaggatttctttcttttttagaaaaaggctgaataatattctcttgtatgtacatactacctttttccattcacttgtagatgaacaattaatttgtttccatatcttggctattgtacataatgctgcagtaagtatgtgagtgtacatatccctttgaggtcctgattacagttattttagataaatatccagaggtgggattgctgaatcatatggtatttctgtgtttaattttttgaggaacctttatactgtttcccatagtggctgcaccatttttcattctcagtaacagtgtacaagggtaccagttcctccatgtcctcaccaacactggccatctttttttgttgttgttgtttgataatagctatcctaacaggtgtgaggtgatagctcatgaggattttaatttggattttcctgatgattagtagtattgagcatcttttcacatacctgttggccatttgtatgttgtcgttggagaaatgtctattcagttcctttgcccatttctaaatttgattatttggttttattgttgttgagttgtaagagttccttaaattttaaatactaacccctcatcagatgatatggtttgcaattattttctccccattttgtaggttgcctttttactctgttgatttctttgctgtgcagaagccttatagtttatgtcctagtggtctatttatgcttttattgtatgtgtttttgatgtcatgctcaagaaatcattgccaagaccactgtcatgaaccttctccctatctttttttctagaagttttacacttttaggcttcacatttaggtgtttaatccattttgagctgatttttgtgtataggtctaatttcttccttaagcatgcggatatctagtttttccagcattatttgttaaagagactgtcctttccccattgtgtatttttggcattcttgttaaagatcagttgaccatatatttgtgggcttatttctgggctccctattctgttccatttgtctatatgtctttattccattaccatactgttgggattactatagctttgtaatctactttgaaatagaaaagtgtgatgcctacaattttgttccttctcctgatcatttgactattcagagtctttggggttccatatgaattataggactgtttttcctatttctgtaaaaaatgccattgagattttgatatggattgaattgaatctgtagattgctttgggtagtgtggacatgttgacaatattaagttttcccatccataaccataggatatctttccatttatttgtatcttttaaaatttctttaatcaacgttttatgatttttcagtatacaagtctttcatcaccttgctaagtttattcctaagtaatttttgatgctattgtagataggattgttttcttagtttcccttttggatagtttgttgatagtatgtagaaatgcaactggtttttgtatgttgatttggtatcctttaacttcactgaattcctttattagtcctaacagtttttctgtggattcttaaaagttttttttacaaataagatcatgtcatctacaaacacattttacttcttccttttcagtgcttatttctttttcttgcctaattgctctggtaaggacttctagctctgtgttgaatagaagtggtgagagtgggcatccttgccttgttccttatcttaaaggtatagtttttcactactgagatgatgtcagctgtgaggtttcatatatggcctttattatcttgaggaaattttcttctattcctagttcattgagagcttttgtcatgaaaggatatcaaattttgtcaatttctttttctgtagctgttgagatggtcatgtgttttttttaatccttcattctgttactatggtgtgtcacatctattaatttgtgtatgttgaaccattcttacatcccagggataaatctcatttgttcccttaatatactgttgaattcagatagctagtattttgttgagtatttttgcatctgtcttcatcagggttattggcctatagtttgcttgtcttgtagtgtcttaggctatggggtaacggtaacaccgcttcgtaatttgagttcaagagtgttccctcttcttcaatttcatggaagagtttgagaaggattggcattaattctttaaatgtttggtggaattcaccagtgaagccatctggtcctgagcttttttggggcaggggatgggggcgggattttttttttttttaattcctgattcaatctctttactatttaaaggtgtgttcagatattttatttcttcatgattcaatgttagtaggttctgtatttctacaaatttttctcctccttttaggttttccagcttgttagcatataattgtttaattgttcatagtagccttttatggtcctttttatttctgtggcatcagttataatatctcctgtttcatctctgatttttttttgtttgagtttttttttagtttagctaaaggtttgtcaattttgtctttaaaaaaaaaaactttgtttcattgagtttttttccccagtgtttttatattctccttttttttcctgctctgatcattattacttccttgcactagctttataccctgttcttctttttcttgctctttggtggtataatgttttgtttttatttgaagtatttcctcttcttcttcttcttcttcttcttcttcttcttcttcttcttcttcttcttcttcttcttcttccttcttcttcttcttcttcttcttcttcttcttcttcttcttcttcttcctcctcctcctcctcctcctcctccttctcctcttccttcttctcttctttcttctcctcttctttcttcttctttcttctttcttctttttgagacagggtatcactctgttgcccaggccgaaatgctatagcataatcatggaccactgcagccttgatctcctgggatcaggtgatccttccacctcagccttccaagtagctgggaccacaggtgcatgccaccacacctacctaattttgttattatttgtagagacagggtctccctatgtttcccaggctggtcttgaactactggcctcaagcaattctcccaccttggccttctaaagtgctgggattacagacataagcaaccatgcctggcctttttctttctttttaatgtaggcatttatagctataaattttcctcatagcactgcttttgctgcatctcgtaagttttggcatgttgtatttttgttttcttatgtctcaagatattttataatttccctataggaaaggcaaaaagtctttttctctactcatttcaggttttccagcttaatctttccaaagacagattaacaggagaaaaacaaacagaagtttattagcatgtgcatcatgtatgtacacttgggagcacacagctatgagtaacctaaatgggtgtttagaatttgagcttaaatactgtcttagactaaaacaaaggagtggaggcttggggctttgtggctgggtaagcaagttatgggaaattgaccaggaaaagtataataaacaggggttgtttagtaaggttttgtatgcacatttaagttgatgtcttctccattgatatgttaggagttatcatatccctactgagttagagggagatatctctacaaatggaaattttctatttaaatataaatttcctttacaaaaagaaaatttgtgccttgattttagagcttcatattgagtctgctgattctcagtggcatttggctcaaaatccattaaataaagattatttggggtaacatattcagacccatttgttggttgttaaagacccattcattggttaagagtatattgtttaatttccacatatttgtgaattatcttgtattctctctgctattgatttctactttaatcctgtggtgctcagaaaaaatacctggtgtcatttcagtcttcttaaattcattaagacttgttttgggacatatcctggaacatagcacttctgctgctctgaggtgaaatattctatatatgtcttttaggtccatttggtctatcgtgtttttcaagtcccctatttcttattgattttctgtctgtttgttctagccattactgaaagtggggaattcagatttcctcctactattgtattgtgtttattgctctctccagttctgtcattgtatgctttatatatttagatgctcagatattgggtgcatatatatttataattattctatcttcctggtgaaatgactcttttatcattatataatattctttataacacttttaatattcacatattgctgtttttacctgtctactactcatatttctagagttttcattgctacatttggaagcacatgtctaatattccttttcagagtacacactagatgaaagatgagggactgtctgaccaaggatccagaaagggatagttcaactataggtgaaggtagttctaaactcatgactatgtactatatagtctttaaggagtagcataagtttaaggcaatttttgtctcctagtgtctcttctcttggccaaatttaacatctcaagtagtcctttggatgaaaggtaactggagatgttttttattttgattttttagacagagtcttggcctatcacccaagcaggtgtgcagtggcatgatcatagctctctgtagtcccgaactcctgagcttaagccatcctcccatatcagcctcccaagtagctgtgagtacaggtgagggtcacctcacctggctaacttttttttaagagatggggtcttgccgtgttgcccaggctgatcttgaactcctgggctcaagtggtcctcccgcctcagcctcccaaaatgctgggatttcaggcgtgagccactgcacctggctgtttgctatttaaaagacattttcaggccaggttcggtggctcatgcctgaaatcccagcactttgggaggctaaggcgtgagggtcgcttgagcccaggagtttgagaccagcctgggtaacatagtaagacccatctctaccaaaaattagctggacatagtgtcacgtgcctgtagtcccagttacttagaaggctggggcgggaggatcgcttgagcccaggcggtcaaggctacagggagttgtgatcacaccactggactgcagcctgggagacagcgtaagaccctgtctcagatagatagatagatagatagatagatagatagatagatagatagatagatcatttaggtagggttaagtcttcatgagcatttaaatccaaattagcattttattctgatgggtttaataggtccaatgatgaatgaattctgatgggtggtagctggctcatcatttgtggaactgagtaaaccctattaaatatctgtttttggaggatttggcagtttgggaagagcctctgagctctatgttcctcggtagacaaggtaccaagtggttgaaatgtaaatatggagatgaggcattgaaaaggaacaactttactgatgtcttgcataattgcaaaactagcaaaaaaaggaaaaaaagcccacctcagaaagactaatttctcttgatgaacacttagatttaaaattaagtggtctgtatttgttgatgtaagtatcagtcataaacagctttggctgaatactatgaagctatttcttcagtgtccaagcaagcactcagttgctttttaaataaaagttcatgttattttaccaaattataacagtaatatttaccaaattaaatcaatattttatccagtacctccatatcaacataaggaagagaaccaaattaaattatcaaaatttgttgggaatcctaatggtaaaaataagcataattacaaaaatttctacctatttgtgtctaatgcaggaagtctctattctgacatgtattctaatgatgagaaaagctcctcactcgttagggaaagtaatcagatagcctgaccactgccacaacccttaaagtcactcactgaacattcactagattgtccggaaagcgtattatgacaaatgcaaataaaagaatttaaagactgtcactgttagctaattaccactgggacagaatcttaagcagtgcatttgaaaattctgaaacagattggatttattataaattaatgacataggatgttcattaattattaagctttgttgaaatacactgaatgttgtacacaggttttacagccaatggctgccatcagaatgttttgaaattatacccacgagaaaaatagaaaggtttttatctccattcatttccagtggcttgttagttttagcatgggggaaaacataacttttcccgagttctcagttggcaagaacacttgtggcaaacttcagattaacaaaagaaaactaacagaagtttattaacatatatacttcacgtattcatgagagatgcctagggaataccaactgaatctccagagtacaggcatacctcgtagatactttgggttcagttccagaccactgcaatgaagtgaatttcacaaggcagtcacactaattttttggtttcccagtgcatataaaaattatatttacactatactgtagtctattaaatgtgcatgatgtctgaaaaaacaacatacatattttcattacaaatagtggccgggcatggtggctcatgcctgtaatgccagcactttggaaagacgaggagggcagatcacttgaggtcagcagttcgagaccagcctggccaacatggtgaaaccctatctctactaaaaatacaaaaattagctgagcatggtggtgtgcacctgtaatcatagctactcgggaggctgaggcacgacagtcacttgaacctaggagatggaggttgcagtgagccgagatcgtgccactgcactccagcctggatgacagagcaagactctgtctcaaaaaaaaaaattaaaaaaaaaattattgctaaaaagtgctgatgatcatttgagcctttagagagtcataaacattaagacagcagtgaagttgattgcatcagtagactcttcctttcatttctctgcagcatgcaatgctgtttgatagctttttacctacagtacaactttcaaaattggggtcagttcctctctaagtttgtgtaatattctaaatcccttgtcctttcaacaacattcatagtatcttcaccaggagtagcttccatcttaagaaaccattttctttgttcatccataagaaacaactcctcatccattcaagttttgttttgttttgttttgttttgttttgttttgttttgttttgtttgagacggagtcttgctctgtctcccaggctggagttcagtgacttgatctcggctcactgcaacctctgcctcccaggttcaagcgattctcctgcctcagcctcctgagtagctgggattacaggcatgtgccaccatgcccggctaatttttgtatttttgtagagacagtgttttgccatgttggccaggctggtcttgaacccctgatctcatgatctgcccacctcagcctcccaaagtgctgggattacaggcgtgagccactgcacctggccccattcacattttatcatgagattgcagcaattcagtattcagattttccttctaattctagttctcttgctgtttctgcaacagctgcagttactaacctccactgaagtcttgatcccctcaatcatccatgaggtttggaatcatcttctcaactcctgtaaatgttgacatttttgacctcctgccatgcatcaaaagtattcttaatggcatctagaatggagaattctttccagaaggtttttaatttactttgctcggctccatcaggggaatcactatggcagctatagccttaagaaatttatttcttaaataagacttgagagtcagaattacttctttatccatggtctgcaggatgggatgttgtgatagcaggcgtgaaaacaacattcatctcctggtccatctccatcagatcacttggatgacctgatgcattgtcaatgaacagtaatattttgaaaagaatcttttcttctgaacagcaggtctcaacagtggacttaaaatattgagtaaaccatgctgtcaacagatgtgctgtcatccaggctttcttgttccttttatagagcacaggcagagtagatttagcaaaataccataaagggaagtgcaattaaagagatgcctataaatgtctaggaggtggctttaatacatgtctacagaaacagaggaggcgtagagaaaacctgttatggggaggtgatcaggaaatatctaaacaagggtaaggtttgttgcgcagatttaagtaggtgcctgccccattgataagagtttctagtttagatttagagccatccctttctttctggtacagagatggagacacctttacaaatggagattccctttatggatgtaaatttctcttacaaaagggtaacttgctttatgttttcagagcttttccagtttctgctgtttctcaaaataatccttatgccaaaaaggcatatttggggtacaaatttttgtctcctacagtcatgttttgaggtggaattccctgagccccaccagcagtaaccttcaaaaaacagaacattgacttttatagtatttaatgcctcctcttcacagaaatgtatccactttctttctttttttttttgagatggagttttgctcttgttgcccaggttggagtgcaatggagtggtctcagctcaccacaacctctgcctcccgggttcaggcagttctcccgcctcagccttccgagtagctgggattacaggcgtgagccaccatgcctggctaattttgtatttttaataaagatggggtttctccatgttggtcaggctggtctcgaactcccgacctcaggtgatcagcccgcccttctataaaaagtgtggtatatcttaaaaagtccttttaaagaaatgataatttaatatttgagatagttattttatttggaagtactagattatttgcattttaatattttaatattaaaatttaaatatttaatcaggtagaaatattccatgctgggaattttgtttaaaaattcattttaaaaaaaaatctatgtttatgatattgttagtgggaaattgctatttaaaaacaagtgaagaaatcttggaaataatgtttagattctaatttgttttagtttactttttctacttagaattgtgttggtgaaaaggataaaaggcttatacagaagccaaatggtatttttatttttatttttgagacagagttttgctcttgtcacccaggctggcgtgcagtggcacagtcttggcccactgcagcctctgcctcccgggttcaagctactgcctcagccttctgagtagctgggattacaggcatgcacctccatgctcagctaattttgcatttttagtagagacaaggtttcgccatgttggtctaggctggtctcaaactcctgacctcaggtgatctgcttgctttggcctcccaaagtgctgggattacaggcatgagccaccgccaccgtgcctggcctccaaatggagtttaaaaagttgcatttattcaggttcctttgttgtattccttcaagaactgtgttcttccctctcagagcccttatcccagttgctcatgtaagttcatcagtgcaatcgttggctaatgccttcgtccctatgggcagagcccctgcatacttctgcccccctttaaattaagtttagcctaaagctgactccttacatatttttagtttttcctaaaggtctcctggtacatagtgaactgtgacctaactggatctgtaaacagacattagggagacataatctcccagcaatcaccgagtatcagccaatcacagcagccagctgttcaaatcatgttcaaataaggcaaatgccgggctgtaaccaatcggctgtttctgcacctcatccccattttctgtgcatcactttcctttttattaacataaatctccaaccatatggcagcacggagtcactctgaacttattctggtttggggagctgcacgattctcgaattgttctttgctcagttaaactctgttaaatttaaattgccttacatttttgttttgttttcgtttttgtttgtttgtttgtttgtttgtttgaaggagtcttgctctgtggcccaggctggagtgtagtggtgcgatctctgctcactgcgagctccgcctcctgggttcacgccattctcctgcctcagcctccccagtagctgggactacaggcgcccgccaccatgcccggctaatttttgtatttttagtagagatggggtttcaccgtggtctcgatctcctgacctcgtgatccgcccgcctcggcctcccaaagtgctgggattacgggcttgagccactgtgcctggcttgcttcttcttttttttttttttttttaacaccactgttgtgtccccagtacctggaacattgtatgtaggcatgctttaagtgggggaacagatgcgctgatggatgggggaagaattcttctagtcattctaacagtgcatgaggctttttcaaagataataaaatattaattgtttttttcccctttcttggcaactgatagaaaagattgctttactgttttctcttctttttcattctggatcttgtatctctcaggcattgctataattccattttgtagaatgggagtcctttataagaattcataggcattgctaggcacggtggccacgcctgtaatcccagcactttggaaggccaaggcgggaagatcacgagatcaggagatcgagaccatcctgcccaacatggtgaaaccctgtctctagtaaaaatacaaaaattaaccaggcgtggtggcgggcgcctgtagtcccagctacttgggaggctgaggcaggagaatcacttgaacccgggaggtggaggttgcagtgagctgagattgcgccactgcactccagcctggacgataagagcaaaaactccgtcttaaaaaaaaaaaaaaatcgtagtcattaaccatagccttttaaaaggcaagactcatgatagaaggattttttgtttgtttgtttgtttaataatcgtgttgccaaaaggaccttattgcaagttaggttcatatgtaatgtttttcccgcacagacaccagagcattgttgcctaattcccagaattgacttattccttcagagtctttaaacagctcagttctttttttttattttttgagacagagtctcgctgtgtcggccaggctggagtgcagtggcgtgatctcggctcactgcaacctccacctctgggattcaagtgattttcctgcctcagcctcctaaatagctgggattacaggcaggtgccaccacgcccagctaatttttttgtatttttagtagagatggggtttcaccatgttgattaggctggtctcaaactcctgacctcgtgatctgcccgcctcagcctcccaaagtgctgggattacaggcgtgagccactgggcccagccttcattttaaattttgaagctgtttggccaaactgcttcttatttccaactgcttgattatgcttgctttttgggaaaagagagtattttaatattatggtattttagcagcacaatgtcatgtgaaagtcattgcttaagaaaagttttaggtgatgactttcaggataagttgatattgatacaagaggtttcttttaactttaccaggttcttgacattattttgaaaaaaacacccagttattcagacaatcattgaggctttaaatttttccttaagtattacagtttaacatgtattttcataaagtataaatcttaattcaaataatattaaaacattttttcctgtttaagtttttaaaaaatttatgatactctccattgttctaaaagtgtttacaagaacagttaagcataatgcagtaacataaattaggaatgtttgagaaagaaaaaaagataaaccaaaagttggaacataaaatggaacaggaaataataacacctttccaaaggcgagtcctgtgagtggatcacaatctgtccctaagctttcaaactgcagttacaaatgagaagccttgccagatgtttaactcactttgctgaaagagaaagagaattagttatttggaagaaatacaattattctcaatactaacactgaaaagtaatttctctgtagtgttcagatgtgacctcagcagtatataggcaagagacacaacaaatttcgggggggtgatgagttttgtgtttcttagattaaacctcagtagaggttgctgttgttaaaaccatgatacagattgaaaaggatagtctcattgcatatagaacacatcccagtggctgctcatgaagttgtgtaacttacccatggacttatgatgtcaggggagagaaattttatacccagaaatgtttgtgggggagatgttttcattgaaaagaatttggtcattacagtataaatgcttaaatttttttaagtttttgtccttgactgttattctgtgtagaaatgactaataaaacattgaaaacagactgagcctcaatgtatacatcactgactttttcgaatatgggtgtctaatatgccaaagttggtgattacccttaaaagcagattgtaatattgtgaaatatatgtttgttctttgttcccattttctggcatgcaactactgaaatccttggaatctccaaagtgatgtgtctttttgtatgtgaatgagattcctggtggccagcagcccctaagtagcctcaggttggagctggtcataggaaagactaaggcaggattagagggttggggcttttcagcgcccccctgcacctccccaacttctggggaggagagaggggatgaaggttatcaccaatggcaaatgatttaatgagtgatgccttagcagtgaggcttccataaaagctcaaaaggactgggttggggagcttcctgaaagttgaacatgtggaaactcctggatggtggtgtgtcctttctcccatgctgtgccctatccacctctgatgatgatcttctcccatgctgtaccctatccacctctgatgatctgctgtgccctatccacctctgatgatgatcttctcctacgctgcgccctatccacctctgatgatctgtgccctatccacctctgatgacaatcttctcccatgctgtgccctgtccacctctgatgacaatcttctcccatgctgtgccctgtccacctctgatgatcatcagtatcctttgtaatatgctttataatgaatcagtaaatgtatttccctgagttctgtgagctgcactagcaaattaatcgaaccatgaggaggggttgtgggaaccccaatttatagcaggtagtatcagaattgaattgaattagaagatacccagctggtgtcggctgcagaattcattgctggtagggaaaaatccccatgcattttggcgactagaggtcacagtaagtgttgtgtgttgattgtgttgtgagaggacaggagaaactcagtttttgttatatctttatacagattttacagagacaatgttattcattacgcagctgttagtttgacttaatacagggatagattttggaaaatatagatgagtgtgcctcctgtatgtcttccatgaatatggcttcttggaactgagcttttgctggctattgagtgacaacaagttcaagatctctcactccttggcaagttcatggaaaactaataggtggttgtaagaggctaaaagtcacttctacctatgttggtacctaagtgagatctttggctggttctaggaatcaaattaacacaagatagattaacaggagaaaaggatacaggttttataaatttttacacatacatagggagtacaagagagtaaggatgcaaagaaatggccaatgcagataggttttgtactttttggacaaggaataataaatttgtgaagaaatttgacaggacaaggggatctgggctagggacagtaaattctagaagtcactaggagatctatggtgggggtgtgtaaagctagtggaagataagggtttcttcagtaagtttatttgtacaggttcattgcagcagcagtttccaatctctggtgataagggttattttctctccctactggagggaagccgtcctcaaaggaatttttatggcttgccatctgtaagaaaggacagatcagaaaggcctttctgcaactagtttctcaagtactttcagcttgaaataataaatatgccaaattggcataatgtggggtggatcgtccttaacgccttcattgtcagtagtggaatcacatgctttaaccaacagttgaactcgtttcattatatgaaaatggagagacctaacaaaggtgtaggcttgagcagttagtcgacacatctcacctctacagagtagagagtagcagggtcagacctctttcagaataattttaaactgagacatttgctgaagttttaggcatgaaaggcccagaattgaagcttcaagtagcatgattaatgtaagtttagcctgggacatttttaaaaaagcttgaagcacctatggaataccaaatgctttgaactttaacacttgtttctgacaataattagatagcagagccattgtttaaattattagttcatatggtaggaccgtatttttttaaaagggaatatttacctccctgttctattgtgggcttgtttacagcttatccaaaagtggtatcaaattataaggaacaggttaaggaaaacatcactattctataccactgaaaattattaagtgatgcacaaagagatggttcctattgacattgtccatggtcagttcccatcaaattctgaagaagcatcagtgccttgtgttgagtttgtataatttagcttataacaaatgcctatccatagattgaaagataaatatgggtccagaaagtggttgaaacaatagcgtctggaagacttaacagcaaagcagtaaagtagcatagtgcagtggttttcaactttggtgtacatcagattcaagtataatgcttgtttcaaagtgcaaattcccagacccaaccctagagattcaaatttcatacattgagttggggcataggaatctgcattttaagtaaatacccaaggtgtttctgatgaaggaggctcatagacctccatggctccgaagctcatttctcacaggctttgtgaaatgttggttaggcttcaaacatttttgttttcacataccttagaaaataaatttttaaaatacacagtggacttaaaaagtgaggaaattttgacatggtataacatggaataaagtcgaataatattgtaagtcaaaccatcgtaaggtgcagactttctgtattaatttgtgccctatgacaatgatgcattaatacaaacgagacagaaaccttttcacttgcatgaagcaaggccctgctcccacagtattttttgtgttgctctcaaggggcgcttctacaggagcagtgcattctctcatttctttagtgacacttcagaggttttagcccccttaacaataagccacataatgttcaggatgcataagaagtgtgccttacgaaagtagaagggggccaggcgtggtggctcatgcctgtaatctcagcactttgggaggccaaggtgggcgcatcacttgaggtcaggagtttgaaaccagcctggccaacatggggaaaaacccctctactaaaaatacaaaaattagctaggtctggtggtgtgcacttgtagtcccagctacttaggaggctgaggcagaagaatcgcttgaatccgggagtggaggttgcagtgagccaagattgcaccactgcactccagcctgggtgacagagcaagactccatctcaaaaaaaaaaaaaaaaaagtagaaggggaatgtatgtgagaaacaaggtatgaaaggttttaagaaagaatctggaaactgctttataaccctccatgtagacatattcccttaaagtaaggtttttaactccaagcgtttgtaaatttggatgaggaaaataatttcatctttttttccactaacctcacctagaaattgagcatttcctttaattacgacaaacctaaagtagcatgagcatcaacagaagtcagatgttttcttatcatattacagttgtttcaggtatctcaaaaggtggtttgaactgattactttgaaatcatgacagttattagacatccccctagattttactatttactgggttaataaaggagcacatataattctagggtatacatattttaatgtataaaaatgtgcattaaatttttaaccatatttaaatataaccatatttaaatatacttatccttagtatggttatattttcttgctaatgctgtttttgatttatgcatttaaaaatattatcctaagaagggattcagcctgactttaccaggtgctagaggaatccaaaacacaaaaactgttaaaacccttttgtggaaagcccttggatacccttaggagcatatgtatcccagtttgaaggcagatggtctaggggatggctgaagcccatcaacaacacctcttaaaccattagtttagggaacccagaactttcgtgttttgccaagcaatgaaaaatgtgaaaaatcactttagcacctgggagatgattctagtttaaattctgtgagttggtggttctaaaccagagatgtacatcaaaatcctttagggagccattttaaaatacacagctgagcctaatgcctcaggattgcagctcagcgggtctgggtgggacctggaccacgctgtgttaaaagcccaaaggtgattttcatacaaaccctcaagaaccactgttttaaacagaagggctttgaaaccttgttttataagaactattttaagtatgactttttttttttttttttttggagacagagtcttactctgtcacccaggctggagtgcagtggtgtgatctcagctcactgcaacctctgcctcctgggttcaagcagttctcctgtctcagcctccccggtagctggggttacaggcatgcaccaccatgtccggctaatttttttgtatttttagtagtgacggggtttcaccatgttggccaggctggtctcaaacttctgacctcaagtgatccacctgcctcgtcctcccaaagtgctgcaattacaggcatgagtcaccatgcccagccttaagtatcgctttttaaaagttttatgtttgatccaaaaactcatggcaggaaattgggaagatttactttgtagtttgaaatttgtttgttactgttgttgttgttgagacagggtcttgctgtgtcacccaggctggagtgcagtggcaccatcacagctcacttgcagcctctacctcccaggctcaagcaatcttcccacctcagcctcccaagtaactgagacaacaggcatgcaccaccatgcccaactaattttattttttgtagagacagggtctccctgtgttatccaggctgatctacaattcctgggttcaagaaatcctcccgcctcagccttccaaagtgttgggattacaggttggagccaccacagcctgacctgtagtttggaatttgtaaccactcaaagcatcttctgtcattgggtgctcagggagaggggttcttgaccatctctggggaccataaaactctgaagtttcatgccctggtcttcagcttaaggggctaatagctttcctgagatttgcaaaggtatgcatgatcaaaaaaggggaaggaagaatagctacctatatgctgaaagagcaaaatttaatggcaaaatgaacaaaaagatacaatcattagacatactaaggaaacagttactaaaacaccattaattttatgagagaagtgctgaactgtagctctaattatttgatttcgtgaacattttctgctctattatttcctgaatttgtttttttgcaatgtaaacacagtaccataggtaaatggagttgcatataagtggttttaatggtatatattagggaaaaatgataaaatattaaaatatactgcctcttaatttaaaagcaaaattatctttaagactttaagcttattttatgctgctgggtatatatctgccagaaatgaaatcagcatgcggaagagatctctcaactctgacatttattacagcactattcacaacagccaagatatagaatcaaccggtgttcatcaacagatgaatggataaagaaaatgtcatatttaatacccaatggaatggtattgagctttaaaaaataagaaaatcctgtcatttaggacaacatggatgaacctggaggacattatattaagtgaaatacaccaggcacagagaggtgccgcatgatcttgttgttatgtggagtgtaaaacagttgaactcctaagtagagagtaggatagagattaccaagagattgggaagagaggaagttaggggagggtttttttttttttaagaccttaaatattttatttttaagataaaataatttcatcctaatactgggctctccggcatttgagagtattatatccttggacctccatcctctgctcactgtcataattcttagatcttaattcttactaaagttttattttcatcttctaaaattacaaagcagtaaacatgtaatatacaaaatgtatagtttcctccttgcaacaagtgagaaaaaaatcctattttaacaaaaagcatttttaagtgagtaaagatgcaatttttcatttacaaaataagttaataggttttctagttgggtttataaaaagctgatgcatatcctgttctttttccctatgactgatgacataacttctgcttttgttcatgatgccctctccttggcaaggagtgcctcccacccacatacctactcactctttaggaccagctcagatgtcacctattccaggaagcctcccttacctgtctctgtgttcccgtagagatctctatcacagtacttactacattacgttttaattatgtatttctatgtgtgtctgccttggaagactttaacctcagtatgattatctttgtattattaatgtctggaacagtgactgctcattaaatattgtgctgagtgattatattcatagtcacccggctcacacctcccacccgtttgtcattgtacttgtctgtgatcatgctacagaattctgttgtgggtgaactcacccagcagcacagctatggtgctttggccttcaagctcctgctctagccaaccaagctaacctgcccagctttggccagcagctcattgtaataaactgagttcaaatggaacccagcactattaaactagccatcagcctaagactacccttcaaagaaggagcgagaccgggcatgaagtgggcccgtgagccagccactccctgtgtaaatctgtacttcagcttctcgctctcttttcactgcagttttattgctgtctcaccaagatttcccttcttccaggcctttactcttaaaggaaaaaaaaaagttgcttatctttgcttaattattaacataatactggcttaattctgaactaggagatctcaaactctttatgacagcccagtgaataaagtgatgaagtgggaaacaaaatgtagagggtcagaaagtgcatttcagtttgtaagatgaaaaaagagggaagggtggtagagctgactcatgtgactgtaattcctagaatataggagcagtgtggcgttattcatctaagcgcgtcctagagattttatacatcgtgcacacatttttaggtattgtcttagaccgtttatgctgctaataacaaaaacctgagactagataatgtaaataacataactttattttcttgagttctggggtctgagaagttctagatcaaggtgctagccttcagcgtctggtgagggccttcttactgcatcctcatatagtaaaaggggcaaaaaggacaagaggaccccatgctgtgtcctcatgtgcagaaaatatgggcaagaaaggggcttagctagtacccttgagccctttttataagggtactaatcccagcctcatgacttaatcacctgaaggccccacctcttagcactatcacattgggtcataggttggcagatacatacattcaaaccgtattttggtttgatacatacattcaaaccattttggcggatacacacattcaaaccatagcaggtattaacctatcaatagtgcagttgaacataaaatgaagatctcacttcaatgaaacacaaattaatatgatttaaaacagttgcacattgtaactttctgaacacctgtattctgtagcctgaattttggcagagaaagtggttgaaacatttgtatctactatcaaattaccatgataattgtttattgttctctcttcactttataccttttaattaagctgggggttggggggaagggaggtgagaaagaaaaggaagaaaaatacagtttttgttgcaagtggattttgtatcattttcctgaaggtcttggttctagaaattctgtagtcttggtgacctgtcagtttttctttataattaactgtgactgtattgtgtattcatcaatattatgaaatattatgaaatagtaaaactcactgtgactgtatgcatgcttgcccacgcgtggctgaacttttacaaagcagtgagggaagttctcctagggtcaggacaggtcatcatgggcacaaggcctctcattactttctctcatcagaaaaaaacaagtgagagaaaaaaaatgcacctacactcaggttcctgaaccccatcttagttcttctccagatagcccagcaagtgagtttgtctaatccctttctcaggaatgagcatgatgaatgaaaaccaagcaaattctggagtcgaaccaggttagattcagaccctttctgaccacttctaatttctgcctctgtgttttcagtgttaaatgtggatgctaattgcctgctttgcaaggtgtctatagaaattagatgtgattatgtaaagcttctagcacaatgcctattacgataaatggttctcacagttgctgatgctgctgttactatgttttttctctacagtagttctgtcttattttcctttgaaagctggagctgtctgtgcttctcctattttatagtatcagttaagggttttcagtggtgttttggtgtggtggagttatttcttttactcagggagcttttcttagggagttaatctgatactatattagagagagtagactctctgtagaccttcctaggcaaagttgaatgagtatttggatgtagcacatacatggacacttctagttagaatatgaagcatgaatttaggtagtcataaaggtttataataatctaaaaccaattactaagatttataaccaacattttgaacattgagtagtattaggatagtttttctagcttttaaaatcagcctaagctttttggtaaagtcaagttttgtaaaatgggtgaagattttttttttcctagtgaaataagaattggcaaacttttaaagctggtttacgataatttccagatgaatagaaactaaaatgtattgtcagctgatgtttcattgtaggctcctatgaaatgactgaattctgtctgtatccctaaaaattgagatgaaactgtcattcttatacataatcttagctaagtgacctcagattgaagtaaatcagatcaatattggtatttttataaccccagcatagatggtgcctgtattgattattgtaagtagcagggcactttcgggagctcctgatggaaccggtgttagctgtaccctagggaaagaattatgcaacacagtgataagtcatctaactaaattcatagcaacaaatctatttggcttctaggcatctctttgaagtgggccaagggcttggggatggaggtaggaaacctgcattggttcctgccggggcttctaccaactctgatgggagagcctcctgggctggctgagatggaattgcttctctagccccttcactggatacaaaataaaggagtgaagctaaagggtggaagaacacttcctggccaccttcacgcctgcttcaaagccaaggtcagggggctgttataccagggagtgctgagaagggcagaaagctgaaactgctccttcctccgatacaagaggcaatgaaaaactggtgaaggtggccgatgatgcccacaggggaagacagcactgactcctgctttgtggactctgcacagatgctatattagaactcaaactgctagtgactttcacatttgtatcatttttaatgtggtcacattaatttgaccattctgcaggccagtgttcatgtattactttagtgtgatttttcttatgatcaaaatcttctaaaatcaatttggtgagctatagaaagagaaggtaaattttccttgtgtgaaatacaactctcagtaataagactgctattagctattctttgaatctttcctgttttcagagatggctttgaggtttaataaatacttgtccacagtgatttcagatgatttttaagaactcatcttttaggatggatgtggtagctcacacctgtaatcgcagtgctttgggaggccaagatgggtggatggcttgaagccaggagttcaagaccagactgggcaacaaagcgagactctatctctacaaaaaataaaaatatcagctggatgttgtggcatgttcctgtagtcccagctacttgggaggctgaggcagaaggatcacttgagcccaggagttcgaggctgcagtaagctatgatcacaccactgcactccagcctgggtaacagagtgagaccccatctttaaaaaaaaaaaaaaatcatcttttagaatatttaaaaaatagaactttttcaggcataagtagttaccttatttttgctgacaaatatttgttacaaagtcaagtttagcctgccagaaaatcttgcctagagaaaattgaatagtttatccaaaagtattaattgaggaacacaggtgtgattatttctaagacattttaaaaatctaaatagttaaccacacatattaaatgaacttcctttcctaactagctctaaaatatgattacctatgatcctttccttatgcctatttgccatactcttatagtgcttgttttttaaaataataattctcaataataaatgggttatgttccagaagttcatatatgaattaggtgtttgaaagctgggacacatttgcacattataaaaatatttcatgtataactgataacccacaaaagcctatttaacctattagatagtaatgttattataaaatccctatgaaaaacatgtgtatagttattcacccaatttgtattaaacatctattctactttaatggtataatgatgtaccttcaaattgctcagattctactatttctaaagcaggttttcttgcttcctcaaatttttctccctaccctgtcctcagccaactataatttttctccttctttcctctacttggaaaccaaactcagtatcaaaacctctccctaccttactatttacagaaagcacacacccttttgaaatttttctaaggttttccacttctgtaaaataaaggacataggataacagaaaaagtgtcatgaagtttagggcatatgcatcatttgtaaactaaaaagaaaacacattgccatgtcacttacttagaatactcctaatgcatctaggaaaagtggcagtttgagggggcactcaaagactgaaatgagatctattcacatttgattagaaagctcagacagttctttagacatcttcctttccgataatgattcctctacaattctggaaacaggactggttatctaggagcaggtgtttcaataaagaagagaatggggagataggccaggcctgtgacagccctttgccccctgggacgcaaggagagtagctgggttcctcccaacctccactcagtaattgttggcttcttttttccttcttctaggagaaggtatccatgtagtttatccattcaatatctctcaacctccttctggcttctcctactattgtaggcaccaacccccaagtggatgttgtaaagtatgaaatggtcacataaaatgcattctaaaagtatttagaagaaaagagcctatttgtcagcttagtgttagctgagctcttcatgacccccaaagggcccatagcttaggcagatttagaatttgtaattggattctcttgtttgaaatggatgtagcatactttaaatgaaaatacttactggacagcaagcatgtaaattgcagtctgtggactctgcagctatgaatgctccctgatgggccactcagtcagcctctcctccgacctgctactgtttgccaggttgtggcgcctgccacatagcacactttgtgcctttgagagttggcagagcttgtaaaaccactcttttgttttggtgtttttcagactgggatcctttccattagtttgttttgtttttgttttgttactacatttagatgttcaataggttccaaaatttgagatcccttatttggggacatattgatgtggcaaattagagattgaacagctcaaaaaaaaaaaaaaaattccttgcctagtagaaagatgatttaaaaaaataaaaggaacatgttttaaatctcaattttctttcccacatgagtcagaggaatgctttgtgatttaaatccctttttcctggcctgatatggagtctctgcttgttacgctaagcataccaaagcccttgcttggtcctatttctttgttctccaggatgatagccttaattacttaatagattcaattatattttcagatcacaaattacctgtgaaagtcactagaagtttgagttctttttttttttttttttttgagacggagtcttgctctgttgcccaggctggagtgcagtggtgcgatcttgtctcactgcaacctctgcctcccgggttcaagcggttctcctgcctcagcctcccgagtagccgggtttacaggcgcccaccaccacgcccggctaatctttgtattttttagtagagacggggtttcaccatgttggccaggctggtctcgaactcctgagctcagcgatccactcgccctggcaccccaaagtgctgtggttacaggtgtgagccaccgtgcccagccagtttgtgtagcatctgtgcagagttcacaaggtgggagtcagtgtcgtctgtccctgcagacatcatcagcaccttcaccagtttttcattgtctcttgtatcacagaaggagcagcttcagctttcagctcttctcaggtactccctggcacaacagcttcctgattctggctttgaagtgggcatggagttggccaggaagtgttcttccacccttttgctccactactttattgcctatccagagaaggtgctagagaaggaatacaatttcagcagcccacgatgctttcccatcagagttggcagaagctggggcctggaacccatgcaggttaggcttgcaaaactaagaagggtaggaatggtaaatgtatccatatggaacaaaccttgcttttaagcctctgatccaatccgaatagcgtggcttcttgaaggttttgttcctacttttgttcactgttacgctatgtaccaggaaagcaaagcctccttggagttttccttgtggttatttccttggaagtggctgacttttccagttgagttcagactggcagaagcagagagtgcaagagagtaagttaccaactctgggagcaagggatcaggtgtagatgctgacagaagaaggtaaataatactcagtcaggactgtggtctcacacatcagtgaagatttaatagagcacttatgagaagatgaatctagaatatctaattcctgtagccacatattgaaaatgatgaaattagttgcagttaaagaaagaacttgaaaagtagactaaaatagattactaaatgagaaaagaaaggggcagaagagtaaattgttctgaataaatggaaagcaaatacatatatttatacatagttttttttcagaaaggaagaagggaaaggcttttacctttcactttatagctttttgtacttttttgaatttcctaaccatgtaatagacatttctttcttaaagccagccacagtgactcacacttgtaatcccagccactgaggaggctgaggtgggaggattacttgaggccagaagtttgagaccagcctgagcaacatagtgagaccctatctcttaaataaataaataaaaacacttcctttctaagataaaaagaataaatgggctacctgggtcacagaattatgggctttttagatgttattttcatattctttctgtagtatagaaaatctaataaataaaagtaaaattaggctaaatcaatagataaatttactttctttttataagcaaatgtgcagttgatacctatctagtattaaaggtttatttgtagaacagttgagagagaaggtaatttaacccttctgtaaccaacctgtgagttgcacttcatataggaccttagaatactaagtatttgagaagaattgtggctcaggaattatcaggagctatatgaggttagtgggtttgatcggggaacctttcacattctttttagaattccactggctgctaaggcgtttgaattcctatggaactgatttctattacaaatgttattaaaacttgatgtggcatctctcactcattttttctcctgatattgcttctctcactattttcaaatctaaagctgctctgctttaatataacgaaccaggacctgctttgctttctgacttttggaacagattaggctacataggattcatgatggatcaaataaaagagttactgaataagaaataagacatttggaaggctaagatgcatggactttattctgtagccagtaggatctctgtatcagtttagggattttttttttaatttatgagtacagaatttcttaatgattttaacaaattggggattttcttttctctaacctatcgggaacatagaagtgaagagttgctgatactagaccagcaacttaaagatgtcagggcctgagtctctgttgttccctcagcctttccctcctgatagcctcctggtttccagatagatgctctgccttaagcatcacatcgacattcaaagcaggaagaaaaggagaggtgtagagcaaataaattcacacaccagagtctgctgtgccttaaggaccattcccacaaaccacacctaaccacttcagtcttcaaagttttggccagatctgtgtccagtggccaatgagggttctgttagaaaagaagcatcaaggccgggcacagtggctcatgcctgtaatcccatcactctggaagtccgaggtgcgaggatcacctggggtgaggagttcaagatcagctttaccaagatggtgaaaccccgtctctactaaaaattcaaaaattagccaggcatggtggcacgcgcctgtagtcccagctactcgggaggctaaggcgggagaatcacttgaatccaggaggcagaggttacagtgaatcaagatcacaccactgcactccagcctgggtgacatagcaagactccgtctcaaaaaattaaataaataaataaataaataaataaataaataaataaagcattaaaaagttgttatttattgggtaaccagcatggaatggaatgatatagccccttccctatgcaaacttgtagtatgcatttccaagagagaaatgttacatcaagtatttcccattatgttttggttttgttttattttaatgtggaacacatttttttgttttgcctctcatgggactcagtatttagaaattttggaagcatacattctgaaaatgatacaagatagaatgaaatcaaatgctaaatagcgtgggacagattgcattggagtgcagtaaaagtcagagaaagaaatgtgatggtggtaggaatagcttaaaaagatttcatgggaaagggacttgagttggactatgatggatcgagttgtactataaatggattgaattctacatgttactacatggtatatacatgtcattatacatttatgaaaaccagtagaaagtgcatcgtcaagcgtggcccctcatgtaaactatggacttcgggtgatgatggcgtgtcagtgtcagcccatcagtggtaacgggtggaccactctggtgtgggatgttgatggtgggataggcggtgggggcgcagggctgcaacagcatatgaaactctgtactttctgctcaattgtgctgtaagcctaaaactgctctaagaaagaaaaagagatgagacgtaaacagttgcaaagatgatgaggctggtgttctagtgagggaaaaaagaacacagtcacagatacagaaatgactgcagcacaggacagcatggggagaatgcgttggcccataattttagacaacctttaagttaaatgttcagtggttacttgagttggaataaacgttcagaacctaccatatcattcctattaaattttacgaagtttacataagaaatttaaaatattttaatattttctacagaggagagatgattaatttttgatattcgacagcagtgtatatgtgtatttatttcactgattaaactcagttaactaatactcataggattaaaattacatgcaaatttatttacaaaactgatatttaaaactgagtcccctgtttagaactatttttaagtattgtacattttctacttagataactgtactttgtaagtatgaaagcttttctatttcatggccaatagtaatcattttgtaaaatactggcattagccattttagttttccttaaagtaaatcattatcctattcaagtaaaaacaccctcttttcagttcgttgttttaattaagcaaagtataataaagttgagttcaattatttttcttttccacattatttaaatagtttcttctaattacacattgattttaattgaattgggtctaatttgataaactccgtttccagcggttaaaatatagatggataactacagtctctgatttaccatttctccgtgtgactggaaaactttaatatggttagactttgccctcccttttgtgtactttgccctgtactttgcttagttgtaaacattattcatgttgtggggcagggataatgcttgtagagtagctagctagcattgtgactggtggtaagtcaccaacggagatgaaaaagcttgccttttaatctgatttatattaacgcaaggggaaaatatatcattttctcttctatttttagtgttgccatctggctgaaggaaggtttttgttttacttatttacttattttttagataaaagcctttttggttgaatttaaagtgtgtaatgtttattcctgtcagcgcaatgtgtcagaaagcatttgtgatgtgaatcgaggagctgcttttagtggtaaacgaaagagcttagtgggtgattccccccagttcccacaagatatatggaacatgtgcttttctgaaatatccttttcctcatgtttagctagggtggataattatttggctacataacagattatcaaaataaatttattaactgcttgggaaagagttggggtttacaaatttcccaaagttgagatgcttgtctgatgttaccagcagaggctgtaatgttcacatgctttctttcctccatgcagtataagcagtaacagcttgagtgtcccttatctgaaatgtttggaaatggaagggtttcagatttcaggtttttgggttagtgatgctcgacctgtattctgttgtgtttgcagagtgtcactctaattcctgagattctcactgtaggtgagactgagcgctcctttctatgaagtggggtcaaaacatccatttgattttgagtcttgcctaatataatgttgaaatcatcctagattaacatgagatattttttctcttctgatgtgaggtgtttagcacactacccagcacatatgtgacactgaacaaatgcttgatgaaggatgcaagagaggaatggatgtgtgccttgtggaacactgtgacaaaagtccagaaataaaaaatattaatgataagatgattagtaaaaagaaaaagaatacattttcttattttttgatgactgctaagattgtagagaaagggtgacaaaaagagttctcagatcaaggtcacgtctacttcacatcagaagagaaaaaatatctcatgttattctggagattataaggctgaagggcatgacccctgccctgaggttgctctggtcaagtggaaaattatcatagatctgcacctggccagatatcaatgactgaatgccgatgttccatttatttggagactgtttaagctcagaatatgatgactatgactagacatcagctccttgaaggaaaatggcccagtcctatcccttaggaatattttggtaacctattttgatagaattatcttttgctgttatatacatgatctttcctatcacatgttaggttttttatttcagaaaatgttgattgtgtcactattttatttatttatttatttatttattctttgagacagagtcttgctctgtcacccagggtggagtgcagtggcgggatctcggatcactgcaatctccacttcctgggttcaagcaattctcctgcctcagcctcccgagtagctgggattaattacaggcgtgcaccaccacgcctggctaatttttgtatgcttagtagggacgaggtttcaccatgttgaccaggctgatctcaaactcctgacctcaggtgatctgcccacctcagcctcccaaagtgctgggattgcaggtgtgagccaccacgcccagcctatgtcagtattttttataatctcatgtatagaccttgacagttcaatccaactgcctcaacttctctttggaagtggttcaatataaattattaacaaagacctgcgtgtctcagttccattcttcaagtcttagtgcagttatagaaataaggagtgatacctgtggaagattctgtccctatgtgtcatataactatacaccatgttggactgtatttataaagtcaatgtcttttgttgggtttgtactatctctttattgaacaaatttatttccttttggtttaatatcattttctatcatggtcatacatcttaaggttttttccattatgacgagatggagaaatcagaaagtgactttcagtcattgtcattgctgaatgagctactccaaattgtaaagcctccacactcttactatgctctgctgaagtctaccatagccaccaaatcctaactttgtgttctgtatagatgtgtgaaatgcaagaaaaagaagattttaattgaattatttctgtcagcagaatagggagagtgctgtgtataactcaaatatgtatcattatcagatgatcctatttagttttttatgttttgtcaacaagaattgatcaatagagtgaataaatggttcatgattgttatttctgtttcaaaatgtcagtcagattgaatgtggctggatgttgcaccataccatgaaatgggtttattctggtgtgtatagaagagcaaatgagactgcactatttttgacattgacagttacttaaattgccatgacacaatacctgtaggcatgccccatgaagcagctgcttccccattaagtgagggtctacaaaagattaataacatcaatcagtttcccatattttatcttcttcactccctgcaaaatgaccttcaaaaatatgccctacctatttcccaacaggcccatttccttatctggcctgccagctgctcatcctcccaggagtttgtggctggagtcccatttccggtggagggtccctatatagtgctgcgtgagctgtccttgacttcttctagggtgaccacactgactctactcttcccctacttcttgtttcttcagggacagacataagtttcaccatattcatgttactttttaccacgtagtggtcaaatacttatctcttggtacacgatacgggtaagtggaagaacctgactagttactaaattctatagaaggcagagttcttagcatgtctgtttttgtctgatttccttttattgttttctttaagatgagatcctttttaaattcatttccagcaggcttgttagacttcactttccatttacacagaatccactgaagctaaagtagttcacagctggaagttccatgtgatatatacttcagtgactttccattgccttcacgagaaagtccacactctcagaattcaaagagacattgaccttagccagtttctcttgtcatattttcaactgcctcccttcctaaacctgctgttctgaccagacagtcctgattgtctctcctgcctctttgccttggtagttttgctcgtgctccatcccagtgagggaacttctccacattattcttcacttatctggatgctttctggtctgcaagctctttgcccagggactgctgtgccttgtggctccttcttccactccaaattcctgtaacactatctatatcatttatttggttattaaacctctgtgggtttatggattttttagaaaattgaatcggtctattgttgcaatttcatgtatgtgcacactgtctctcctccaaaggatgataagcatcttgaaagcagatagtatgtcatataacctttgtattctcactgcgtagcacagtgtctggcccatggaggtattgtaaatgttgaaaaaattacttaattccttaaaattacttaacatttctgaggctggtggttctgttgattgtgacaaagagactgacattagggggttggcttttttgtgaggacattcaaatgatagcagaaatacatgagcagatattccctagaggttgaagacgggaactttgttgagagcacatatttataaatgcacactcgacagtgactgatgtacagatagtatttcaggccatactaggagatgatttttgaagagaggagatagtattggaggaatcagaagctccagaatacagtgtaacctagaaacataggacaagaaaaggaaaaagaagtggtagaaggagatacattatacccctaataatattacttccagcatcgagctcaagatgtcccatggagtagtgtactgttcgaataaatgcaagtaggaagaaaactgaggtagtgtgggaaatgaaatccaggtttgtcttatgctaactcccataagctttgatcattgctgcccaacttcacttataattatgaggaatttaaactaaggagaaattctccattatgtggaataatcaggaatgtcattaggagtgttgctgttgctttatgtccttcttgttctaatgcaaattttataaatcacattggataaaacacttcatacctatgattcgagtgttacaatactcctggcaggtatatttgaataaataaatgtaaggaataaatatatataaatatatacaaaataataaggacagcagtctcaggcctgatatggtaactcttttctatacagatttatttaaactattagattgaaacataaaagttgttaaattttaaccattttttactacataaaaggctatttcatgtggttcaacctctagttctgtgttctaggtcactcccccaaagctgtgtcctcacaagtctatgtccacaaaggggctgtatgcccacaaagtccagttgaagactgtagccgagaagcatgtatgcagtagttcctccttatccatgatttcgctttttgaggtttcagttacggtcagttgtagtccaaaaatattaaatggaaaacttcagaaataaacagttcataaattttatgctgttctgagtagtgtgatgaaatctcgtgccctcctgctctgtccagcctgagatgtgaatcattcctttgtccagtggatccacactgtagtcgctgcacacctgtcagtcacataggagctgtctcagtagatccaaaaaacatagcgtatatatggtcggggactacccacaaattcaggcatccacggagggtcttgggaacctagtattcctccatggataagggactatacagagctgggaactgagtttaagcttttgctgtttcacagcccacattccagattttattaaaaagagtgactgaaatacattatccttgtggatgtcaagtccccatattattcagtgagatttaaactcaggatggtgcaaaggttatagtcagacgtgtctcagagcaagtattttgactaaattgacaggtcatttgttggaccagttattctgagcagttgagagaagactgtattggaccatacagccagaagtagaaacaaagccatgagaacaccaaggcctttgtgggaagacgttggaaggaatcagtgagtggcagacgatgtggattgcacaggcacattgcagcacttactggagctgcagaattttcactagatgaaggctccaaatgtctgatgcctctatattttgttttagagtatgtcggaaagagagtcccagaccaccagggtgcttgtttgtatccttcctcttgtctttacctcaacactcacatgtgacactaatggaatacagctttcaagctagcaggataatcaataaagatttcataaggctagcaaagacttactgagcatcgtagtatatggcttaattttctttttttttttttttaaatgaaagaagagagattcaaataaataatactggaaagtcacctagtcattttaatttttttttccatgagaacttttataagggtatatacaatcctatcttctagttaatgaggattttcaggtttttaaattttggaaatcagaaaatgaataaattcctgttgtcattgtgttcttaagtagtgaaatctcctgcactttgtttaaaaaaaacaaaaaactcccagctgggcgtggtggctcacacctgtaatcccagcactttgggaggccgaggcaggcagatcacctgaggttgggagttcgagaccagcctgacaaatatggagaaaccccgtctctattaaaaatacaaaaaaattatccaggcgtggtggcgcatgcctgtaatcccagctacttgggagctgaggcagaagaactgcttgaacccgggaggcgggggttgccggtgagccaagatcatgccattgcactccagcctgggcaacaagagcgaaactgtctcaaaaaacaaaacaaaaaaacaaaaaaaaaaaaacacaactccctgttttatttttcccattgttactgaggttttgttttttttttttttaaggctcagatttacttaatataatgaaagacatcacatcttagaaaactgtcatctcccccaaaccctgaatcagaaggactaattacctcttcccaaaccaggccataccctaaacatcatatcaataagttcatcctacctgagagcaccaggaggtataactgtggctgagctgaaaacctctggaaacagcggctgacccagaccttcctgccactttagtcacttgcccccaggaccccgtcaccaagttaacataggtttgctttctctcaaatccctgaggaactagaagcccagtttcctgaagagagctaaaaatactttctaccatttatcgtgccttgctgtgggccaggcaatgaactacctttctgtacgttatctcgtttaatttttacagctctgaaagtagatgttttccccatttacagatggggaaattaagacttagagatgttaagtgacatgctgaggattcagctggtaaatggcagaaccaggtttgctgactccaaaacacactcaaacctgcatgggtgctatgggtatgggatgcccaggactccacagaaaagcatagaagctgggagaaagggccttgaatacttgttaaacaccttctatgtgccaagtcttatggtagatttttaacatgtgtcttctcagttaatctttcaacaattctgtgagttaggcagtattattaccccatgtgacctacttagagaggccaaataactttctcgccactcaactggttatgtaccaagtctcacttttgaacccaggtctgtctgtgtcttttgctgttacaatgttcaccaaagaagtttttgaagaaatacagactcttaaaccattgaagaagaaaaagactgatatgaaagcagagagatggcctgaaaactttagaaatacatccaacctaagagttaggaattagcaatatataatcttagaccaaacagcctgacaattttcaaaaaattatttttattttacgaaatttaacctattactaatccaaatggcttaatggaaaataaaataacataaaataaaattaacctatcaattttatatgagcacagaaaaatttaaaatggattgtatatttgtctcatggtgaatatgactcagaaggtcttctgggatggaaatgaattcccaacatgcagacgataatgaagtgggcagataggcctctgatgttcgcctagaatggatccaataaaagttagatgtagataaattagagttaaagtaaccagaactcctgtttaattgattttttttaatttgaatttcagcataataaagcaaactacagcctccctccagcaccccacccccaaaagcatttatcagggcttattcagaaaagtgacttgtactgaacatacgttgaagtctttttgatttccatggtctgctgttacataatattcagttagggttgatgtttgttgtcaggacctggggctactgcagagactcagtgaccccaaagaaagattaaatgatgttgaatataccaaagcaagaaagaaattaatacatttgaaatatattctaagccaatggtgctttgtaagaactcagatccaagactttagactccagtcgtgcttccacgtggttgctttatgtgtaaactggtgcagccatgggaaaggcccttcatggccccttgaacatgccacttctataagatgggtcacttaagctgaggttgttgattttttatgtgttcttcctactccttgagggcacaggttgtaactacttcatcttttcatttccttaatctagcctaagaacctggtacataggttaacagtaaatgtcgaatacttaaatgtttctgaagaaattttaagaaactaaatgtgtcttttctcttttgtctcatttctgtagcacccgacagctacaaagtgcaagataagaaaaatgcctccagccgccctgcctctgcaatttcaggacaaaataacaaccactcaggaaataaaccaggtatgatgcattgcattaactgtgggaaaataaaggttatcttttatgccctaaaggcatgctgatgattataaaggtttaatttgtttaaattctagtttccagaaaactcgaatttaggagagcttggtttcagtcctgccaccaaacacacactcctactggattgtatgatattaagtcagagaacctctcaaagccaagccttggttttctctctttaaaatgtagattcaaacacacgacctgcttacctctcagagtcattttgacaatcaatgagatggtgtatgtggatgcactcatttaatgtcaagcagcttaaaggggtaataattttactattctgtttcaaatgataggacacaattttttatacctgtatgtccaacaagcattattgcgtatctcttttgtgactttttcaaaaactatttcaagaaatctttacacatagcaaagcttgtatagaattatggttttgtttcctattccttgcaatgattatatgcctacagagtaatttcatttaataacctctgattcatagtctctttcattcagtgatacaaagaagcaaacagtctgtaaatataatacaaacaattgaaccgacagtgcagttgcttccagttatccaataaccattgcgtggcctgtgggaggaatgaatgtacagtatgataacaggagacaatcaaaggaaaggaaagcaagccgaataccccatgaggttcttggaaacctacttcatgctgcatccaggactgaagtcactcaagcacagtgacacagtgaatcagtgagaataaagatggaaataactgagtctaaccttatagagaacattctagtgtgtttagttttgtgaatttttttttttcatgtggaaaaggtcttgaacacaacagataaatctggtttgtcatttagaggaaagacaataacaagtattgttgaaaatactgcttaagctgccattagtggaaaatgatgtgcagtctcagaggagttttaattaccaagcagagatttccttagtcagtcaacctgccttttcattgagtcatttatccatccatctagccatccaccttccagctaccatctaatgtttactgagttcttctatgccgaagaagcatgaaagatgtactgtatgagcaaacaacatgaaccctgtccccacgcagcttattctagtggacctttatttttgtattcaagtgtgtctctatggaagtagaaattctttagcatgaaaatcacatttgttggcagaagtggacctggtagctgagttcccctggcctcctggtgctgcactgaggttatggcccacttcgcggccgggctgggcacgcagggcaagcgggtggtgttggtcacgtcaggcagcaccaaggtccctctggaagcatggccggctcttctgcgatgttttacctggcgcggccctgtcagatttctgtgttcctggctctgaaatgcctgaacacaagatccagtcatctgggggcccactgcagataacaatgaagatggtgccaaaaatactttcttctttgattaaagattgtgctcccaaagcatttataatttcctttaagttggagactgacccctccattgtaattaatcgagttcagaaggctttggaagtttatcagcatcaagtggtggtggctaatatccttgagtcacaacagtcctttgcagttattgtaaccagacactcagaaaccaagttatagctatcagaggaagaaatagaaaaatacatagagatagaagagaagatagtggataatcctcagtcttgacacacagctttaatatgtgacaaaaactgaagtaaaaagcccttacaggatcaaaaattgtccagggctcttacagatggtgaaaactttaataaaacttttgctttcctatgaacagagaaaatgaaggaaagggaaaaggcagtggtgcgcaggcaaatatgctttgttattcatcttttaatgacatgtgatacactcacctgaatgtcatcttgattttgaaattgaaccctagaactgtttctcacctttaaaaataagagcttattgggaaatatatattacttaaggtacacatgggggcctgaatatcagccttctttatactataaaaagaggattatggatgcatgaatggtcatgctttggaaatcaaatatttgttgagtgcctactgtgtgtcaggccctgtgctgagccacgaggattaaaaagatgaataaatgtgtttcaaaaaaataaaataaaatcacatttgtaatacaatgagaatttaacatagcttagttgttggtgctgtatttctctggttctccccatccaccactgcttctaatttctaccattcttttactgtgcagtttatacttttatatcctgataactcatttattcatctagtgttagcatcattaaagtactaggaatatattattaaaagacataatctctaccttccagttgacagtatgatggataaaccaatatatgaataggtcattctaacacagaaccaccagtgtgacgagagattgcacacagtgtatagagatcagaagccagaaaaatctcttccacccttattggccatctccttatatatagtcatttgatttatattgctaaagtcaagttaaatagggagacatttcacttctgattgtgtctttttgagcatccctgtgtctgttttcttgtatatacagataagccaagctatataaaaggctcttgatttagtaaccaccatgtcattattttcctgagtctcctcaaaggacaatatgagttatgtgttggagggctggccttgagtaacaccttttaatttttgtgggatacgggtcataggaatgtctgtctaaagcattttgttaattttcattttctagaacttgaaaaaaaaaagttcattatatattttgggatattttaggtattgtcctaaccaggtatgggcatcctgactgaatgatttctgagaatcccttttaatctagtaagttttagctaaatgttctttcctcttttaccttctgatacttaaactcattagaaggctccagaacatctctttgatgtagaacacatttatccacattcaagttgtgacttttatatttaaaacacattatggctggccaggcgccggtggctcacgcctgtaatcccagcaatttgggaggccaaagcgggtggatctcctgaggccaggagttcgagaccaacctggccaacatggtgaaaccctgtctgtaataaaaatacaaaaattagccaggcatggtagtgcgcgcccataaccccagctactcaggaggctgaggcaggagaatcacttgaagccaggaggcagaggttgcagtgagccaagatccgccactatactctagcctgggcaacagagcgagactctgtctcaaaaaacaaacaaacaaacaaacaaaccacattacagaagtccctcgtggtgttttagaactatgagcacactatgttctgtgttatcctggaacgaccattgctctcaaatgtgaatacttgaacccagaccaaaacagacagtttgtaaagttacacatctgtccacgtctgctagttcctgaagaagtgggagatggttcttcagaactccagctgccttcaaatgattaatagtttgacttccttagaaaactgcgtgttttcatggacctgagaaaagcagatacccaaattcattaaaaatccttctgaattcctatccctttgctgccccccaacacaagtctttaaaagagccactgaaactttattctgccttactgtttataagtaatttgccctcatagaggagtgtgtgacttaggagcttccagcccttctctgatgccacacggtgcaattgtaatgactgtagctgccatggtgcgtggatgggcacaggactgagttagaaatcgggttttatgccctcactctgacacatatccgtgctgtcttcattagtcatatctatttctctgagttttttcatttgaaaaagaggcataataactcttcattgaataaataaatgcttggctaactcctagtgttattgggaagaataaagtgataatatgtgaaagtgcttcataaagtacaaattgctgacagaaatacagaagtatttactgtagaaacagtagttgttacatatgagtcaaggcctagtgagttcttgaaaaagccttgtcaactttgagagctctgtagtagcatgaccgtactctcagatgtgtgtaaggcaatccaggtttatgcatgttatcaaacagagaattttaatggcactccctttcacccttaacaatgccccaggttagatgtcaccccacacttgaaacatcataggtaggaggttgaatgtggagtgcaactgcaatcttaattaagcctaagttctattcctcttaaaccctttttccttgtgagaatcagtaacttaattttattctaaccatattagatccattgggaaacaatgtggaatatacattattttattttatttcaagacagggtctcactccgtcgcccaggctggagtgcagtggtgtaatcagggctcactgtagccctagatctcccagcctcaagcgatcctgtcacctcagcctcctgagtagctgggaccacaagcatgtgccatcactcctggctaattttttttatttttggtggagatgaggtctccctttttcaaataggcctgggctggtctcaaactcctggactcaagcaatcctcctgccttggcctcccaaagtgttgggattacaggagtgagccactgtgcctgacctatatataatttttttttttttttgagacgtagtctcgtcctgtcacccatgctggagtgcagtggtgcgatcttggctcagtgcaacctccgcctcccaggttcaagcgattctcctgcctcagcctcccaagtagcttggataacaggcatgcaccactgtgcctggctaacttttgtatttttagtagagacagggtttcgccatgttgcccaggctggtcttgaactcctgacctcaagtgattcgcctgcctcgtcctcccaaagtgctgggattacaggtgtgagtcaccgcgcctggctgacctatacataattttaaagtattttctatagctaacttttgtttcaggggaaaataagtgggggtggaaacgagaaagaaggcaatgaattataggaaattcactatttactggaattatttaattgtatttttttgaaaacctacctttaaagataaatttttatcagtttttagttattaaaactaaaatttaaacttctagcatttaaatagtttactctgttatcaggtacaagattgttcttagttttccccattggtgcatcttaataaaagtttaaaggctctgagggttagctaaggttgttcgttgtttgttcattcattcattcaacaaatacttattgaatatccttttctaccacatacagcccgaggaattgagaatgcagcagggaagaaaacagacaagtctctgttcctccccagccccatgcacagccatctttaacctgccacaggtgttaatgacattctagcacccaagagactttcatattaatgggaacagagggatagaaacaacctacactaaataactttttcactctacaattcaatattttctaacgccaggtttccaaatcaagcaaaatcatctagtgtatcacaaccactatgcatcttgagcttcaaaaatgttacatttctttacttcctcaaatctgtttccagagagatagtaattatttcagcactaatgttgatggacagccaggaactactgcagtcctaagcattggccttatttacagccttatttttaattgtataaaagtttggttttttacatattatcttaccaaacaggacgcagtttgttacatgcgaagagtataattttcatatgaaatgatagcatagaaatcagagaaaaactagcacttcttcaactattttcagaatatacattcaaaaggcacttcacagggggaagcattacgttgcacaatcgggcattgcctcattactgcaggagcactggttattactatgacttggggctgtcagggttggtgtgggttgtcaggagtggcatgtgtcccatgtgttattaaagccttcttttcaaaattttgtatgaaatttggcatgtacttgaaagtaagctagacatggcacatacttaattgaaatattgtctaacagaatttgtcagtggaattttaaaagtaattaaactgtctattttacagactttccataatgtgctcatatggcttttacaaagttgattttcaacttttataattaaataaaagtttttatgaggctgggtgcggcagtttatgcctgtaatcccagcactgtgggaggctgaggcaggaggattgcttgaagtcaggagttcaagaccaggcttagcaacatagtgagagcccatctctacaaaaaaaatttttttaattagccgagatcgggcatggtggctcacgcttgtaatgccagcactttgggaggctgatggatcatctgaggtcaggagtttgagaccagcctgaccaacatggtgaaaccctgtctgtactaaaaatacaatagctgggcctggtggcgcatgcctgtcatctcagctacttgggaggctgaggcaggagaatcgcttaaacccaggaggcagaggttgcagtgagctgagatcacgccactgcactccagcctgggcagcaagagcaaggaaactctgtctcaaaaaaaaaaaaaaaaaaaattagctgattgtggttgtgcacacctgcagtctcagctacttggtaggctgaggtaagaggatggcttgagccagggagattgaggctgcagtgagccatgatcataccactgcactccagcctgggtgacacagcaagatcctgtttaaaaaaaaaaagtttttcatgagtgagtaaacctcatattatttaaggagtattaaagtgataagtaattgttaaaggtctttcttttaacttcatcttgacttttatcccgagttctttctttaaaatgccattttactacggccaccattttctttcagcaaaacaaatgatagcaagaacttcctgtggatagcccttaataaattgcctgagagggtcgtcatgtccacttccattttcttgtttccaaattaaaccttttagggccaggagccatattttcctacataaaaaatatgtggaagtacataaatgattaggaaatctgaaaaatatttatcattgtgggctattgaggagtccatttaaccaattttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttttttgtatttttagtagagacggggtttcaccttgttagccaggatggtctcgatctcctgacctcgtgatccgcccgcctcggcctcccaaagtgctgggattacaggcgtgagccaccgcgcccggcccatttaaccaatttttaagaaccatcccctagtcttgttcatcatccacactgcctggtttatgcaggctcctaaggggcgtctttactgtttttattttctttaaatgtacaaattctgtaaagttcaagagacatatggcagcctgggcaacatagcaaaatcctgtctctacaaaaaatacaaaaattagctgggtgtggttgtgccacctgtggtttcagctactcaggagactgaggtgggaggattcacttgaacccaggaggtcaaggctgcagtaagccatgatcgtgccacagcactcctgcctggatgacacgagactctgtctcaaaagtaaaaaataaaaaaaagacatttgggatgcaggcctttacatttgttgccaaagcactgctatttgtctctactgtattttcttttctttttttttttttttctgagacggtgtctcgctctgtctcccaggctggagtgcagtggcatgcagtcttggctcaacgcaacctccacctcccggattcaagcgattctcctgccccagcttcctgagtagctgggactacaggcatgtgccaccacactggctaatttttgtatttttagtagagacagggttttgccatgttggccaggctggtcttgaactcctgacctcaagtgaaccacccacctcccaaagtgctggaattagaggcatgagccactgcacccagcttgtctctactgtattattatagtagattcccatttttaacgcaaggttctaaaaatgtcaatgtcaattcttttttctttttttggagacagagtcttgctctgttgcccaggctggagtgcaatggcgcgatcttggctccctgcatcttctgcctcccaagttcaagccgttctcctgcctcagcctcccaaatggctgggactacaggcgcacgctgccatacctggttaattttttgtatttttttagcagagacggtttcaccgtgttgctcaggctggtctcgaactcctcagctcaggcaatccacccgcctcggcctcccaaagtgctaggattacaggtgtgagccaccgcacctggcctgtcaacgtcaattctactgtcaatttagtaaagagaaaaaccttttaagtgtgattattatgctcatttttattattttgttttaattcggcagcagagtgagcctgtaaacctagccctctgctgcagaacccctcttctccacccatgtctcactcagagtataatgcaaagtcctcaccttaaccatgagccccgtcgcttactcatctcactctgttccagtccctcagatctccctattgtttctggaacacattgggtacttgcaacctcagggcctttgcacttactttctatggaacatcattatcacagtgaggccttccttgggctccatctaaaaatttaaacatccttttcctgacatgtcataatccccttcatttccttgttgtctccttaacctatattctctgtatttttctccttctttcattctatgtatagtacttatttgtcttgtttgtcagattttttcccaagtagaatgtaaatcccatgaaatctcaggtttttgtctttttttggtgactgctgtcttttcagtatacagaacagtgcctagcacacagtagatgttcagtgatttactgggacatacacactacacactctactaacagtcattataataatgagagataggttctattgtatcctcattttacaggtaataaatcaaagtacacctcatagcttgagacttacagaggtgggtaagtaccttggccggcgagtgacggggcagaaactgaatgcgtgtctgtttgactcgagcacttcacctctaactctcaaacatttgtgcagtataaagctacttaaggattttgttggtcattaaggaacagactttttaaagcataaaaataatagaagtttggtagcttaggaacacaaaacatcatttatattgtttgatgaaaatagccaaaaggctatagttacgtcatgattttacatgttttcaaatagaagaaaaatgcttagaaatccttagaaaacttctaataattgagtagatcactgtaactctagtcacatgtacttattgttgtaaagtgcagcaatatattattcttcagatttactggatatttatcaatgtgtgttttttctttttctttttttttttaatccactcttcatctcatgttttttttaatctcgctttcagaccctccgcctgtgttacgtgttgatgaccggcagcggctggcccgggagcgacgtgaggaacgggagaaacagctaggtaccccaggccccgtgtccatggccctgatttgaatggatgtcactataataccgtggtcttttgcatacctttatgaattttacagatggactatgaggcagaatttagtatgtgatgataaaatataaacatagggataagttttaagtgacaataaactctagcctcaggattaaggtcatccttttttgcagtcacagtttaatgtggcactggagggaaagtatatatgagtagagtgatggtacagcttacattttactactgagaaaatgcgaggacagtaaacatattgttcttttttacatgaaaagttatgagattatacactgtcagggcacttaactgacttctctgttaaaataatgctgccattgaacttatagacaggtgctaccaggctgctgccaggaaaagcatgtgctgaggtgtctgatttttctcttattacccaaggcccttgtgacgttagcaactgcaatatttgtcatataatcactggaacctggatcacaggactatcttagcagaagctgagactagagcacttagagattgtacagtcattgtcttctaaaacattgggcaaggaagcaggtgccaacccctcctttactttgatgtccatttatgtaaacttgctaaaacaggatactctcttgaaatatacctgaatgatgtaccttggaaaagattaaatgcctggtcagcatgtgcgtgtacagagtgcctgggtattctgaaactagactgacagggtatcaaaattttcccaggagatgacctgtaacttcttaaagttgttctgcattttgtaagagttaatgtttcaactggggactctgcccctatatctcatccctttattattcttattccaaagcccaaatttgtgaaatgtagtggaagctggttttcaaaagtcttttgctattgtttacattctttcaactcagacttgtttctgtcccttgccataatggccatatgaggtcatttcttttgcttctgaggttttttaggcatagatttcatttgcttactggaagtgaacatgctctgctgtttttctgtgcctagagtttcctccctggcctgatgggttccctgcaggcaggtaggttcttggggagcaggctgtctgtggtcaccagggctctcccttcctcctgtgaatatgctcattgctccctactaaggttgctttgacaagcaaaccagaactgagagaggatgaaggcagagctgctgaaactggaagatgagtaaaaataagaaactgactactgttttagggtggctgttatttacactctgttttcaagtccatgcgtatgtccttttccccctctaccccatcaggtctcacacttgtagatctctttagttatagcgtggattcatatctgcttgaatagaaggagttccataggtcgggagagcattcctttatggtttaaatcacattgtgaattagcttttccatacttaactcacacctttccatttgggtttctttatcttaacaaaacaaagcattagttttttgtggaaagcacgaatatgctgctggtgaaacaaaaatgactttacttatactataaaggtgtaagacttacagctttgagcttgcagttctccctaaaagttgcttacctttgtatattgagtgactagattttttcttaacatgtaatgccatatttcaattcatattgataacacaggacatgactcattagtttatatattcaaacactgtatgtgccatatattgtatttaaaagatgacaaaaagatgaataaaggttgacacccagccctctagggctaggtgtagtctagtgaaaggcagataaacaagtagcaactattaatgtcacagtgcaatgcatccactgtgagtgggtatgcgccaggggcattgagagcctgtagaggtgcctaaaccagcctggctttgccaggtgccacccaagttcccaactaaaggatgaaaggagcctttcaaagggatagaagagcaggcattatacagcaatgtgcaagaacaggtggaaaaaagacatttgctgagagacccaacatgcttttcagattattatatgattatatgttacatatattatatctagatgattgtattattctattattacagcttaacttttttggtgagccaatatatgatatacatagtttctctcttctctctctctttctctgaaatgggatcttgttatgttgcccaggctggactgcaatagctgttcacaggtgtgatcacggtgcgctacagcctcgacctccttggctccagtgatcctcctcagcctctttagtagctggcattacagactcacgtcaccacacctggcatttttctctttattcttacccctgccatgttaaatatcataatttttaaaaattcaatctcatttcttttttcaattgtcagagtcataattttaaggaaaatatatccattctaatttttttctttgcattaattttattttctttacatttcagagcagtgcctttttgcctattttttttttccatttaaaccatcatagttagaactaagtcttgagaggctcccttcaatcttcataaatacaggagtgagcatatatgcaaatatacatgcatatattatatacagttgtaaaagagccgtttaaaaatctaatttcagctgtgccttagagtacgtgaggatgatttctaaaaaatcttcagtaccaaaaaaaatcaaagggcacacctgatcaactgtctatgaactgtgctttatagaagctataacagcagtggaaattttttttaaaagaaaaaaagtttaaaagcagacacttaatattaaggaaatctttggactgtgcttaatttgaaaacaaaaaaaaaatagttggtaatgtcaactcttaccaactttcaaactttaaagttttcaagttaaaaaaaatcggacaccattccacaaatgctggcaaagtaaagtttaaaatgaatagccagggagactggttatttactgttggatgtaggttgaaaataacattgaaatcattaaagattgttttaatccacgtattttaaaaagcaaggtagagagagggagaataaaggtctgattattttgttcttggtgttatggcatatttgtactattttgcaaacaggaaggacttattaataactttctgtgggttaaatctctgagtcatgctttgatgcttttatagtaggattatgtcatgtggcctgctttttctgcattatccttcagtttttcacaaaatcaggcataattcttcatgtatgagattattctgtcgttgggcacttgtactctgaaagctttatttttcttccttaaacgctttatacgtagaaaagtctctaaccaccctattccatctgattctatcccctcaaactctctctcttgacttctgcatgtttttcactctctctcttctaagcttttattttttgttttccaagggtggggtggagaatctcatttgttctcacaggttcactctcctttttaaatattgattccacatttccagctactcggaaggcagtagatgcctgcctgtttcccgaaactctacttctgtacaactaaattgttcattttctttcactccaaaactgactcatcctggtaatttctgtgtcccaattaattgcaccaaatgtttgggtttttttggccccaagacattatttatttccgtcatttttgatgcttctgctagagaccctaggttctttctgactagtagcttagctattagatcttttgcagaataaaacattctcccttccttggctggcccaatactgtccactgactggtctccatcctggcatattgggccacttgtagctacccagtggtcagtctggactcagcctagttctctaactggagcttcaactatctactatcaactagcccagtaggtaggtagaagttgacatactctaaccctgaatccatttagtcagaaatctagcagactcttatttcaggtaagagtctatgccattgtattggctgcctctgccattatcctagttcaggctaatacatttactgccctgttgttctttatactcctagcactgtatcacaattagtgccagtccttctgttttaaaggcttcctagaaaatctccttttagaaatttatcatcctttcactatatactatatcttgcataactatcacattttagttcacattctactgctgttctatacactactgaatttttatctatttagactttctatctctggtttgtatctctggtgtgtattttaagcttccaaagaatatgactgtggtctctaattttttgtatcccaacacatggcacagtgctaagtgtaaaacacataataaatatttgctgattttgcttactctacaatcttcagtgaaataatagcaataatgataaacagtatttattgagcactaactatgggccaggcagtgttctaaacacttcactatgtataatcccatttagtaacaaattagcacagtggttgtactttttattgtgtgggcgtgccataattggcaaggtaagttttttaatagaatgtcacttactttatttttaaaatacattgtgatgagttagccaaaggaagtaactgagaggatctcagaaaaatggaatcgttaatacacccttttgtttttctgccctattacccttttgttgttgttgttgttttgtttgtttttgtttttgttttatacagtcttgctctgtcacttaggcaggagtgcagtggcatgatctcagctcactgcaacctccaccttccaggttcaagcaattctcgtgcctcagcctcccgagtagctgggattacaggcatgtgctaccacgcccagctaatttttgtatttttagtagagatgggattttgccacgttggtgaggctggtctgattttcctggcctcaagggatttgcccgccttgacctcccaaagtcctggggttacagacgtgagccaccacacccagcccctattagctttttaagcatgattttagtatgtacaggatcaccacagtccatgttaaaattcttccactagtagtgatgctgttaagtagagagagatccttgtgctttgtttatgggtgatagaattttcagaagttttaggagttggacaggtatccagttgtcatggagaaagagttattctccttcctcatagatgtattcataagatgcataggtgctatgttgactcccattcgacagtggttaaaatgtaagtgttggagcagattctgagatctgctttgagaaaactttatggcattgatcagttaccatcctttgagtccattaagagtaattctgtctttatgaacttagaatcgatcctggttaccgatttctcttcagaaaccattactagaaccagagtatatagaatttatgcaacaacataaattttttattcagagagcttaaaatagaaccccctctcttttaagctattttgtgtgattttatgtattcattcaataatatttaaagcgtagatagtattgagccagggatgctggagtattgaagtgaaaagaataaatttcataacctcctggaatttatattccaagaagggagtaagataataaaaaatcaaacaagattacctagcatcttagctgaaatttcccacacatcccataaccaatccatcagcaaatactctttgctgtaccctcaaaacatacccagaaagtaactacttctcacaaccaccactgctgccaccttggcccaagacagctagatctttcacccggattctgcaataggctcccaaccggtgtcctcatttcctcctcctcccacagagtctgttaacacagcagccagagtgacccacttgcaatatggcctgccaggcctgcctctgctccagacctttcaagtctttacatttcatgcagagtagaagtcagaacccttaccatggctcagccctgctacctactaatgtcctctcctttgccctctcctccagccatgctggttccttgctgtttcttaaacactacagccaaatgcactccacctagagtgtttttcctgagaaatccacatagttcattccctctcctccttcaggtttcatttaaatgccaccttctcagcgaggccttctcctaccatcttactcaaattttcagctccctcaaaccagaccttctttatttttctccctagctctgtcaacatctaagcatgtagatattttacttatttgttgattatctgttggccccctgccccggaacataagctctggaagggaagggatttatgtctttttttcatttctgtagcttagtatctagaacagcttggcacgtaatcaatgtccagcaactgtttgtttaatgttaagtggagatgaatgcaggaggtattgcatattagttaaaacgttaccaaagtatcatgtaatacctgcccttatgatagttcagtcaaacaggtattaaattcttattagtaatcattttctcaggtgaacaagaatacagaaataatctattaggatagtccttaaattttcctatggatctatcctattatctatggataatctattaggatatgccttaaattttcctcttcatatattataaaactaatagttctacaatatgtcgacaagaaagttcaagagaatatttaaggactgtgtagcacacaaacagtactctacgcttgagcagacacagagcttccctttttcaagataataacaagtaagtttggagtattgattgtgtttaagttttgtttaagtgccttggaacatactaggcactcagtaaacatgtaattatttagtctttttctgaaaccaaaatttttatatgaagagtcaaattcctaactggtactttcggggattctataaaatcatgaaagagaatgtatgatggactgacatagctcttgaagaaaaatgtcaacttacaaatctataatttcattcatattgagttttgtagctaagttcaaagctaagatatatcataaagcaatattttagaaagaataagacaatataaaaagttttaacctttgaacaaactttggttaaattatatgtgaggggctttttttttttttcctagataatttcatcgggcttcctttgccttctaatcatagctttcttgctgtgcttctttttttttctctctcatctcagtgtgttgtcaactcagtgagtgacggcagtactaataagagtgtggtcaagagataaatggtcatttcaacctggtttagaatgttcatcccaaaaatgctgatagcaagttagtaataattagtaaataataatgctgtactcctggttagaattgggagtgaaactccccctgatttcatacttcacgttatttgattcagatggctgttggttttaacaagagactttcctctttagagactgtccaggaaaaaaaaaggggtcagaggaggctttagggaagtaatctttctaatccaaatatctaatggataaacttcggcatatctgttaccagtctcagcatctgcatctcctaaaattgtcacttagtgaatatagtgtacaaaagctcatgaggctgtcaggcaggttaacagctgagggacctaaatgcatcttagtgagaggaatatggatgttagcacataacagagcagctgtatcatgagtcaggctcaggactggaaagaataattgctgcttgctgcatggattaggtaagcagaagctgaagcctgaacataaaatgagtcattatgacaaagcagccattatttttttctccccaaattactttgcctttaagagtgaagataaaaaatcttaaaacctgaaaagtaaggggtcttgtaaacagatgacggtagaggctaagagtggcattggaagatcaggaccttcacatttggatgcccagctctttcttgctagtacagagaaggagctgtggtctttggaaggtgttccaattcatgccttttagcataatggctcattgtttgcttctagagtcagacaatccagagtttgaatgccaacttcatcacttatttgttgtgagacatcgggcaggttacttcactcctctgtatctcagacttctcataataaaataagtttaatggcagtgtctgcctcatagagtggctgcaaagacaatgcctataaatcacttgcgtcagcatgaagcaagagctgacgacatctcaccatgatgatgacggtgataaagatgaggatggcaggtcatatgattccacaaatactgacttagattcctggaattagagaagcctaaggcgtagcagagagaggtgggggatgtctgtgcctcctcatccattagggtggggctaagtaggacagccccaggtgaagagaatggctacattctttgaggagtgaaagtacttagggttaaggctgtaacagaaagattccaaggacaaccattgccctgtttagcaaaactccattattttagtgaaggctaacattcctttaggcctagccctgagatagtaagtcctttctttttctttttctttctttttttttttttttttttttagagacagagtcttgctctttcgcccaggccggagtgcagtggcgctatctcggctcactgcaagctccgcctcccaggttcacgccattctcctgcctcagcctcccgagtagctgggactacaggcgcccgccaccgcacccggctaattttttgtatttttagtagagacggggtttcaccgtgttagccaggatggtctcgatctcctgacctcgtgatccgccggcctcggcctcccaaagtgctgggattacaggcgtgagccaccgtgcccggcagtaagtcctttcttatttgaaaaatcattcagcctacatataagaaaagctcttgatctccacctatgtaactactattctagcacctcaaccccattagcccaccactgtgtgcagtgacagggtgaaatgggaaggaccctctgtgcaggagcaccgtgttgtggggatcctccaaggtcacacttcttatcaggcagctctccactgaatgcttttaatgacaagttgagaaggctttgagttgtcaccaaagcccagtgtgaatcactatgcttggagatcactctgtcctttaactctttagttcatttattcaagcatattttaaccatctgctagactagacattgtgtgtatagggaagaattcacaaacacataaaagcagagtagctaccgtctggagtgtaagtgctatgagggagtctgaatccagctagcagatggggctcctgtgctgtggtcatcaggaaaggctcctcagaggaaggagcttctgagctaggacttgaaagacagaagtttgccagggggaaggaggtgtgtgtgaagatgcatgatcctatggccagtccaaggggttggacagggaacagtaggagaactaacaggttttcaagcacgacaatgacttcaggtctgtttcttgaggaagatatctctgagacgactaatgtgtaggatggatttgaagtggttaaagactagaaatgaggcatgagaaaggaatgagagtttaaagtagtggtaaaaagattggagaggctacagcagattcaagcgatcattctgtgtttttctgtttttttacattagagacagggtttctttttttttttttaattatactttaagttcttgggtacatgtgcacaacgttcaagtttgttacatatgtatacatgtgccacgttggtgtgctgcacccattaactcatcatttacattaggtatatctcctaatgctatccctctcccctcctcccaccccacgacaggcccaggtgtgtgatgttccctatcctgtgtccaagtgttctcattgttcagttcccacctatgagtgagaacatgcggtgtttggttttctgtccttgcgatagtttgctcagaatgatggtttccagctttatccatgtccctacaaaggacaagaactcatccttttttatggctgcatagtattccatagtgtatatgtgccacattttcttaatcgagtctatcattgatggacatttgggttggttccaagtctttgctattgtgaatagtgcctcaataaacatgtcacccaggatggagtgcagtggtgcaatcatagctcactgcatcctcaaactcttgggctgaagggacccttctgcctcagcctcccaagtacctgggactacaggcatgtgccaacaagtccagataatttttctttcttttttgtggagatgggggtcttgctatgttgcccatgctagtctcaaactcctgagctcaagcagtcttcccaccttggcctcccaaagtgttaggattacaggtgtgagccactgcacccagctgagagatcattctgatacaacaattgatgggaccaattatatggatgtgttgagttagggtgcaccatgcatgagggaaacattgtggaagacttgaagtgactaactttatagaccatttggtctcaggaatctgctatcagaatacggaagacaaagaaagttccagtttggagcagggaagaatgtgcagataatgaataagattatatgatggatctgactgagaaattcaggtggaaattagaagcatgcagaagtgaatatagaggcaatattgtagagtgactgagtacaagctttcgagtcagagctgaatgaaaatcccagctgttttcttttagaccatgtgctgatcttggaagcatcatttcacttctttgggtctttttcctcatttgatcttcagttctattttttctggtagcaatagtcccacagttattacatttttgttttcatttgcctgatagccatttgctcattattttagtgttatttgacgctttgttttagttttgtttcttttaaacaacatagctaggtgtttttgtttttaacccattctaaaagtcttaataggcttgattttagtccatctggctttttttaaaaaatgttgtttcccccaactcttttttttttttttttgagacagagtctcgccctgttgcccaggctggagtgcagtagcgcaatcttggctcactgcaacctccgcctcccaggttcaagtgattctcctgcctcagcctccctagtagttgggactacaggcgcccaccaccacgcctggctaattttttgtattttcagtagagacagggtttcactgtgttagccaggatggtctcgatctcctgacctcgtgatctgcccgcctcagcctcccaaagtgctgggattacaggcgtgagccaccacacccagcctattttcccctttttttaaaaaagaaaaaaaaacttttttgtaggaggggcagggctggtggtgtagaggtaggggttggtttgatgtaagtaccattcattccatggttatctttaataatttgaaaggtgtgctaaacttttccattctattaatgattacattttcattcctgtttcttgactattaaatgaaactaattagtatttcccacacaaatgctctaagacctacaaaatatttttacttttccatctttagatgttcttattattttattctacaactcccttctaaaattgatgagcataggttaagccattagattcctttttaaaaagaattattattcagcacatatatcagtcagcatataatatgaaaatgacatgtatttgaatataagtaatcacaacaattattgagataaagcataaaggttaaaattttaacattcaaaatgaaaacaaaaggaaactggaccaggcacagtggctcatgcctataatcccagcactttgggaggccaaggcaggaggatcgcttgagcccaggagtttgaggccagcctggacaacacagcaagactctgtctctacaaggaataataataaaaaaaaaaacgagccagacatggtggcatgtgcctgtagtctcagctactcaggagctgaggccagaggatcacttgagactgggaggtcgaggatgcagtgagccattactatcccattgtacttcagcctgagttacagagcaaaaccctgtctcaccaaaaaagaaaaagaaaaggaatctaattgtaatcccacacatgtcctcaaaggtaaaaacaaaaaaatcaagtcatgggagttagttggaagagatcttggagatcattttgtatactctttctaatgtagaagtagaagagtttggctagttttcccaagatcacacagaattagtagcagactcaagacccaaactcagatgttctcatcacttttcactttctgactcttcattatattactggctactctggtagccagtgttacccaaaatccttctatatcttagtatgaaactgagacaacaagtctgaatatttcagaggttaagtgatgatatttctctagtctctgaatgtcaccttttcttttctctcatacagcagtaaaatatatgctcccctgatacagaagtaagcctgttcagagggaccaggctggactctagattgctgaatgtgatgacaggggcatgtggagtgttgcacacaacccatgagtgcactgagttcactgttctacctgagtttcttcctgttagctgcatgctgtgtgtattagtccattttcccactgctggtaaagacatacctgagactgggaagaaaaagaggtttaattggacttaaagttccacgtggctgaggagacctcagaatcgtagcaggaggcaaagggcaattcctacatggtggtggcaagagcaaatgaggaagatgaaaaagtggaaactcctgataaaaccttcagatctcttgagacttattcactaccacaaaaacaatatgggggaaactactcccacaattcaaattatgtcccacggggtccctcccacaacatgtgggaattatgggagtacaattcaagatgagatttgggtgggaacacagagccaaaccatatcactctacgtggcaataggacaggaattattgattatcgtaaaggctgtcattatctgcatttattgaatccctgcaatgtacatggcactatgctaagtgcttcatatgttactgtgagccacaaagcagccctgtcaggaagttggtgccatagtaacttgggggaacaaggccacagaagtcattacttgttcagtggcacatagcttgtaagtggcaagactgggggtgggcccaagttcatatgaagccagaaactgtcctctatccaccacagtaccctgcttttcatttttaattcctttttgtacagcatcactgtgtatttctacatggagtctagattgatagtggatttctcctttgtatggtactgatatattgttacagtgtcattaaaatatcttggtgtcagcaggtcagggatgggactgactcgttagtgtccagtatttcacaggctacagtggattttcacttcattttataatgtgatcccataggccagggataaattgtgacttcagaagagtaaaggttaatattaatcacagttcattttttggacatactgttcttttacagagctgcctctttatgaaattaagtggttgttaatgatttaaatactgaatgagttgtattcatctactagggatgccataacaaaataccatagactgggtagcttaaacaacagaaatttattttctcacagctctggaggccgtgcagtccaagatcaagttcagcttctgttgagggctctcttcctggcttccagtgggccactttgtcctcacatggtatttcctctgaatctgttaggttagggtgccatctttatgacctcatttagtcttaattacctcctaaaggtcctattttcaaatgtatttaccttgggggttagggcttcagcatatgaacttggtgggggtgggggcaaggtgggcggggaacaattcagtcaataacagttgctgaattttttcgtgtattcaaaattatcatttcttaatgagaaaatacataacctcaacattatccatagggaatattttaacctattctgaaattcttaaacctaataggcttgattttacaccttctagcttattttttaaactttgtttttttccctttaaaaaaaaactttttgtggaagggccgggtattaaagtattaaatctcttataataaattaactttttatttttattaaaatattgaaatactttgttatccttccatttaaaatattgcatgacctatatttagcaataagtttgcactcactagcatgctctgcaattggcaagtgttgtttaatttgcctatttgctgtgtgactgtttaaagaaggcactgcattaggatctgcacttcctggtagaaagtagtagtggaattcaataacagttggatagacaaagaaatattcttcctttaaaagattatttggggtaaaactaattattgttgcaataatgtctagctctactgtgatttatagcacaaccttaagaactacctttaattttctaaactgaaattataatgattatgacgacaaaaacaacaatagctaatatttactgaatgtttactacattgcagaaaagtattctaaccatattatgtgtaattattttgttaatctttatggtaaatttatgagaaagatcctctttttacccacaccttgacctgacaaaactgaggaatagggaggttaagcaatttacccaggaccaaacagttatgggtgaatgaatcaggaagtagttcccaatgaattataaaataattattaagacccttggatatgttcaagttctgaaaggcactatggagagcacacacaaaaagattctagccagagcaattaggcaagagaaagaaataaagaccatctaaattggaaaggaggaagtaaaattgtccctgcttgcagacaacatggtcttatatataaaaacccctaaaagcttcgccaaaaatctctaagtatggataaattaattcagtaaaattgcaaggtacaaaattaacataaaaaatcagtgtttctgtaactcagtgacaaaccagtggaaaaagaaatcaagaaagcaatcccatttacggtagctataaaaataaaataaaatacttaggaataaatgtaacgaaggaggtaaaagtttgctacaaggaaaactgaaaacactgatgaaaaaaattgaaaagctcacaaaaaagtgcaagacatctcatgttcatgaattggaacaattaatattgtgaaaatgaccatacttaaagtgatctacagattcaatgcaattcctaccaaaataccaatgacattcttcacaaaaacagaaaaaaaaaatctttatgtggaaccacagaagaccccaaatagtcaaagcaatcctgagcaaaaagaacaaagctggaggcatcgtacgacctgacttcaaaatattaagctctggttacacaactatagtaaccaaaacagcatagtactgccataaaaacagacacatagaccaatggaacagaatagagaactcggaaataaatgcatgtatttacagccaactgattttcaacaaaggtaccaagaacattcggtggggaaaggacagtctcttcaataaatggtgctgggaaaactggataatccatatgcagaaaaatgatactagacccctatctctcaccatatgcaaaaatcaactcaaaatggattaaagactacaatgtaacctgaaactatgaaactactagaagaaagcattggggaaatgcttcaggacattggtctgaacaaagagttttggggtaagacctcaaaagcaaagacaacgaaagcaaaaatagacaaataggattacatgaagccaaaaaccttctgcacagcaaaggaaacaacagaagagacagtgaatagaatgggagaaaatatatgcaaactatttattcgacaaagcattaacaaccagaatatgtaaggaactcaatagtgcaaaaaaaaaaaaaaaaaaaaatccaaattaaaaatgggcaaatgatctgaatagcatttctcaaaagaagacatagaaataaccaacaggcatctgcaaaaagctcaacatcactaattatcagggaaatgcaaatcaaaatcacaatgagacatagcaccccagttagaatggctattatcaaaaagacaaaaaatagcaggtactgatgaagacgcagagaaaggggaacaccagtacactgctataggaatgtaaattagtgtagccgctatggaagacagtatggaagctcctcaaaaaactaaaaatagaactgcaggatgacccagcaatcccactactggatatatagcccaaagaaaggaaatcagaatatccaacagactattcacgatagccaagatatagaagtaacctaagtgtccatcagtggatgaatggataaggaaaatgtgatatatatatatatatatatatatatatatatatatatatgatggaatattattcaaccataaaaaagaatgaaacactgtcatctacaacaacatggataaaactgcaggtcactgtcttagaagtaagacaggcacagaaagacaaatattgcatgttctcactcatatatgggaactaaagaaaagtgatctcatggaggtagtgagtcgagtggtgcttgccaggggctgggaacagaaaggtgggggggaggttaaagaggtttgttaatggttacaaaatacagctagatagaaggaataaattctagtattcaatagcacaataggatgactgttaacaataatttattacatatatgatatatctataagagaagatttgaaatgttcccaacacaaagaagtaataaatgtctgaggtgataggtatcctagataccctgatttgattactacatactgtatgcatatatcaaaatatcatatgtaccctataaatagcacagttattctacgtcaataaaaaacataaaaaaaaattaaacctatcaataggtaactggttataaaaaataatgtgcatagacagtgaaataccatacagccactaaaaagctttaaaaagaggctcaataaaaatcagtcacctgcaggtggaaaggttttctttaaaaaaatttcctggccgggcgcggtggctcacgcctgtaatcctagcactttcagaggccgaggtgggtggatcacgaggtcaggagatcgagaccatcttggctaacacggtgaaaccccgtctctattaaaaataccaaaaattagctgggtatggtggcacgcgcctgtagtcccagccactcgggaggctgaggcaggagaatcgtttgaacctgggaggcggaggttgcagtgagccaagattgcactaccggactctagcctgggcaacagagtgagactctgtctcaaaaaaaaaaaaaaaaaaaaaaatacctttgctgcagagatatcagaacataagaaatgctaggccaggcgttggggctcaggcctgtaatcccagcactcagggggctgagacaggagcatctcttgaagctaggagtttgagaccagcctggtcaatgtagtgagaccctatctctaaaaaaaaaaaaaaaaaaaaaaaaattttgctgaatgtggtagcatgtacctgtagtccctttaggaggctgaggcaggaggattgcttgagttcaggagtttgaggttgcaatgagctgtgatgacaccactgcactccagccgaggtgacagagcaagaccctggctctaaaataaatagatagatacatagatagaagaaaagaaatgctaaagtttgtggttgatgtcacaagatcagcagtgagctctggaagagatggcacttctgtggaagaccttagagtacagcgtttctccaaatgccatccatgggtcacttgtctcaactacctgtgagatttatccaaaatcaagttaccgggcctcatcctagaattagcacctctaaatacgagaggtggagctctggaatctgcgtttgaactagacattttccccttccccccacacagttccaacagtaattctgacatattacaattatgagtatgccttctcaaaacatggatctgcttggataaaaaatgatgacagctttcccaacaggacaataacaaaggcaaagatctgggagaagcatggtttgatgggaggtgcattaaggagatgggatctaattagaatgcagaggctattttggagagcagtggggaggaaggccaaataaggatattaaagccaaaataggactgtacaaatcagaggagtttaaatttagtgaagaaatagagccacgtattaataagtcagaaagcctgatgaaaacattatttaagaaaaattgatttgtgaattaactcttattttacaaatttatcttaccagctttcaaatatattcttaatattttataaacatctttatttcttattttctcttgttggcttctggatctcttataggagaggaaaatattatgttcataaatgtcctcagagaatttgaaattttcctcaaaatggggtataaaactcaaagactatgtagtttgaaggctaaaagttaaaaagtagatttatcatactgcatatctcaaggtacacatctgattcttctgcctatgaccatcatacactgttggtgggtatataaattggtatgacctccacagaggacagtatgacaatatctatcaaaattttaaatgtatgttccctttgattcagctattctacatggacatgctcacacatctacatagggatttatgacagcacattgttactgctcagggtctgaattcttaaaatactggaaataacttagataacctatcactcagtaggtaactggttatataaaataaggtatagtatatagacaataaaatactatatagccattaaaaagactcttagattcatgtttcatgtgttgatatagaaaagtctctaagatacattttaagtaaaaaaaaaaaaaaaaaaaaagcaagatgcaggctgggtgcggtggctcctgcctgtaatcccagaacttcgggaggccaagacaggtggatcccttgagctgaggaggtcaagaccagcctgggcaatatggcaaaaccttatctctactaaaaatacaaaaaattagccgggcatagtggtgcacgcctgtagtcccagctacccaggtggctgagatgggaggatcacctgagcctgggaggtcaaagctgcagtgagccctgattgtgccactacactccagcctgggcaacagagtgagaccctgcctcaaaaagagcaagatgcagagcagtaagtgtactttggtacaaggtgcatggtgtacgttgtcaaaaagttggaggtggaatataacagaatctcaggttagaggaagacagttgttttaccgtttattattttgtgttgtttaagctttgacaaaagctatcactgtcaaaatttatccacctttttaagtgatttaaaatgtttaatgtcattaaaagccttccagtaaggtattcccatgtagaaaatccaaaagatattatgtgcacgagtgtgcgtgagcaaagtaagtgcatcttaagaaagtatcagaattatgttctacttctcttaacttttaaagtgtgttctcacagtggtatttattttttcagtcattcagtaaatacttattgtgtatactatatgctttttttttttttgaataatagtttttattttttattttttgagagattatatgatttaatgcatataaagcattttaaacagtgcctgacatgtggtttggttgttgttgttgttgttgttgttgttgttgttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcagtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttgtttattgcggcactattcacaatagcaaagacttggaaccaacccaaatgtccaacaatgatactatatgctttttattgaagtgaatttttaacttgagcttgagaatttccttagaacaatgagctttgaaaattggtaggaaccttgaagaccagtgtcctcattttaagcaaaagaaagctaaaatccaaatgaacatgtctgagatctcagcaccagttagtagcctagctgctaggagaaccagtcccagttcactccacaaaccaccctgaatgatgccaggagaacaaactcaccttgaatttgtccttctccttttcttcacctaaaataaagtcagttccgatcactttcagtagatttagtcctcaaatgactaactttggaaagatttaatggtatcagaaatgcattctttaatattaaacatttagaggaaaccaaaatatttctaaatttatgttttttcttttatttgtttgtttgtttgtttgtttttgagacagagtctcactctgtcgtccaaggctggagtgcagtggcacaatcttggcttgctgcaacatccgcctcccaggttcaagtgattcttgcacctcagcctcccgagtagctgggactacaggcacgtgccaccacaccttcctaatttttatatttttagtagagatgttgtttcactatgttggccagactggtctcaaactcctgactgccagtgatctgcccccctcagcctcccaaagtgctgggattacaggcatgagccactgcacctggcctgttttttcttttaaaaagtaacattttaatttgtatgccatgtagtgtcctcaagatttactctttgaatgttgtttgaattttttccttttgcctacagtattaataactcatagatatttttagttattaccgctgaaggaagcagcatattgaaatagctttgagggggcatatcttttcctaaaatgaggaaagaacctgtattatataaagaagaaaaaatgcatcctattgttgaacgataattttggattgtatttttcatccagcttttgatatggttaactcttatctaactaaattgtgagctcctcagacacaaggccacctgcttgttcggtccttcccatccctgagctgactcaatgtgatagacctgtaaggcacttcagacatctttcatcaactaattattttctcccaaatccttttaatactcagaaccaatgccatgttggaaaaaatgtagtcatagactggaggatatcacattgttttataataaaaaaaagagacagatggtactattgattttcaggattgagactagagcatgtggttaataatgccttattctacctacaaactagagggctgcttgcgttcccaaagagtggaattcagtacattttcaacctcattgctaacatattaaattatgctaaaaattaacagtaatacatttttcttggaaatttgagggaagcaaaggccatgcttggttaatacaaaactaaagaacccatatttgttcattgtagaccacttaatacagccctaactattcaagtttgcaacctgcctatatttgatttccctctttttttttttttttaaccctccccaaagctgcaagagaaatagtgtggttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagtgagccgccccccgggaagaatatgagtggctcctctagttcagacatgcagcaaactttctgtgaaactttgcagtcaggtgcagggtgcaaagcaaaatggtttcagagtgatcagctttacagatggctacagtttctagggagttcagggtatgagaggtagcgaatgggctgatgattattattgccacagaaagtttaaaagcccatttctctggtccaaacctataacttattgaagtgcaattcatctgtactgagtattaagaccactccaagtaattgagtttctgtagtctttaccatttgcaaacatttacacatagattatctcatttaacccttactcaatcctttagcatgcattatatgtcagtttgtataaaaatagaaatttagactcagagtgggtaaggtacacaaggtcatacaactcaataagtcatggggtcagggttacccatgttctcagattctgaactgttttttaaatatggtatcgtatggtaaatatggtatcgtataagcatcagttgaagctaagatctgcactaccatgcttacgtgtgttcatgaaagcatcacgcacaccctagtagtaagggtcgtttatttgaatgcctgttgttcgccaagggctttatgaactgggacctaatgactaaagtgaccctcccagattgacactagtctcaccttatggtatagaagttcagctagagatcaagaatagtagagtgggaattgaagtagtactcctcactccattctgccttaaattgaagaagcttcaaacaaccagctggaatctaatcctcagctcttctattccatctaaggaacgccacgaagctgttgtacggcgcacaatggaaaggagccagaagccaaaacagaagcataaccgttggtcgtggggaggctctctccatgggagccctagcatccacagtgcaggtaaacagtgaccactttgaaaattagtctttattttcctgaaagtaacagggtgtttccttctttcttctaaatctatgtttgcgaaacaaaaatcctgctgaaataattaaacaacaatgaaatgaatctttcactatttgaggataagagggtgatggagataagaagtaagggcctctttcccttaacacaggccaattttctcatgttacaaaattccttaaagggagaaatctatgtagtgtttctaaataaacatgctagcttcaacactacattattttagtcttctatttgcattagggtttcaggattatggaataagttaactagttttatctttttctctggaaggattatagttatattgactgaccagaatcaatactatgagcttatgtattctgaccctaaagtatatgcaacactaatgctctgtaagaaaatatataggtttattgagctagaaatagtaaatgactaagctatttcctcctttctgaatggacataaaatcatattgaaatttggatttactgaaaggctttatttttgtactgtaaattcaatacccctggaattttacatagtgtgtcagtttttatttttttatttgtgtgaatctgataaccttttttttttaaatttgctttgaaaaatcattgttttacattctgtctccaggtggttttgttgaatcatcattctcctctctggatttagcaggcctggaccaccacttcataacttttggtggtactagaaaagctggtacagacatccctgtgattgccaattgcctgacctgtagctagcacctcagacctagggccgatgcatcaatagctgaagcatcaccaccttagtcatcaacgcatgcctaataccctagcgcatagacgtagatctgggattggaacagtgtttcttaagtgtgataatatgactcaggtgacttaaaggtgttgaaataaagtaattacatgtggaatgtttgctttccctttaaacaatcattttggttttctatttatgttttttatttcttttttcaatgtcaggattaaacctttaaaaaatgttttttagctaaaaaaattacctgggatcaaagtacttccagtttagcttttttccccgtcaatcattactgctgttgccacttttagttttaagctaaataactgtggacctctttttgtttgcttattctgttctctttcattgttaacattctatagatctcttataactgctttattaaaattaaaaatctaggatcaggtgcagtacctcacgcctgtaatcctagtgctttgggaggccaaggcaggaggatcccttgaggccaggagttcaagaccagcctgggcaacatagaccccatctctacaaaaaattcttttaaaaaattagacaggcatggtggcatgttcctataatcccacctacttaggaggctgaggcaggaggatcacttgaggccaggaatttgaggatacagtgagctaagagtctgcctttgcactccagcctagaggacagagtgagaacctgattcagaaatgtaatttaaaaaattaaaaatttgtttaagtccaaggaatatcaccacaacttactttcttatgacagtgaaccaaatatgaaagcacttctgttttcttggttgttcatgacccagcagtagctggtgggatacatattaaatctgttatacagatcatttacatatgagattttgttgatgggatattttttatatacctttcatacagtaaacctggcagggtatatatttttataatcatatatttgttttacctgacttcctgctttacatgtatatggcagatatacactgttagatcatcagacatttttgaggagatggtaagctgcctagcttaattttttgcctccacactcaaagcttaatatatgacatttatttctgccactcagaacaagagaaaccagtgttgcattcgcaagctgttgggtaaaattcattttaatacgggttgtgaattataataaattgttcctatactggaacagagaagtttgccagaaaataaatgggatttgccaagttctcaaagaccagaaaatgatttgctatgatcttgagaacagcaaccaggtcttattcattttgaataccctttacttgacaacaatacctgatgtatgatgggtactctatcatggtttgctgaccaacaaacacatcatagaaactgtctacattaaaattcctgtcttggccagctgctggccatcgactagcactggtctgtaaaacttgatacgatcagcagggtgcggtggctcacacctgtaatcccagcactttgggaggctgaggcgggtggattacctgaggtcaggagttcgagaccagcctggtcaacatggagaaatcatatctctactaaaaatacaaaaactagccggctatggtggcacatgcctgtaatcccagctattcaggaggttgaggcaggagaattgcttgagcccaggagatggaggttgcagtgagctgagattgtgccactgcactccagcctggctggcagaatgagactctgtctcaaaaataaaacaaaaacttgatacattaaaaacttattcttttgtgtgttttgttcggtgagaaaaagaaatgaataacaactgtcttatatattaagtaataaacaaattcatggtgtgcctccataattttaacaatttatggcagatttagatgctttactactaatgatactttttaggatacaaggatccactgtaactcattttttccacttactctgaagcagaattaaatgtttttaataacctgttgagaatctgcctgaggataggcctgcgtgtggacacaattttcccccaactaaagcataacatataaagcaatatcagaaaatgtactgctataaaatcacctggaaatgactttcgtattcctcttcctaccctgtacctcacatgtcatcactaggatgttccttttgatgtttgaccctaaatcctttctttatgtttggattgccctaagagtccatcagctaagtataaatttgaggcacagaagtggtttttttttaataataaaattgcttcagccattaaaatgaatcccagctgaagatagaaatgactgatgttaatcaaagacttgcttattaccagtgtgctataaatggtagtcaaaaatacacagggaaaagtttgcagcaattttttcttactgccaaggttagaccaacgggtactgagttttggaagcatctcccacaaggagtatttttgttttagttttagaagcaggtaacaacagaaaaataaaacaaaatacagcaaaaacccctttcactttggctactgtagatcagaacatccacctgcctcctggataaattaggaataagactttttagactttcattacatgcagtgttatttgaggaacaccgtttatcctaatgagcatgattataacctgggtctactataccaacagcaggctgctaattcttgccttttgtatgcttatttcccttctgatttgaacttaagaattctaaaattatgccaggcacagtggctcatgcctgtaatcccaacactttgggaagtcaaggtggagtatcacttgaggccaggaatttgagaccagcctgggcaacgtaatgagaaccccacctctacaaaaaaattaaaatattagctgggcgtagtgatgcctgcctagagtcttagctacttgggaggctgaggtgggaggatcacttgagcccaggagatcgaggctgcagtgagctatgatcatgccagcctggccaacagagcaataccctgtctccccaaaaaaaaaaaaaagaaattttaaaattacttgactataggatgaacaatgctattgttcatgaatgtgtgtgctaattctacatttgtagccacactaactcataagcacagagctgtggctcttagatttttaataaaggaacgtttcttaaaaatcctttccacacttagaatgtttcttttactttttctttttttttatttaaacaacaacaacaacaacgagccttcttctataatgaactttaatgccctgggtaaaatgactctgtaagcaaagttatcagcaattacacagaacctggtgttctttttatcccagtgtttgcgttctatgttaccagcatgttaccactccattgttccttcttttggagatttcaaaggcattcgcttttatggtcctcttttgcttcatagtgtgcctccactattttagaagcccttcactggccttccttttgtcttcatccacttgtatccttgaatttccatggctgacaagctggtgaaataaatatttattttatcctttaagagaaatgaattttatttctaagcctttaagttacctttaaaatgtccacttagaaaactgtgttattatgacagatctagaaatagagcagaaagcatccaatcctagtttttccttccatcagtgaactaggaaattgcaatcctacatgttggctgtcaattagcattatctccatttgttttagatccagacaggcggtcagtttccaccatgaatctttcgaaatatgttgatcccgtcattagcaagcggctctcctcttcatctgcaactttactaaattctccagatagaggtacagtccaaaggaaaacaaaaaagtgtctgttatttacttaatgcttttttttctggatgtttacagataaaaataagcatctgaagttgctttccctacgtttcttaaataggaagaaaaaaacttcagagtaaaaaagcaataaacggctgagcagcattttccttgcgacaagaacatttctcattttagaacttggctgagtgattgcatttagcagtgacgaaagcggtgcttctctcaactttttagtaaatgagtttacagctccagaaatcacccacttatccaccaaaatgcaaataatctttgttatgaacatttcttttacttcaatcatactgtctttggcttttcatctatctgtactttgggaattccaggctctgactttctttaaaaactttttaaatgattcagattggtagattttattttgccaatttacttctcatttaaccaaattatttcttactgcatttcttatgtgtgctgttggttttttggtgtccattcattaactcttgagggatctggcctaacttcaagaaatcatcataattacagcctcctgaaacatttaatattcatagtcctttattaacatcttgtttgaattttgagttttattcatcccatggatttacagtacatgaatgttgagttatttataaagcaaaagttttgttttacatagatcatagaatgaaaaaaatcaagcttttaagataagctgcttgtttttacataactaagatgattttaaataaaaccaaagaattgttgtgcaatatgaagcccatactctttaaaagtaaaaaattgtggttactttgagtgctttattaagaaactgattgggaaagtttcagtgtttataatctttaaaaaatgtaatgtgtgcatgttctgtatgtgtgtatgtatatttatatattttgtattgtataaaagttatggtgtcattgtaatgtacaatattctgtgactgttggtgttattttataactaatctcttaaaatagtaaatgtttgaacaactttccattcttgtcttttagccaaaactctttccttttgtttttttaacctaatttgcctaaaccatcaatattagacttgtagtcaaattaggggcctttcataaatattgtgaatttaaatttctttcatattctttattttcaaacctattccctaaatataagacaaaatatagcatgtgaatgttactcttacagttgtctattcatcttttctttgcagttggtcacttagcactttagtttcatacttttgtgaacctggatctgagacaaactacaattagtattttacacttctttaaaactttattatcttctacaatcccatagctgaaattagggtaagggtgggagtagggagctagacaacaaacttggcaatatcctgtccatgctgtggaatgacattgaattgtctgtatcaattagaaagatgtattctagactctctgcacaatagaccttcttaaggcagtagaatcttggaactgaaaaagatctactggatagatcacctactctagttggggtgatagagtccctaagaggttgcgagcctctctttaatgtcctacaggctaattattgcagaagggtgactcctcacccgtgtgaccgccacactgcatcctcagttctcaccttcatgggtgtcctttcttagattgactctgactccatgcattctctctctctctctctctgtgtgtgtgtgtgtgtgtgtgtgtgtgtgtgtgtgtgtgtgtgtgtgtgtgtaaggttagaagtggtaaggagtagagaattaggacataggacatcagcgttaagggaagttcaataaccagttcatagagggggccagaaaactgccctatgaatcatggtagaggcccagaaaatagaatactaagcagaaataataggacaagagggagaacgctagatttgagagttctgcttctctgcctccttaccaaagaactgtcaatcagttcctggtctagcaggccaggtcagcctgaaggggctcccatatattgtctaggaaggaatttttttctttttaacttaagcaaagccctcagtagaaccctgaaaggcttaggccttttattatagtgagaattttaaaacttcttctgaatttaaatttctctaatttagaaatttaaggccaggcacagtggctcacacctgtatttccagcactttgggaggccaaagtgggtgaatcatttgagccccaggaatttgagaccagcctgggcaccatcgcgaaaccccatctctactaaaaatacaaaaattagccaagcgtgatggtgtgcacctgtagtcctagttactcgggggctgaggcagggggatcacctaagccttgggaggtcaagactgtggtgagctatgattgtaccactgtactccagcctgggcaatagagtgagatcgtatctcaaaaagaaaataattaaaaataaataaaagaaatttaagtaattccattagttctttcctgctatttttaaaagttagttatactttattatctcattagaaagcattcttaccagattgttaaattagaggaccttatagacaaatgggtcaagcaggtatatacatcattattagattgtttgagctttctcagtcctaaggcataggccttaaagctgagattaaattgaggctccgataccatcagggctcatgttctgctgtaatatatccaaagagctctactagttattaaaaatactgaaatatttccatatcacttttccaagatgtgcttccccgggccctccaaagccaagggaagccagtcattagtgtagtgtctgtgccttgtcagtttttaaatattttaattattacacctgaatatggtgttacatggactgataagattactttggttaaaagaaacctctgattatgaaaggtttctgtaattgctggaacagaatgttgccactggaaatttttacattaaaagtatatattattatctttaagctatctgcttaaccaactttttctcaagaaagaatattaggaagttggaaaagagtaagaaaaattgcctactttttgcttaaaatccatcaatacattttttccccagaatcttcatcataggactcagaggtagacctcgaaataaattctgctcacaggcttgttctgttttacctgagcagtgttgtttgttcttgttttaattagaattaattgccaacacttaaaatatagaatacttcatgtaacatttcagttttctacttctaaagaaaaaatcaggacctggcaacatgtgtctaatttcttcctggcacctattacctgaaatggaatagtgatgtcacgcttatgggaggaagtggtaaggcaggtatccataaagtttgtttagccccgatcatttatttatgttaacttgcatggcccccagaggcctttgagtttgcctctcttcatctgggtggcctataatggaaattgtcaatatctcaattttaagtgcttaaataggatcgatgccatagcgttgttccatgagagttaatatctctcccttcggtttggtaatcttaaaatcaggcccctctaggggaaaaaaacaaactaacaaaacaaaaaacaacaacaacaacaatgcaccaattctcctttattaacctttactaaaaagttatcttacggacgctctgtctccatcttggtcaaggcatagttatgaatgtggtggaagtggaaacatgtttctcctagcaatatgtttagttcagagtatcaggagatatgaaacagatctctctggatttgctttaccacaggttacaatgggtttttaatcatttgagataaattttttggtcgatgccttcagactcatggaaataaagtaactgaacttcttaatggagaaaggagacttatcttttccatgacaacccatctctgcagttgtaagccacagtcatcgtacagtttttctaagaaaaggaagagtttaactttcttccctttctcatctcttgaaaatagttctgtggaagattttcagttagtcctaatcaccttttccccactgattttaccctgtacatgtattctaattttagattgtattctattctgttgttacactgctgcacatagcttatgatagtacttagcccgtggtgctttctaattgtaactattgcagtagtttttataacatctttttaattaatcttaatgtcagataatatttaatttaaccatgaagactcttctagtaaacagactctaacaaacaattcactaattcttaaattcaccagagcctgatcaaaatatttactcttttaaattagtcacatagttaaggtacttattggaaattgatacttcattccaaatggaagcaactatttttaagacaatgtttagcagtatatggcttttattaattaaaactaatttcctagcatttaaatgccattcacttaaaatatgatatatttaagatagttatatagaacactgctccagaggcaaaggagactttgccacctgctgtttgtggagtggaacagaagcagccttttcaggtgtagacagttttaaagacttttaatccagtcacagtggcatgcacctgtaaacccagctacttgggaggctgaggaaggattgcttgagcccaggagttcaaaatcagcctgagcaacatggcaagatccctgtcttaaacaaaaacacaaacaaaacttttaaaagtgacaggaatgtgttctaaaacaaagatatgtaatcacttcagtgatatttgtagaattttgcaagctttactgatatttttggaaaatagcttctatcttttcatgagccatcactggaaactaaccatataagcaaagtaattaatttataattggcatacatgtcctgactatggccttgctaagctccaatataatttgggaccatacatcattgcgttattttaaatttgttttctagacttcttaggcatccactagcaatctctaggattatgtttatattggattttggcttttctgtttaattttatcttgcttcagccttagccttgtccttggccaaattttttatattgttgccaaaaagggacctgaaagaacttggcttgccaagtgaaaaggtcaaaaggattcccatacagaactttgcacgaatcttctttcattttattatatctaattcccacacacatactcccattgcccaagtagcaattcatggagatctagcataatttattgggtcccctttctgtcttttatttaactcgtctttcattaacctgccagtgcctctattggggtttattattcaaggtacttaggaagccttttgactaaggtatgtgccatcagtctactgcccatcccaatgcccatcagacagtaccactctggagttatagatatacaccaaaacaatagctgaaatggtattttttgtttattgctagttgactagtaaaagagggtggttagcaaaatttgcatctgtaaaactaatttagagcttgctacaaacttaacatcttgaagaaaagcaacctggtggaataactgctccctctggacaggggtcctgttgccctgactcttggccaaccatcctccctgcagagcctggtcctgtgaaggcccagcgtatggaagcaataggtacgatgtattatgccctcttgactctgaaaagaatgcttctaacatcttgcttatgtggtgacgtttagctcgccgcctgcagctcagcccatgggagagcagcgttgttaacagactcctgacgcccacacattcgttcctggccagaagtaaaagcacagctgccttgtctggagaagcaggtaaaactgtccaggtggaactttccccatgaggtcaagtcctccctttgaagcatattcgtctaatcacatctcactttttcctaaaatgcgcttctctcttcccccggtggaaatgtctgtcggtgttggtttcatacccctgtcattgtttcctctgggcatctgccttagcatcttatctggacaccagactccaggcaggctgatgaagcctctccccgggctccgatggcttcagaggcttctgtctgttcataacattacccgaagaaagtattccttccctgcctttccttctgcctctgtctctgagcagataatccaaggtagaaataatttaacatttaatgctaatatatggacttgggaataaaatcaaagcacaagtctgttatttcagcatatagtttcataatgtggctgtggcatagctactacttctccctgtgccattcttttatatgtaatctaggaattgtacccttccagaactctcagagttgtggagtaggctaattgtaatatgcttatttgttacattctttgaaattatatgaaacatgcttagtaccagttatgatgattggttataactcctacttttttgaaatgcaaaacatacctgaattagccagttaatttaatgagaagttagtgtggagcctacatctagtcggtaagcctacatctagtcggtaagcctacatccagttggtaagaaaggctttgggtaacggatctctcctggtgagttgatttaggttttcccaaatatctttggggacaattggtgtatttatataaacagtctactagccctcatctttggcactttaaaagtgctttgcccttgcaagcctctccatgttcattagcctgcttttaagtaataattgttggtggttttatggtgtctttcatctgcagtgcccaatgagcgaataaatctcagtcctaaatctcatagtacccctgggagacagtcacgaaggcaagcgtgggcattcccacaaccttcttatgaaaaccaagtgcagcgacaataagtgacttacaccaaagccacttagaaaatgggcagacaggatcataaatgtgctttcccctccatcctcaatgccctgaatgatgctttatgtgcaaatgtgcagtcaactagctgaaccacagtgttctgtgttctctgtaaagtcacactcctgtcagagccatcacattgcatctgaggttttcctggaggaggagaaagtacagcttatttcaatattttttcttatgcctatgaatttcacacttttctacaagtcatgagtttttctttagctaattgaaaagcttttaaaccacttttcaggccgggcgtggtggctcacgcctgtaatcccagcactttgggaggccgaggtgggcagatcgttgaggtcaggaaatcgagaccatcctggctaacacggtgaaaccccgtctctactaaaaatacaaaaaattagccgggcgtggtggcgggcgcctgtagtcccagctactgtggaggctgaggcaggagaatggcatgaacctgggaggcggagcttgcagtgagctgagatcacaccactgcactccagcctgggggatagagcgagactccgtctcaaaaaaaaaaaaccgcttttcagtcctattttctagcatttagctggtttatggctgtcatgcttctgaatctccccttgtatgctgtgttgtgctaaaggactgcctcacagctgggaaattgtctttactatttttgtcatcactaactcttgtcacttctttcactctccctctagtcttttccaatactgtttcctcattttccacccattctacttgcccatcttctccccttctttgttgttatgctcaaccaaggtgcttttttatctgcaaaccggctctttattttgacacatttccattctccttttcacaagttgatatgtttctgtaatttattttagtgtgaaagagtgcatagcctttacttgagctgcctgttttgtcaatacattgcctgcttcattgtcaccagtttcatcgatacagcttatgtttaatgaaccaaaattcctggggttttttaaaattttcatttagaagtatatatgcaaacatctcttccgattatcttgtcaaaaccacattttccatcatttttatttttcatctattgtccttgattattctttcatgttttcccattttagtgttgtccctcaacctcatcatattcctaattgccattggcaagaaggtaacctataatatgtcctgtactgggttacatcagcagattaaacagctacttttagccctgggatatagagtgattgcaaactccctgcacaaacaatacagtagttgagaactggaactcccagtctcacacctctcatttgcagccactgctttgggttgacttttctatactttttttccccgggacattcaaaatacaagtgattattagagctcaggattaaataatgtatatgcaatgcttagactagtacctgcacatagtaggccctcagtaaatgctagtaccgtattaccatattatgccatttttctttttgctatgctacatttcaactacttgacctgcattatcttttctctgcacccattatttcgtatagaaaatcctgaacgagttcaattaatgcatacttaccaccaagagtaggatcaaatacatatattgtgggagactttcttaaagacattttcgtgagacagtgttcatgtttaattaactatttgggatatgaagtgtactctgggaaaaaataactatatattgttattatttcttaagaagggcaagattattcaaataattgatttgaagatttcaggtttttcagtacttgctattcagtgcagcaatgaattccatgaaatctaatatccttacaagaaacttaggtttattttagccaaaagatgttctttggactaaatttgaggatgtttttctatggactatactagctaggtttaaggatattttcaacccatatttagtatcatgtcaacattaaaataaagaataaaccagaggcctggtgatattggcttacatccatgatagcttcaggaaatgctccatagatacttcatgaaattgttattttccacttgagagaaaaatcatatttctgtacttcattcctttttcagtgtcagacccatggcctccaagcagagctgttttctagggtttcttgatccttgagcaaggtgaatggcctccggctgtgccctgagcagtgcgtgcctctgcccccggttattaatccccagaagtgccttgtgccaggatgttatttcttaaatgcatttgattggcttggaagaattttgcattagtgaactcttgtctagaaaatgcaaatgccttgttgtggcgcttgagaaaagattattttcaaagagtttttcctgtgatcccaggcaaaatgacaaagagattcccttccttcacaatacaaatccttccttctccattaaggttggaagtaaagctttatgtcagtttccaattaagacgtacatatattattttaaggaaaactgaagaaatgaaaaagtgttttagtttgtcctgaagaaacagaattctgttttcaaatgatgggaaaagagaccggtttccaatctattcactgtcaaggctgcagtgagccgagatgagatcgtgccactgcacctcagcctgggcaacagagtgagatcctgtctcaaagcagaacaaaaccatgcagtgatagccagaagatactgccaggcatttaatgaaagagtgcattaataaagatgcaatctgattgactttctgtctgtaaattaaacccaaatagcaaatcttttttcaactctataatcctgaagttaagatcaccccaagtttgtcttgtgaacttttgagttaagttattaatcctcttacattcagctggcatagtggtttctttaaagggttgctacaaagactacagttgagaagtccttttataaccatgtccaaatacatagtattctctatacttgtgtttaattgtcttatttttgctaggaaataaaatttctgaatgagatctgaaaatggaccttagaacctgaatactcacacttttgatacctatgcagtgttatatgaatttccttaaacccactgttgtttgcaataagttgattcatgacagtgttccttggaaggtaatggtcagaagctatgtagtttttcataaaatattccatcttgagtaaaactgtaaaggttcttcacggttcaaccttacatttggcagatctaacatatttctgttctattcaacattttaaatagatatagctaatctccccatatgctctaatgctgcttcttatgaactatcaaatgccttggcttttgggaaaacccggaagcatgcatttggtttgcctataaataaataagacatgtacagaatattttcctggaaaagtattacttatcctcgtgacaagtcttaacacctggtaagacttgttcacttaacattttttaagtttggttgcttttttcccctgctggctgttgaatttgaatcctgaaacagttgtagtatatcttgcttgcctgcttgcacgcttcctctctttccaccttttgttccatcttaaagctaatttaggaaaagtctggttataaactagtctttatataaaaattatcttttatcactaatgtagttttttttccagaaccatcagctaataggaatataagaccattgctctccataattactggattacttctacatctttcattagtatttaaagagccaaagagctaacaatatattccagattttttacgtggacatgccttccttttggactcatcataaattcataggactgtaaggacagttgagtatgatggttctgggcacctttaggtaataacatcttcttcctacttttctctctatctctgctttgctccttttcctgaacctgcttttggctttcttcaactgctcctctggcactcttgtgtgtaaaaccaatcacctgcaccctagttatccccatttgtcctcgttcagcatcttgcagccccatcatcatgccctacaaagctgcacactctagaaattcgatggatcgaccaaaactctttgtaacaccacctgagggctcttctcgcaggaggatcattcatggcacagcggtgagtagctgttgggagcagctgggcaagtctgggagccagtgctgttcctgtgcagactgtacatgaccctgagctgtggtgtgggcgtaagagggggagaccgtgacatccaccatcccatctttcccattgatcatgaatctggctagctgggcagtagtgtcccctcacttcctcttcacttggggattttgctctccctaaacatttgaatttgaagatgaaagctgttctttgttcaagcatgtatgagtggacgccctaccctcctggagcgtccatacacataagtacaatgccagaatactttcatttttgaaagtaggaaaaccaaatggcctttgaaggggaagtgggcttggactgctgccttggcattttatttcaaccatatccagaagctggctgaactctaaatgtggttcactcaaaagcaagataaagaatttttatcctgcttggctaatccctgtcaaggccctgtcaagggatcttaaaatttagtcaaaaaagtattttgaaaacattagtcatttgctatatcactaattcgtaaaaggctgttaggctgtgctataaattctgattttgtaagtgaaaaatataatttgtacttattattacgggctgaggtaatgttaattttcaccatgctataaatgcaatgaggtaatttgtatgtctccaggaatcttcttctttgttttaaatcttgtgtttatttggtgtcagttgaaagatataaaccttgttctgtggtctttagacattgtactttagtcttaaaggactcaccagtgaactagaagatctcattgcctctctccaggataacagtatgacccttttgatgaaaggctgaaacagtttcttaaaatcgtaacttcccagagcaattcagatttataaacctgatggacacttaaaaggattttgcttaaaggataattcagggttgtgagagcttgatggctttgcctacagcctgtttttctttcaagctccatcggcctttctggaatcagtgtttgattcatgattgagtcaggcctccaaccctctaagccacaggtgaaacaatctttgatgtctggaaagttttaatttattagagtgttggtgtttcagagatcctccttagctgtagacagaaagccgtagttaaacagaacagcttggccccaaagttgggtactcactgggcaggggaaaagagcatttaccatggaaaaactatcttgttctgggtaaaaacaaaaattaacactccttgagagaaggttgagggccacctgtggctgacaggttaaatgagagatttgtcatcacatgatccagagccttgttttgttttgtttttattaccttcctctttctctatttaatcacatagctgtctttttacctctttacaaccaagtatttaggcaaatactaacagaaaacgactcagagtcatttataccctggagctgcactgtggaattcagtagtgactggccacagtgagcacttggaaagtggctactgaaactgacaagctaaattttaagtttttaaaaaatatttagttgtgttaaaaaaaaaaaagcatgtaacgtaaaatttaccattttaatcattctaaagttcagcagtgttaagtatattcatattgaagtgcaaccaatgcccagaactttttaagtcctgcaaaactcaaactctatacccattaaacaactccccatttccccctccccccaggccctggcagccactgttttaatttctgttcctatgaatttagctactttatagaccacataaaagtgaaatcatgcagtgtttgaatttttgtgcctggcttatttcacttagcataatgtcctcaaggttcattcttattatagcatatgtcagaatttccttcctttttagggctgaattatattccattatatttgtataccacattttgtttatcagttcatgtgttggtgaacatttgggttgctttcacctcgtggctattgtgaataacgctgctatgaacatgggaatatagatatctctagagattgttctttcaatttcacttgatatatagggattgctggatcatatagtaatcctattttcaattttttgaggagcctccatgccattttccacagcagctgtaccattttacattcccactaacagtgcacaaagatttctgtatctccacattctcgccaacaatcgtgatcttgttttttgataacagccaccttaaggaatgtgaggtgatgtcttgtagttttggtttgcgtttctttaatgatcagtgatggtgaacatattttcatatgcttgttggcttttcatgtgtcatcgttagaaaaatggcaattccagtctttgctcactttttaatggggttattttgtttttgttgaattgtagagttatttatatattctagtagtaaccccttattaaatatatgacttacagatactttcttctattccataggttgcctttttactctactgattgtttcctttgatatatagaagtgtttaagtttgatgttgtcccatttgtttattgttaatttattgacactttattgcctacgcttttagtgttatatccaagaaatcagtaccaaacacagtgtcatgaagcttttcacttatgttttcttctagaggttttatagtgttaagtcttacatttaagtctttaatccattttgagttaacttttgtatattttagaaggtaagagtccaacttcattcttttgcatttggatatccagttttccctgcatcatttgttgaagagaatgtccttgtttcattgagtggtgttagcttttgaccatatacacaagggtttgtttctgggctctggattctattccattggtctatatatctttttttttttttgagacagtctcactctgtcacccatgctggagtacaatggcacaatctcagctcactgcaacctctgcctcccaggctcaagcaattctcatgtccagccttctgagtagctgggaatacaggcatgtgctaccacgcccatctaatttttgtatttttagtagagagagggtttcgccatgtaggccaggctggtcttgaactcctgacctcaagcgatccacccatctcggcctccccaaatgctgggattgcagacatgagtcgtagtgcccagccccatatatctatatctgtcttgataccattaccacacagtactgatcactgtagcttttcaccaattgagtatctctaattcaaaaatacagaatgctccaaaatgtgaaactttttgaataccaacatgacactcaaaggagatgctcattggagcatttcacatttccagttatatggattaaggctgctaaagcagtaagtgttaatgcaagtattccagaatctgaaatctgcacactgtaatcccaatcattttggataagggatactcaacctgtaatatgttgtgaaatcaggaaatgtaagaattccaactttgttctttttcaagattattttggttcttcaggatcctttgaaattttctgtgaattttgggttgaatttttatatttctgcaaaaataaaaaattatattgggatttcaatagggaatgcatggaatctgtggatcccttttggtagtagtgacatcctaacagtattaaatcttctaatccctgcacacaggacttccttccatttatttgtgttgcctttaatttctttcagcactatcttctagttttcagtatgcagatctttagcctcctttgttaagttcattcctaagtactttattcctttggatgctataggaaatagagttgtttttcaaatttccttttctattttacttaatttgaattaatttagatttaaattcaaataggcaaatgtggttagtggctaaatttagaacatcttcatcatatcagaaagttctattaaacagcactgcgttaaagtatctgtcagtgaatcgtctctgttggaggatatttatactgtattctaaacctaccttaattataaaattaaagtccttttcctgctgatatgttgcccagaccattgacttgctgagtatgtgttccccctcagcattgtggaaactattaataggaaagatgattgtatagatggtgggctattaactcagatcaggatgagaatcgggagtgcctttacatgtgtggtacccaaatgggtggttggatataagagtaacaaaaggactgaaagggttaaaaaagaaagaaaaaaaaaaactccctggttgggagggtgttaagtatcgagtgtttttccaaaccattcctcctctgctcacctacccctaggtgattaaaggagataacttttaaaaaagaaagaattggctcaaaggtactgtaattctaggattatatacctttatataggttcattccctgatccctgtattatcaaggcacagataataataatccccaaccacccccacgccacatcaaaaattgtccctcttgagtctttttcccatttacatcacccattgatctgatttcagccaaatcaaaatgttttgagaaaaagaaaaaaaaaagaagggctacttgaggtacttaaccccagtctcccctgggaaaagacctgggcatgccaccctgtacaccagccaggagtgccccatatggtggctgcagcttttgatacccaaagcccacagcagctctgtgaggccccacctcctacttttggggacctaaaatgggagaaatggtggttgagcagctggaaatgatgcagagctggcacacaccttgtgaagctcttctctgcctctttcttcattttttctgtttagaaatcccagggagacaatgagcattatttgacacttaaatgtttttgctcctctgataacccagaccatcaactaggatgctgctaaggaaaatggagggaagcaattaaaagggacactgaggggaacaaaagggaaaggaaggaaaagaggagtcgatgcttgagccaggcagaaaaggagagaagaaaaggtacagtactagttcatgtgacctggggctagataatactctgccccttcccatgtacgcttgcagtctgccctcctgacaggtgttcacataggtgcctccagcacgtgcccctcccacctgagggcattgtcaggtttcagatacttggaatgggtctgttttgctctgtacaatttttgtttgtttgttttggtcttcattgactttagagtagtggaacacttctctgggcttccctttgcccattttgacttaggaaagtgtcatctctcaagctgaattcctagttggcaatcagggaggggtgatgttttggcccaccttcagatttcagtttattcctggtaaggaagagcaaaaaaataaatagctgaaattcctcactttaaacctgacttttcttcaaaatcacctattgtatcagttatctattgctgcaagaggacagtaggtgaagaaggacttgattccattatacaacatcaatataaaagaaaaaaatgagtttatgtctaatatagcaggcatataatttttttaaagactgagatatagtgtgtttggggggaaaatttaaagaattaaaaagaaaaagatgtgttttaattaaaattttttaaaaaatgaaagtaacatttgacatttgtgggggataaaccagaatgggacgttttgcttcaggtaattaattttagacacaaagtataggtgctttctaaaagtatgtacacacatatgctttttgacaaatatgactccaacacatccggaatcaccttattagtgtcacattgtgttaattcagttatactgttcagtgttaagctaacaagggccttttgttgagatggaatgggtatatgtgacatagctaagaaaatttcttaaaagtcattcaatggtttctagctccactgttgagtattgtgagtgtgtttgcctcgcttgtggaaaaatctaactattgagtttctctgaacttagagctataaaaaagaaagagagagagaaaatgtactcttcctcacatctggcacccgaagggctgtatctccatctaatcccaaagcaagacaaccagctcgctcccgactttggtaagtgaaatataagtggctggctgggttgtttcatgttagagaattagtagctctctcctctgaaagtgaactgttcttctcatgctgtttggctttgacttagggaatagcattcttcccaaaaggaaagaaaaaagagaaattggaatggttccctaaagcaactctatttctgtatctaccacataaaaaacaaatacacggagctaaatatctgcattctcttccatcgagtcgtgttctaggttctggcaagcctgttctcatgtgtccccttttgtctgccttgtttgtttgtggcccaggcttccgtccaagtctcttcctcatttgcctggcacacccagaccgacatcctccttgccacccggctcagtcaaagctgctcctgctcaggtccggcccccatcccccggcaacatccgccctgtcaagagggaagtcaaagtggagcctgagaagaaagatcctgagaaggaacctcagaaagttgccaatgagccctcactaaagggcagagcacctttagtgaaggtagaagaagccacagttgaagagcggacacctgctgaaccagaagttggccctggtaagagcaaactcacctgtggtctgggtgctctctctttttctcccgcactgttttgatgaagctttttttgttttccttttcttcttttattggagacttggaaattttactctaaggttaagtttaatacctttccttaagtataatattttaacttcgcattgcttaaaaatagttttttacttagcaacgctaagtaaaaaattacctggcaacactattcctgtgcatactggagtttaaggacccctggcgtagcctgtgtgcttgatagaagtcagaattttttccagaagacccactggttttcacctctgccagggtaaccagatgctacttagaaatgtaaaaccacctggagcttgaagttcaatatctctagttgaaaactgtcttcattccaaagttttctacttaagacttaatttgaagatagagggtggggcaagaaagaggagatgattcaagacaggtgaaaatggtagagaaaggaggagtccagtgtttgcttccatggaaaaagaaagaaaggaaaggagggtcatagaacatcataatagccatgaaaaaaatctgtggaagcagaagtagaaatgtaaatctcaaatcatacatccaaaagcctattgatagagccacaaacacgtgaattcaggtgtaggttctcagtgcttttattggctgagtccatttcacaaaatgtgttcagagcacctgcatcaaaatcacctgttgtattcattatctattgctgcataatgaattagcagcatgaaacaacaacaaacatttatcatatcacatggattcttgggtcaggaatttggcagcagcacagctgggtggtccctgctcaggaccgctcatgagattgcagtcaagctgtccactagagctccagtcatctcaagactcaaccagatctgaaaggtggcttacatacaaggccgggggcgggtggcctcagcttctccacacatggaccgctccatattattgctgaatgtcctcatctatctgcttgctctgctggcttctgccagagtgagtgacctggaagagagaatgaggaggaatgtacaatgtattttatgacccagtctcagaagtcgcacaccaatgtttctgccacattctgttaagtagaagcaagtcactaggtggaactcacactcaaggagaaacatagtctccaccttttgaagagagagttttcaaagaattttttttaagagttcagctttttattgaacttgttacaaaagaggtttagtcaaaaagaccaaagcccatatcctccttggactcctcagactctcttttctttgcttctatttcttctcctcagctggaacagcattggtggagggggcaggaccttctgctggtgcaggtccacgagctcctccattgcagatgaggctccccatgtcaacattggccaaggcttttgcaaacaagccagtccaaaaaggttcaacatttacaccagctgctttaatgagggcattgatcttatcctccttgacggtcacctcaccctcatgcagaatgagggccgagccttatgcagaatgcaggcgagctcagaaacagaggccatggtgtgagcaagtgtggggctggcactgccaggcaaggtgctagttgccagatgaagtgagggttccacttcaatgtggccctacattcctcagagggaccgagtgcagcttggcagcagctgaggaaaactggaaatatttttaaaccaccacatctataatgttttgacatacagacccttggtttttacctcagacttactaagtcagaatatgtagtggtggatatgaggactctgaaagatactaagcttgtcagttgattcctaaacatggttgccagatagaacacagggtggccagttaaatctggcaatgctattcctgtgcatactggagtttaaggacccctggtatagcctgtgtgcttgatagaagtcagaatttttttccagaaggcccactggttctcacctctgccaggctagccagatgctatttagaaatttaaaaccacctggagctgtgaattcaatatttctagttgagaattgtcttcattcaaaagacttaatttgaagatagagggtggggcaaagaaagaagagatgattcaaaacaggttaaaatgttagaaaaaggaggagtccagtatttgtttccatggaaaaaggaaggaaagaagggctagagcatcatgatggccgagaaaagtctgtggaagcagaagtagaaatgtgactctcaaaaggaggggctggagcagccaggggccagagcttgcacttgctggtgccttgctcactgtggtgcagaattgtgagcatcagtgtggggcttctggggcaccagctctctaggtcatcttcctaaatccgagtaaggccagagaacttctgctcccatcttgcatcttggcagcttgggatatataagcagaatgagcaccagctcccaaagaggccccgagctcctcccatctcagacctagagacagctctggggagacaaaagggtcctcttcatagggtatcatcttcccaggctgaatctggactcatggcatggatgctgaggatgctgctctagtaatgaatggttaccgaagagtaggaattttcaaatgcaataaaagacaaatggatgatctcatcttctttttgctcagtgtataactccccacagactctaacatgaggctttgtacacattcaatatatgttaactgatttaactggtataaaaataagacttggtgacagagtgtcagctttgttggatgtcttacttacacatactgattttttttatctgttgcttggttacagatagaacatagtgaaaccgtgagaacacacagtaataaacattcccttttctttcataatggtaaattctaggccttggatgtggggaatgctagttttggttttgttctttggattttgtttccaactggttttctccttgtacctatttgtgcagctgctccagccatggccccagctccagcctcggccccagctccagcctcggccccagctccagccccggtccccaccccagccatggtctcagccccgtcatccactgtgaatgccagtgcttctgttaagacttctgcaggcaccaccgacccagaggaggccacaaggcttctagctgagaagaggcggctggcccgagagcagagagaaaaggaagaaagggagaggagggagcaggaagagcttgaaaggtaaatgggagacattgctccacaccatggtgtcagtgatactttggattaactcatcacccctctgagagggaggaggtgataatactgatgaaagtgaatggattagttctttcaggattactcttacctaattttcctatgactactaagcagtttgttttttaaatcacatcttcttcttttttttaaatagaaatggggtctcactatattgcccaggctggtctcaaactcttgggctcaagggatcctcccacctgaacctcccaaagtgttgagattgcagacatgagccaccatgcccagccatgttttcttattttaatgacagtgcaacaacattgatggagaaagctttaaagaaaaaaaaaatccataatcataccaattttcagtaatagtgtacattttgggtggtcctttctagtctctcaacagtatgggagtgtgtgtgtatatatacatacatatacatatttacataattataaccacagcagaggtacaattgtacagtctgcttttttacttaacacatctccaatctccaggtttccgttttatctttgtaattatcacattaaggctgcataataagggttcatgttttctcctttccagataaaactcctctcggagggtagccaggtgggatctttacatgccccatgattgcctgccaggcagtattccagaaacagtttgtttaattggtcatcttctgggcctaataagacgaatgtcaatataattgttcttcaaacgaacacaactgtaccctggggaaggatctcatgcactcgctggaccgccatcttggccatgccttgcccttggctccaacagggagcttacatggctgtcttcctcctgtcctgtgacagaacactgtgacccttatttatttacaaagattccctttggctggggtgcttcaaattcattactaagaagtcacattatttgaattaaacaagtcagagcctttaaaaaatagttaaattccttccaaaaagccagctctccccaagatattggtggttacacgttgcttctatttagcacggacagcaatgcagctggcaaggcgggaggaagtctaagggtggcttcgcgctttgtcccttagcagtggtgaaggcatccagtggggatttttctactggacgcctaaaggaaccgccctacagaaccaccgacggaggcctctcttcaaagatttctcctcaggtgtctttggttttggttttgttctgtctttttccagacaaaagagagaggaattggctcaacgtgtggctgaagagaggacgactcgccgtgaggaggagtcgcgcaggctggaagccgagcaggcccgggagaaggaggagcagctgcagcggcaggcggaggagcgggcgctgcgcgagtgggaggaggcagagcgcgcccagaggcaggtgcggccgcaccccaccctggccccggccccagtcccgcagggagacgccccagcccagcagaggagggtgcggactggactgctggtgctcccgctttccacaccttctccatccgccacctcgcccccacctctgggcaccccctgggagacccgggcagcccgcctgtttgtcagaggcagacgccgaccttctgttttcagaaagaagaagaagctcgcgttcgtgaagaagcagagagggtccggcaggaacgagagaagcatttccagagagaagagcaagagcgcctggagagaaagaaggtagctgcgtcttagtagagaggcccgggacgcgaacttgcacctctaagacccagagactagccctggccgtcagaaaacgcgtgttctacccttgccacataaactagtagccccctcagtgataacaatctcctgcaaagaaatctctctcggtgttttagccgtcaccaaaaaacacttacttccacttcatgtagcttaaggcagttccaactttcttgaataaccccagttaagacaaagcagcactgctgggccgggtggctcatgcctgtaatcccagcactttgggaggccacggcaggtagatcaccgaagtcaggagttcgagaccagcctggccaacatggtgaaaccctgtctttactaaaaatgtaaaaattagctgggcgtggtggcgggcgcctgtaatcccagctacctgggagactgaggcagcttgcgcccaggaggcagaggctacagtgaactgagagcttgccacacggcactccagcctgcgtgacagggcaagactccatctcaaaaaaaaaaaaaaaagtgcatattgtatttttccaaaataacagaccattttaaataatctatttcatcagttaaatatgccaggctggctttttttctgtgtctaatcttcttgctcaattcttcctttcctatagcgacttgaggagattatgaaaagaaccaggagaacagaagctacagataaggtattgacatggccgttttctaactacttttgtatgcttttatctttttcattttcacttgtaactctaatttttaaaagtcctctttttttcttcttcgtagaaaaccagtgatcagagaaacggtgatatagccaagggagctctcactggaggaacaggtatttctgtcaatgaactcaaaccaatttatatataaaatgtttaaattgactctccaggggtgaagatattcaggaattgatggagggaaaaaagatccagtgcttacagactcacagaagcttaggggtctgtcatcgagtccttccttcctcttatgtaaaactgtctagtgtttctaccagttacttttcacgtttgtttatactctaatgggttgcttgatattttaaatcatcttatgtaatatgtatttatgcatatatgtatatatacttatacatatatgtgtatacatatacttttagaagaatttcttttgagtttataaaactaaatttcatttatcacatactgtctgctcaagtagtgtatatttatatttcctcttaagaaaggactttaaatttacacattggacaacttgtattatagaagttctcagaaaaatgatttaaatgttatttatcttagatctgacttcaaaataaagttaaaaatttgttgaaattcttatttttttaattgacaaataatagttgtacatattcttggggtccagagtgatatttccatacatataatgtacagtgatcttgaaatttcattagagttactgatatgccatcggctttggaaagagattattgatttttttttggagattataagtcaaatgtatttaaaataaaagtgaaattagccttaatactcagattaaattaatattaagtgccctttttgtatcaggtacatctttcatacataattcctactgctgccttgtgaagtggtttgctttgtctttgagtcaacaagcatttttgaagctcttctatgtgccaggccgtgttatagggctgggattcagtgtgaacaaataggcaaagtccctctacccacaggggcactcaggtccaatgacaggccaggcttacgcagctggggccccggtcccccagctcctgattctgctccttcagtgatccttcgtggtcttcatgattgtacatgcaggtggttagtagatagctcatcattgtcttcctctttcctcatgtgtgatatcaatatgaaaagaaaagaccagaggtactgcagttttctttttctgtttacaaacaaaagcaaaggctggaataccttttgctcaaagatcaaatccaacggtttatgtgacagaacattgcctataaacattaagggttttcaaatgtaaagtattattggtattttgggacttggttttatttccatagaagctattttggtttctgtatgtcataattcctttatagtggagttttcatgctcttttaaagatgctctaatgtatgtatgtgtatgtttggagaatagtcttaatggttgtatattataaccccattgcatttttagcatactgtcttcaagaatattgtaatagacacaggctgtaagtaggcatagtacccagtgagttgtcagagtgatcaatttaggctgtaaattgcaccagctcaagattatttgaggggctaatgctgtagtttgtgcctgtccagtctccttgttggtttgtttgcattttcccccttcctgccctttccttatctgttctttcagtattctttataaatcaatccaagaatgaacaaaggcaagagggaaggtgaaacttgctgtttggcatagctgtgtttatcaacactcatgtaaatttgatttgagttaaaactgctaaaaggaggcttgaggattagctgtgcctaacaaatattccccttctcccagtcccacatctgattgcgggctgactggtgttaccagtgctacaaagagaattctaaggtgggtatgcaggcaggcgagtttacagacctatcatatgttttctcaggggctgcctgtcaccagctttgcaaatttgggcagatttgaaattatcacttacctttctgccttagttatcagatctcttgtacctctggcagctttattgaatttgtgccaggttgtaaaataacattgtcttgaaattatttcagaccaggtgaggtagctcatgcctataatcccaacactttgggaggctgaggcaggaggatcacttgagctcaggagttcaagactgggcaacatagcaagaccctgtctctacaaataatttttttttaattagctgggcatgttggcatgtacttgtggttccagctacttgagaggctgaagcaggaggattgcctaagcccaggaggtcgaggctgtagtgagccgtgatcacaccactgcactgcagcctgggtgacagaatgagaccctgtctcaaaaaaaagcagggggcaagggggtgaggggtaggaattatttcagttattctctcacatcaagctgaaaccataatctaccacagatatatctgaaactccggcctgtataaaggtttataagtaaccctgtcctgtattttagaggcagtcatcaatattgtcagcttaaagtgggctgcaacattgagctttgaataatgaggtggaatggtgaggtacagtacactgctttccattcgtgaaatcctcattgttctaagtgtgcataggactaaactgagttttcaaaaatatttttaatacttatggtgttccttggtgatttgctctgaatcctttgtaaagatattcagtgtcagcttgatcaagtcagcttactgctatctttatcagttgctttggtttcaatattatatacttcatgtaactttagtgcaaggaaaaataataatactttgcccttccaacatgccaaacactgttctaagtcctttacatgtattaatattaatacatttaattctaacaatctatgaagtaggtactattactaatgaggaaactaaggcacagagagtttaggtgatgtgcccaaggtctcacatcacttaagtagcagaaccagcacataaatcaaggcattctggctcttggaggttaggtctaagaaaagaatattagtaaccctgtgttctgtctcctttactatgcccagaggtgtctgcacttccatgtacaacaaacgctccgggaaatggaaagccagttggcagcccacatgtggttacctcacaccagtcaaaagtgacagtggagaggtgagttttcactgacattcattaaagtaaaacattactgtttttacccaccagctccaccagaatttcaaagtcttaacattaggatttattatttggggggggcctcattgatttttggttgagctagtaattctgtactccaagaaagtggaaatatcttttttctcaagtcattaaatgtaatggtgaggatttagtgtgactgttccaagaatattacaagtggccaagtgcagggctcactcctgtaatcccaacactttgggaggctgaggagggaggattacttaaggctgagagttctagaccagcctgggcaacatagcaaagcaccatctctacaaaaaaaaatagcaaaactagcagacgtgatagtgtgtgcttgtagtcccaccttgggaggctgaggtaggaagattgcatgagcccaggaggtcaaggatgcagtgagccaaactcctgccactgcagtccagcctgggtgacagagtgagaccctgtctcaaaaaacaaaacaaaaaacaagtgataatctgttagttttctttgtgtatatttagcctgatatggaccatatccacattctttaatggtatataacaattgcattttagccatgcataatattacagtgacttacatgtttgttccatataaaagtcatgtagatgtcagtatttcttatattattaataacagggcttcttattgaagaaccagacagttgctaacaacagcctagaaaacagtctggatttcagaaagattgcctttctcttttcttgtaattatatcaacagcatcatatgaacattttcaaaaacgaaaaataagggtaatcatagcctatgcctaaaaatccaatcatagagaacttgcagaaatatttttaataatgttcaaaaaaatttagctatgactttttaaatttgggaaatctacttaatgtatgagtcttcctgtctttaatgccagtctttgctaccaacagacatctgaaagtcctcaaattattttcttaatctaaaaacacataattgtttctcggcttttggccaggataagtacagacacacagacactacattttataatgtaattttataatgtaattttataatgtaatgtaacattttataatgtaatgggcagcagttaaaaggtaagtccctactattgtgttgatatctttctgagactgtggaatttttatttatttattttttgcctactataataccaaagagaataccctgagagatcttaataattcatttccaattatgttgaataactttattgttgtaattacctaagatctatattaaatggtatttttttcttagttttaattagattttttaaattcattccctaaaacttattatgttcaattcattgacttcagagatttctttttaaaaaaaaaaagaataaaagataccacagagagaatcccattattatggggaacagacaatgcctaccatagtttcttttattattattttttttgagacagactctcactctgttgcccaagctggatgcagtggtgttatcttggctcactgcaacctccacctcctgggttcaaggagacacacccagctaatttttgtatttttagtagagatgggtttcatcatattaaccaggctggtcttgacctgctgacctcaagtgatccacccatcttggcctcccaaagtgctgggattacaggcatgagccatcacacccagcctaccatagcttcttaagccactgattatgttatctgatctataaagttaatttatgcataatttgactctcttcagtagtaatatcaccaagcaattaatcattatataagaacctgaaaaataattttactatatttgatacagataataaaattctgttatattttagccttttccacacacagaaaagcaacaatttgtaatgaaaccaaaatgaacttactggtgtcatccatctttacccaacaaataaattatcctttgtcatatatgtaagataatccctgtcaaaccattagaagaaacataagcatagcctttttctactttcacctgacaatacaggcaggtccagatgagcatcagacataaacatcagaatataagaataagcctaatatgaaatccattggccatctactccagtgtctctcctttaaaggaaatatatatatgtatatatatctactatatatatttttatatatatctactatatatatatatctactatatatatttttatatatatctactatatatatatatctactatatatatttttatatatatctactatatatatatttcctttaaaggaaatatatatttataggaatttaaaggaatttatataaaggaaatttatttttatatatagtagatatatatttcctttaaaggaaatttatatatatttataggaatttaaaagaatttatataaaggaaatttatatatagtagatatatatatttttatatatagtagatacatatttttatatatagtagatgtatatattttatatatatataatatatatatatatatagtagattcccagagttacttgtattatttttacaaatataaatttaggtttaaaatttctatagcccttgttcatttataaagccaaaacagcagatcacaaatttacataaataataaaactactttcaaccttcccccacagtgttacccttctatcccttgatttccatttctagggcacccccactgaccaagtccctggatgtttgcagtagccacctaaatgcttttgcccctcaaatactaaataccagccgggcatggtggcttacgcctgtaatcccagcactctgggaggccaaggtgggaagatcacttgagttcaggagtttaagactagcctggggaacatggtgaaaccccttttctaaaaaaatacaaaaattagccaggcatggtggcacacaactgtagtcccagctacttggggggctgaggtgggaagatcactagagcccaggaggtcaaagctgcagtgagccttgatcagaactctgcactccaacctgagtgacagagcgagaccctgtctcaaaaaaataaataaagctgtaaaatcaagaacagtgaaattattgtgaagaatgatgtttttctgaaattaagtgggtaatatacatatggtactgattgatcccttttgcattagggataaccatgattcatttcactcactgcttctctctgtttgaactgctttaaaacccctaacctctttttaatacagagtgccatgatgatacttggcttttacatggcactagcatatttatttagcagttcagctggttcatgtcattagcccttgtcaaataagctggtgctacctgatatcagtatgctttgaaatacacctgaaaatggagcactgaaattatgtagcaaaactcagctttgtgataatcagtcagacagatgatcagactgtacattatttttttaagttacctgggtgaaaacataaatttttaaaaatcatgtaaagaacaggaccccagtttgagaaacagtgcatttctgaatgacactgacctgtaggaaatgtttaatgtgatgttaagtttggtccccattatatgacacacagtttgtgatatgtagcctaagaaattctgcttcccttaattattttgaaatttgtcatccttgaattcatccagatcgatcttgaaacaatctgtatttttgccttgtattacctcttatagcaacaagtacaagaaaagaagggcataaagaagtacttttatttatcttatagctgctctttgcagtttcaaggttaggacccatagttatcataaactaggttttagagaatgtcattgtttgtagtttccatacccttcatagttttatgggtcttatttctattccctgtctacacttattttataagctgaatcctcctattatgtttactgtatcagtcggggtctaatcagaaggaaaaaaacatagatttaaaccggagaaaatttaaagaataactatcattcggattggagtaaataggatggagtaactatgattttggtttggcttataagaaataaagagcacttgtgggaatgatagggaaaaaaggaaaaaagaaagagaattctaaagaatttaggggcctggtgtggtggctcacacctgtgatcccagccctttgagaggctgaggcaggtggatcacttgagcccagttggagaccagcctgagtaacatggcaaaaccccatctctactaaaaatacaaaaagttagccaggcccagtggcgtacacctatcgtcccatctactcaggagactgaggtgggaggatggcgtgagctcaggaggtcgaggctgcagtgagccttgatcatgcccctgcactccaccctgggcaacagagtgggaccctgttaaaaaaaaaaaaaaaaaatacgaatagcagatacaaggagcagtcacataccttagtgttgcacccaagaagaaagatcccttaccctgcaggtctgtaatccagaccttgttagagaggatataactgtttgtattggatgccagagaagttgctatgttttcttgccagcagaacttgccagagatccaccctctagagtgcctaggaaagctgttcactgtctccccagaagcactctaccatgaatctgccccagtgggggtgctggggggaggctgctggccactgtgcactgcaggagccaggcactgggaaaagcacgtgtatgctaaagaagcctgctgagcaagcacacaccgaccagaaagcaaaactctgctgcagtgtctctccagcagtggcaaaggataattatttaacaggtctggatccagtttcacagaacaggaatgatgggtgaatttggagctgagaggcagtaaatcaataactgacatatttaccttatctctaaaagactccttcagctgtttgaatattttattcatatttcttcagagattcttcagcatgaatatggggttgaggaaaaagagcttcagaaccaaaagttccaggctggatccctagttttacctttgagaagttcagcaactgtggggttaacctacttaattaaaccttagttttctcatctggacatggagatactttccacacaaagtattgggaggttcagtgaaatgctatctgtgaaggagttccaaaaactgttgtactatatgaatgttacatatcattatctttatcctcctaaaatgaatgcagtgtccagaaaacacacagtacactaggtgtagctgcagtgtgatgtaaaataatgcttttggtttgttcctggtatcccatcttctcctgcctagcattttattggcttttttttgttttttcgttttgttttttttttttaccatcaaaacacaaggagtcagtatcaccaaggaacagtttgcagtgatcccaagatgtcttaacctccattgtgactgatcattcactgtcttttaaggatagctcagctgacagttttctaaacccactgcttttacagactgcctgccttgtcactcatttcatgattttccctgttttctcgaggggctatttttatgacttgcatttccaagaataaacattatctgcatacttaaattttatcctgcttgtcttccgattattataaaactaaacctagcactgatccctggggctctctgccacttaaactcttccatctagagaagggcttgcttattcctgtctttattttgttttatttttattttataaaacagagtcttgctctgtcaccaagcctggagtgcagtggtacgagcatggctcactgcagcctctacctcctggctcaaatgatcctcccaccccagcctcctgagtagctgggactacaggtgcgagccaccacacccagctaatttaaaacatatatatttttatagagattaggtctccctgtgttgcccaggctagtctcaaactcttggcctctggccttaagcagtcatcccaccttggcctcctgaagtgttgggattacaggcgtgagtcaccacgcccagcctattcttgtctttaaaatccatccccaaaacagcttcccattcatgaataaacattccctttgatgcagtggaaactcaggtttttaaacagttttacatctgaaattctgttaaaaactttaaatgacaaatcacatccataaatatttcctttcactcctagtttcaaatcaaccttaaaatgcttataaaatctttggttttcatctcagtgcattatttttagtgaggcattccatgatccttgtgatcagtcagtatctttattaaataccctactttgcacctcaagtagagttatagatccctccagcttgcccactgtgaattaaatcactgattaatggaaatgctcggggtccctgccaaagaacatggtgtgcctgatactccatgaaaatccatcatgacagatcatgcaagtatagtggtagaatttatttttgctagaaaactccactgctcagaatgactatcttttcattcaaattgagagagaagtatcacttttcctaatgtctttagtacctaatatattcgtaaataaatgaatgctgtgaactaaattacatttgctcctccccaccttgagatatttcagcaaactgtctagcagcaccccaggaggatggcgaccccctaacattacttttcctagcagctaggactgagaccctttgttatagaacaactctgtaccagaagtatcctgaaccctactcctcaccttactcctgagtgagacgcctggcccctttgccccaaagccatttttcttgcccatctcttttccccctgacaggttccccactgacattagttagaatggaagagggtttgagttatcacaattctggccagattttaaaggtatacagaaatatgtgaatatgccaagtgtggtggctcacgcctgtaatcccagcactttagcaggtctaggcaagcagatcacttgagcccaggagttcaagaccagctagcaacatggcaagatcccgtctctacaaaaaatacaaagatcagccgagggcagtggcatgcatctgtagtcccagatacgcgggaggctgaggcgggaggatcgcctgagcccagggaattgaagctgcagtaagccgtgattgcaccactgcactccagcttgggcaacagagtgagaccctgtctcaaagaaatatatgaatatatattaataacatatatggattttataaaattttataaatgaatatatacattttcctatgtaagatatacgacgtttataaaatacttgaaatatatctttatgaaatatatgaatattatatatgcccttgagctgatcattcttactcaaaagccatgtttggttcttaagagagagtacttgtggagggatgttccacaggaattgaggaaaatatttgtccatggataggaaacttgctttggaacaggaaacaaaggatacggatccatatgaatacaagtcggggaggacaggggtgaatatcagaatgggaacagaggaagttatctgcagtttctcaggtcattctgagatgttcttctacccctagctgagaatctctagtccagaggctaagaagctctgctgcctatacagatactgccttaccctcctaatactccagaagacatttcatgtttgttcattgccgtaggggagctgtcttttcgtagaatgttcgtctttttttttaaataagaagtttttggtaattttggtgtttgacccattcattttccctccaaatcttgagttcatcattgctcttagtttggcctgaaggaaaagtaacattcccaggcccctattgttcacacaggaagagatgtatcccttttaatttaaaagttacttgttttaacataattaataaatatcaagagaaaataaggttctggcttccataagctgtgtggactgcagattcttgccaaggtcccaacccctgcctgtacacattttggactggagcaaagcgtgcggtcttcaaaagtcttacatcagtcttcaaacttcagaaggtaactgaaggcagggaattcagaagctggtgctcttattctgagtggacacacggatccatactccttaaccccagtacttcagtttcagttttatagtttctaccagtcccgatgtcccctgaacatttcatgacttgtcatccaatgcatatggcacaattatccctctgattgccagcaggtagaatgggcaggtggaggggaaatgaaatctgatactggctcaagtctggggttagccattgccattatgacttgttagtacatgcaggcctggaaggtgacaggttaaggttgccaaggaaagggggctctggagatacgttcctgttctttatcctttgccaggacttctacttaaattctctctgtattaagaaccaaaattgtttccctagttacagaaaggctgttggtgttaggcaagaacaggaagatgggtgtggcagcccaggcacttagaacagtagatgttaggcatgtgtgtgcacacgtgacttgggggggggggcatgtgcacatgtgtgtgactgtactcttgtggagacttataatgcctagtggcattcccttcccttcttagtaaaatagcagaaaagcatcatcacactgtataatatttcagattattttacaaataatgttttcagtgtattctgcaatgccttgtgagacacttaggacaggcatcttcattttttccgtaaaaaaggaaggtttaataattttaaaaatacacaaatattcaaatcagaaatgctttagtatgtgttccaaagtcaatacttctcactcagtagagaaagtaaactattttgactgggcgtggtggctcatggctgtaatcccagcactttgggaggccgatgggggcagatcactcgaggccaggagttcgagaccatcctggccaacacgaagaaaccctttctctactaaaaatacaaaaattagctaggcatggtggcttgcccctgtagtcccagctatttgggaggctgagactcaggaaccactttaacccaggaggcagaagttggagtgagctgagactgtaccactgcactccagcctgggcaacagagtgagacccttctcaaaaaaggaaaaagaaagtaaactatttattcaatcaggcaaaaaaaaagcaaagtgttaaaaagcaatagaaaggttggatttacattagcattgttttacaatttgagaagacaaactgacttgctaacaatgttcaagcagttggtattactgagactaaggttaatttgttgagcattgaacaagttttgaagcttgcacacatatgtatatgctgcaatgaaataaaatgaatggtaaaattagtttagcactcatttgatgcataggcattatttggctacattgtaaagcataataataagcctataacagagagtggtaatctaagacaaaccatagaagattaagtatttggggccaattaagtatatctcaaaaataaatccaagatattaagcatgaattcataaggatcaagatgaggtcagaggcagatttaaggggcaaagataagaagatcggtcttcaaaaatttacatatgaaattatgcaagggctttaggaggctggaatatctagaaagtgtgcgaaatggcttaatgagaaaaacacaggaccagagattaagagatcgtgcatttagcctcaactatctctcagtagttgtgtgactttgtgcaaatcatttactcccccctccaaattataatcccctcatctttgaggcaaaggtcctcataagtggtactctttatcagatgaatataaaaatgcctgcagcagaaatcattaaatgtgtagaactgctgctgatgatgatttatttctattaatgatgatctgttgtaattgataaattgttctatttgataattttcataacaaaatgacagatttaaaatttttttgttgttgtttagagacagggtcttactccatagcccaggctggaatgcagtggtgccatcatagctcactgaagcctcaaactcctgagctcaagtgatcctcccacctcgactgccagagtagcttggactactggtgcgtgccaccacacacagctaatttttttcttttgtagagacgggggtcttgctatgtttaccaggctagtcttgaactcctggccttgagcagtcctcccatctcggcctcccaaagcgctaggattacaggcatgagccactgtgcctgacctagattttttaaaataagaatttaaggtacaaatacaccacaatttattatttttgttagtaatgatgtgactcaccagtctgatttttttaattgtagatttataaaattattcattataaaacattttggttttcctaataatgtgttttccagttttaagactaacttatttctatttttatttttcaaattccttagcactcccgatttggaaaaacaaccaaatgaaaatggtgtatctgttcagaatgaaaattttgaagaaattataaacttacccattggatctaaaccatccagattagatgtcaccaacagtgagagcccagaaattcctttgaatccaattttggcctttgatgatgaagggacacttgggcccctgcctcaggtagatggtgttcagacacagcagactgcaggtaagcttgcctccaactcccttctgtagtcatcagaaatatctgacacccaggaggacacgaactgctgccttctacagtatgattgtggtaacactttgttcttcaaaggaccaagtaagccacagtggaagagattgtgcctggctcatagaaattgaattttgagttggattggacaacttctaaggcctctcctattctctcagtcagtgcagaagtccagtccgcagcacccagtgggtgtctgtcagcctctctgcacagagcagcacccattacccgacatcatgcatgctcagaatatgctttgtagaaagacagggctgtctccccataattttggaccatccggcctagtgctgcccactagagaaagatctgagttttttccatctttctgaggtcttcatgtatttgaagactgccatcatgttctcccaccatttttctcttatttgggtttggcaacctgggtaataaattattgtcctttcaaaatgtgacatgatggatagttacgatttaggtgatgaaaccagtactcacactgagtctaaagatcttaacttgttaaatgattttgttgctgttgaaactgcctgtgactttcttatacaatgtctctttgacccacacttgacctgaagtctttgtgcaaaaagaacaatcaggacccaaagaaagaagacataatatcaaatattactaactcagtggtcatagcagctcagcaacgcaatcccatcagtctcaggaattagcaagataatctgtgctccctgtctcttcaaacctgtttcaattttgttgacttctcttccctgaagatgactgtcatgtattgaccagcatctctttatatttctacaaaaagaactggccaaattcaggataactaaatggagacaatacagaattatttgtgggcaaattgttttgccttctagattcaatcagtgaatctgtaataaatcaacttttaattcggtgtgataaccaatgtgagccacccatccaaatgaagctactcttcttttctcctctagtgtactgaccttggaagtggaacctcactttagtgaactccacttttctaggatttgaagggaggttgtaagggccctcccctgtctgactttctgattcttaagcctttgggaacaatccgactaatggtatgttgatggaaacatgcccagtgcagcttcctactcatgttacagatttacaggaagggaaagaacttccagatgatttatcaacatttatttaacctccaacatatgtttagaaccctaagcatcagatactgaggatacaagagaaatgaatgtttaaacccctaaccgagaaaagtacaatctgtgtatgccacttggaaaaatgaaggctgtggcctaagctgatgtaaagaaaagaacatatgtttcctatgagtaacagaattcacttaaatataagactgtgaatcctaacagaattgcctattcttatataagtgtatataacagtatagtaagttttagaaatttaaggtattactatggtattcttgaaataagattttagataaatgtcatattaatcttgttctttttctgtctcttcatgtagaagttatatgagtgtttcttctgaagaaccaaagctgaaatttaatgagaatttctacaattaatggaattcctttcctgctataaaggagcatcccctccacccgttttctagagttcttgaccatcattttgaaaagatttattaaaactagctaaagacaacagactggatagcttttctaataattttcatcaataggaaaaaagaaatacgtctcattcttcaatactttaaaatggctttttccagtgtgctccttcttagcaatcaatatttttctgcattctttaaaagacaagagaatttggttataaaagaaatgggctgactaggcatgatttttttggtcttaaaagcttaacatgtaaaattggcaaaaaaaattttttaccttttataatacttgaaaaataagtacctctttgttctacaagtagaatgaataggagaagagtttaagcctgtttttttaaaatattattgcaaagagctctatttgtagaagcaaattataggcagattaccaggttcttataaatacagcttgtacatggacattctgcaaacccagctgtcacatttttcttgcaactccttttgcaaaagcagactaaaatgttttaaaatgtgaaaaaacattattttttcaaagcaagaaaataatttactgccctcttacataatgtatttataaagtttttccagataaactaatcaaataaattagaataatgtgacaacattacaaatttaatttgttagctgcattccttctgatgttaccacgatagaatgttactgatgattcagggctatttctgaagtctgtatgttgctgctgtccccagtgatggtggacttatctttgccttacctgatcacaaattatgttggggaaaataaagatttaatatttctttaaatagaaaaagaatttggttttgctcgtttaagagcaatgagaaaatgatggaatgttgactgtgtttggcacacaggacacggaccttcatggaagtccttgctctgcgtggcatctgtcagcttttcacctttcattcttattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagacttcatctattggactattttttttaatccaggcatatggtctttagtaatggcttgtaatttgtgaaaacattaatttgggggttttccctgttttcagttgtccatgtacacatagtcattatattagaaaagaaagctgttcaacaaacttgtttaatttgtttaaatcaacatagcatgaaacaccaaataaaatgtttgacatagttttacttttagctttctcatatgttataacttcactcagattgattcttgagtcttcagattgtccttcatttaactcagtgacattttcctagcctcctgttgattaagcatataggatagccttatttaaaatttagagcagtaggtgtattttggctgtttttctttttcatgtgtgtttttaaacttattcatcattagcaaacggaaagccttctaagtaatcaagttttaattagaagtggtgcaaaattcttaattatattgtgttaaagagcagcgctgccagagaatgaccctgacctttacaatggctggcttgctttttggccagcactggaaaaatctatatttacttgcagaccttaaggaggtcttcagtattcaccctacattaaggggagcgctcaggaatcaaatatggccctcagtatgaaatgagagtgaatgggcttttagtttccttcctacaccattgcaaactatctaggccaatttagtcaccaatcacaggtccatttggtggtacctctagctattacaggaaagtaaggctatatgtgtcctcctacataaccgcaccacctcgtggtgtgttactataaaagcaaatctaaaacagttatctatatgacaagtttattagcaagcagggcttctggaaagcttggagaagttctttctctgctcctaagtaaccccacaaacaccttgactaaaaagttcacagtgaagcagaagcagtgatattctgaaagcagaattaagaaacctaattgcttggttggatcaggccacagtcataaacgtgtgtggagtgctggagggggaaggtacaggggcaaggagatctctagacctgagatactataaaaagtcattattttgcaggatctgccagattcttacacctcatttcatgcattttgcctctaaaagtctagacaaccacctacttttcaggctgcattcatcagtgaaaaattactaatatcccttatgctgatgaacactctggcgtatatttagataagtgtttaaagcatcttcctagccacctgattgaggtgcttcaaatactaacttacccccagaacaagattgaagttaaattacacagcacacatccattacacagtttatatttgaagtattttaaagtaaattattgcataataagtaacagtcagcaataaattctcccatcttttgcattactttttttaaaatctgattgaaatggactattggcctctatc

SEQ ID NO: 15771 - DNA, 61140 bp, Human
taagctcttcatgtgtaccccactgtgctgttctcctattctcagttcatctctttgcatctcaacttggaaggtaagaacttaatcaggatgcactgaacaattggcagaaactcatgtgaatgtaactatcttgtccagttccttaacctgtgctaagtccaggcaggcacctgaagaaaaaaaaaaaaaagcatgaaggaggcttttgcccaaatggcactatacttgggggattctgagtagggctgaaacagcctttgcaaaaattataactgaggaaattatggcagtgacaaagatcagacctaaatgactcagtctttcttctaactttcatgctgtccttattcattcctgggcataggccaaactaaccttagaaaggaattcagtttatggtttgactcagaaacaaaatcaataatagccctttcccgaaaagacccccttcttgcctgggtgccagtctgcctttgtacgattaatctattagttacaacattagaaattatggtttaggggtcctgcggcgtcaggctgcaagagtctgaaccttcccaagttgctgctggggataacatcgctattgtaaaatctaacatcctattttgcagaccctgcactggatggatcagctgacaccactcagaccgtgtgtgatctggctcaaccagttctgcgatcccacccaggaacagaagactgcaagaaaacgttacttcaacccccctgtgatcccatctgcaacctgaccaatcagcactccccaagtcccaagcccctatctgccaaattatctttaaaaactcccagaggcagggtgcagtggttcaacgcctgtaatcccagcactttaggtggatcacgagatcaagagatcaagaccagcctggccaacatggtgaaaccccgtctctactaaaaatacaaaaattagctgggtgtggcggcgcgtgcctgtaatcccagctacccaggaggctgaggcaggagaatcgcttgaacccgtgaggcagaggttgcagtgagccaagaccatgccactgcatttcagcctgggcgacagagggagactccgtctgaacaaacaaacaaacaaacaactcccggaatgcttggggagactgatttgagtactggaatcccagtactttaggaggccaaggtaggtggatcatttgaggtcaggagttccagaccagcctggccaacatggtgaaaccccgtctctactaaaattagaaaaattagccgggtgtggtggtgggcgcctgtaatcccagcactttgggaagccaaggcaggtgaattatctgaggtcgggagtttaaggccagccttaaactggcgaaaccccgcctctactaaaaatacaaaaattatctgggcatggtggcatgtgcctgtaatcccagctactcgggaggctgaggcaggagaatcgcttgaacccgggaggcggaggttgcagtgagccgagatcacgctattgcactccggcctgggcaacagagcgagactccgtctcaaacaaacaaacaaaggaacgaaaacctccggtctccggcacggcaagctctgcgtgaattactttctccattgcaactcccctgtcttgataaatgggctctgtctaagcagcgggcaaggtgaactcgttgggctgttacaggaccagtgacagaccaagggcatgccactgaaggaatccctagacgcacccttctggatgtgagacaggcggatctcacccacgcctgccagcagctcctcggagaactgtgttcctgggtcagccctggcccagaggagcgccggggacccgcagagtgctgctgaagtcaaggctacaactcacctaggatctggggcgccagccctccggtgggcagggcgttctcctcccccaccccctccccgcacgatgacatcaagtgtttggcgttgagttgctccataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggtaaagtttccgcctgcttctttcctaacactcctgagcgctcagccgcccctgggctgaaggctcttcaatgataaagtaaaatcattgctgcggggagcagggaaggtgtagtaccaaatagtagattctcaagaaaggatgctccgttttcctttgctgaggttgggtcgggaagcacgttgctttctagtggcgcttggcgcagatttggtgttaaaatgtttgcgtgtactcccgggcaccgccagctctgaagatgtggcttgggaacttgctaaccagggaggagatgcaaagccaagatttaaaacagcgttcccctgatccacgtttagaaagtagagacatgactgtggcattctgattggggtaagcacagagaaaggtttgctgtgcccctgtgcagaacccgcagacagtggtaggcgcttttctttggaggagaggatctttaccattaagtcttacctacaagtcaaagggatgatgcatcccattcttaatcattgtttttctccaggagggctctactatgctgaatgtacgtgtgtgtgcacgtacacacacacacgcacgcgcgcacgcacacaaaccacacacacacacacacacacacacagcatatttctgattgtaattagaacactaaatcccaaaaggctggaggctgagggactgaatggaggctccgtggagtgacaggaggaggtggcagaggggacctgaactgtgggctcacgccgggccagtgagctaacacgtgtacagccaaggctggttcattaatcttttggaataagaaagtgattttggaccgaaagtgattttactggctgaaactagattcttcctggcgaggcagtggtggtgggaaatgtgtcctgctcagcagcataaaagctctgagcctcctctcttggaggtcacagtgcccatggggaagggcaggggagccaggctgtggataactcttaattaaattccagtcaactagctggcatgatgtgcttgatattatctccctcatctggtcagggagaaacagaagcgatgtaacagaagttgggagaaaggagcgatgtaaaagtgaaaatcaagttttaaaaccacaaactttacatgtttccttttacgaaagctgcactgagaccaaagtttccctggaaatctctttagtcctaagttgctccaagaccaaagggagaaacagccattagttggccctctttcctatagctggttgctcctctcactctggggcagctctgcctcccttctctctcttttcctgcccttccctgttctcttccctccctccccttcctttcttccctactttccctgctcttcctcttccctctccctttccctcctccttatctcctctcccaattctccaagttgggactggggaagtttgtagtcaaaactccactttcgcctcactctgaggaaggagactgcctacccctgggtagagcacagcttttattctgtaaattctcatgcagtttccttgggtttttaactgccttagaggacaggtcaaagcaaaaatcactgaggtgtagaatgtcagcatgaacccaaagttggaggtggagaggagttaagctgagtaatggggtcaaagtgtgatctgctctctgcctggtgcatttaaacttccagcattggagaatgttcaagaacaatgtcaggggcccaggagggagcataataatgtgaagtcaagtgtcttctggagaaacccttggaattcttagttgccgtggctttggggggcatttcagtgaattctgcagagcttgccctgcccaaacctggtgtggagagccaggcagtcttgggctacccaggagatggttactcagggaaagttctagcacccagcacaggaagcaggcagggcccaggacctctgatatggatcttggtaaataccattttctctgggcattccctccaggggaacctccctgcccagtaccagctgggtctgcaggttctaacaggtttcaggctgagcctcccaggtttcccagatggaacagataaccttccttgggaaggaaactattcccctccaggaagggcctgctccctcaggatgccactgaggccttggcctggcctcgcttgtggaatcagtttaatccttttaagccttctgttcttacagctagaagtggggaaccagggggtgcaattcctgaataaagcacactttcgtgcgcgtgcacacacacacacgcacacatacacacacttttagagagacttcctgaggtcagagctgagctggggccctgatcctcacccgatgaacccccttgactcaccatcctcacttacaacgccgcttctccccagccctccagctcctgagcccctccagacactgccatttatacccaaagtgccgagtctggagtcccaagccagctcactcacagagaggagggcagggaatgttgctctggaggctgctgcctttcaacaagtccccagtcctatgtcaccaccgcgacctcacagtcccagatgtccactctatgacttttagccctgagctttccagagtgtgatgctgaggcctcatctgaggatgagaactccaacaacagggaaaaccttgattagcgagccctgggagggtagcagaagatgtagggtataaggctatgatttgaatgtgagcaggtacaatgcaaactgctggcaaggcagcagtgctcaggcagcagatgtgtttctagtggcctccaggatcactggagtggcctgtgcctcctcaggggaaaagtaagggtgaactcctctgttatttgtggaattttacatcctgggcctccaactgttctgcctgctaagaggtaatgatctggcttattatatctctaaggtctgggattacatcttaataatgaacctctcacacaaaagactgaagaaaatgtccagaagaggttttatgtcttctatagcttggtttgaaagcaatgctttctttattttttttcattgttgtttcagcaaaggggtgagcagtaaacttgggggtcacatacaagtttggtttccccgtggttctgaatgtctaattactaattcaagggaggttgatcttgggaccctcaactctcaatgcacccatagctggtttcaggggagtctgtggaccttctgaaatgacttgtatataaaactttatgtgtctaagcttagggaaattttttttttgagacagagtctcgctctgtcacccattctggagtgcaatggcacaatctcagctcactgcaacctccgcctcccgggttcaagcaattctcctgcctcagcctccccagcagctgggattacaggcacccgccaccacgcctgcctaatttttgtatttttagtagagacagggtttcaccatgttggccaggctggtctcgaactcctgacctcaggcgatctgcctgtcttggtcttccaaagtgctgggattacaggggtgagccaccgtacccagccagcttagggaaatttttactgggagaggtccataatactcatcggatactccagggggtctggactcctccacttaactactccaaagattgaggagacttgaagattccctaagttcatggcactaatgctaaattaatggtaaatgcggtgggactccttccagtgggaatatgatattggtcaggacacttcaccttggtggactttcatttcctcacctacaaaaggaggagatgggctatgagtgtaagaaagagatctgaactcttctcttccagggtgggatgtcaataaataatgcctaaacataaaacaatcaaggtaaaacaatattagcatgttatatagagatatggagataatagcaaaagaatcattttaaaaagatccaaagtggttgctctagggagcagtacatggttagggaatgtcagggaactgaggtttttgttacacagctttgtagaaccatctgactttctaaaccacgtgcaagtgtaatttgataaaaattaccaattacattggaaaattaaaaacaaaattaattacaaacactgaggcaaagaaatggaacagaataacaaaaaatatgagattaaaccggcttttttttaaaaaaaaagccaagttcactttttaacttttaaaaaacacaatttccttaagtaggaaatgccaggagtgataagtgaccagattgcttgtcacttaagttttactgcaaactaattcccacgagagaaaggggatgtgaggtgcttccccacaagggtacgcttttccatctgtacccttgtgggtcgagaaccacggagaccctgggaaaagttgggaggcagggatttaggagttgcacagtcccctcattggatgagtcacctgagacacacagtgggatgcttctctactcagggtcccttcctcggaggtgaagaggaaggccggcaggcagggtcacaagagcacagctctgcacttgtgaaaaagaccttttttgacataggaacgaagaacatttatgcatgaagagtgtggagtgcgaagtagtgggtgacttttgttctctttctggcagaactttgcctacacattcctactacccctggaattctaactcagatgtgggtagcagcttcctcaaagagaaactttttcccagctgggtgctgtggctcacacctgtaatcccagccctttgggaggctggagtgggcagatcgcttgagcccaggagtttgagatcagcctgggcaacatggtgaaactccatctctgtgaaaaatacaaaaattagccaggtgtggtggtgcgcgcctgtaatcccagctactagggaggctgaggtgggaggattgcttgagcccaggaggttgaggctgcagtgagctgcgatcacaccactgtactccagtgacagagtgagaccctgtctcacaaaaagaaagagaaagagagaaagaaaaagaaaaagaagaaagagagagagcgagagagagagaaaagaaagaaagaaagaaagaaagaaagaaagaaagaaagaaaggaaagaaagagagtgggaggggagagacagagagagagagaaaatgtaaagtgggaaaaagcaagacacagaacactatttccagtatgccaatgtttgtgtgaggagaaagagggagatcaatgcatatgtgtgtgtagccatgccatgaaagggctcccaatcatcagctaacctccttgtctaatggaagcagggaaggtagagtgggaagaagagcttctactgtatataccatttgatggcttttgggttttgagccacatgaaattattgcctattcaggtaataaagtttagcttctctaagatgtctggaaggcacctgctcaagaaccccctcctgcttccatgagcctctgcatgaaccaactgcctgtgctgctgactggagcacagttgccctgagaagctgctgttctgatgcagactcagaaaaagtttcaatttggccgggcatggtggctcacgcctataatcccagcactttgggagaccaaggcaggcggatcacctgaggtcgggagtttgagaccagcctgaccaacatggagaaaccccatctctactaaaaatacaaaattaaccaggcgtgacggtgcgtgcctgtaatcccagctactcaggaggctgaggcaggagaattgcttgaacccaggaggcagaggttgcagtgagccgagatcgcgccactgcactccagcctgggcaacaagagcaatactccaccttgaaaaaaaaaaaaaagaaaaagaaaaagtttcaatttctgggcatcgacctccttttcaatttcgctcatatcaaaacaaaatctgtagtgttttccattactcatctggttccattgtacttacttactgtgttttgttctttgtaggttccaagtggacttattttggtaagtagagattttaaatacttttttgttgaaaagaaaatagaaatggttgtatttaatgagaaaaacagaaacttcatgctctgtggaggtgattttgaagggtcggaagcacagttcttgtattgtagaaagagagtacaaaggcatctcctaagaacacttcaacttgggttgcatactgcactttctccaagcaggcgagcctgctccaggcacaggactgtgagtcatagtgtccaggcttcagattcctgcaaggatttctaccaaacctccaagatttggaggtaacttgccccacctccggactgcaagggtcctgggcaggagagagcctttctcccttgcaggacacatatcctattataaacaaagaagaaagggctcctctctgaaagtttggctgaggtcccagaacttaagctgtcagtatgtctagaattaacttcttgttgccgtgattgtaagctagcgatggatgaagaggtgttggtcagtgcttagtgaaagagggatgcttgtcttaaatgaagcgagaggagcaccagtgtgcttgttgcctgggctttctgtgggacggtctccaagagcatgttagccccatctggcaggcctgccagagaagcagctggaaatcagcttagctggagagttgcagtgaattagaaattggtcattggctggaatggatgtggcaggccagacacctgagtcccctggccagtgcgggaatgttgataatgtcttgttggggcacagccacagaagatgcacaagatcgattgttttggtagcagaagggtggaactgactcactggcacaggaggcattttaagcaagcagggttgtggccaaagttaaagccacaggatgcaatggctgtgggcggggacaggcgggaagttgattactacagtggaagcaccgtccagagaaagatctgacaccaatttgcataggtcagcctttggaggttcaccagcccaagatgcatagaaaagtcactgaactgaccaaccagctacccacaggccaaggtcccctcagccccagcactgcacggctccgttattgctaacatcccttatgtactgattatgtgcacagcacattgctaagtgggtgggtaatagaagggtaggctgtggtccatagttgggaattacttaaagctcacaattcaaagcagaacataataggtaataataacatcataaacaaatgcttcagagatctgagtgctcaaaggagggcgagtgtgctagggctagatggtcagggaaggcctcctggaggaggagggctttcacctgggccttggaagataaggaggattcggtgagtggggagtgggtgctgttggctaaggtgatgttgagcagaagcaagaaagagcaaggtggtgttcgaggaaagcatgtggagaagggtttatagcggagtcacgggctctaaggtcagagagataggctgggtcaaacaggggaggtgtggagggtcagggcaggcctttcccactttgtcctgctcctggaggggcagggcagggagtaagtctgtgttttaggaagagttacttggtggtaggaggtggagggggaaggatggagggaggcaggaaggtgtttggcctgtggagaaaccccgttccgtgtcttcacatccagtttacagtggtggcagtgagggggaaggccaggccaggataagagaactgacaaagtaagaatcgcagaatctgggccacagggccccttgggcaggttccgtgtgtaggaggtgacaggcatggaaagaaggtggcacttgggttctgggctttattccatatgatccccagtaagccatttcagccccaggacttcactttccccatctgtaacctggaggaggggttgtctagaccagtgtttctcaaactacggcttgggatcacccacatcaggatcacctggaatacttccccaaaatgcagatttctaggccttgggctagacctgggaaagggagggagcctgaaaaacctgtattcttaacgcactccccaagtgattcttagctgcactctatcagagaatcactgacccatggttcccaagacctgtctatccagagagaggaagcttgccccacctcttctgctggcctctcaggtatgatagaaacacagatcacatctctacggggtcctctatccctatctctctgttacagccctcctgggcagaatgagatggcgacagggaacagagacattgtgtgaaggtgtgggaggacaaattttttttttttttttggagtctcattctcacccagggtggagtgcagtggcgtgatcttggctcactgcaacctctgcttcctgggtccaagggattctcctgcctcagcctcccaagtagctgggattacaggggtgtgccatcacgcccggctaatttctgtatttttattagagatggggtttcaccatgatggccaggctggtctcgaactcctgatctcaagtgttctgcccacctcggcctctcaaagtgttgggattacaggtgtgagccaccatgactggctgggaagagaatcttaactgcctcttcatcatgacgtggtgttcgccaagggcgggcttctcagtgcagccacactgacctgtccagaagcatttctccctgaccactagctctggccagccctctgtccctcctaccctgcataattagagcagctctttgctgaggaagcagagggcagagtctaatgatgcatggacatgcatggggtaagcacaaaggcaagtctggtttttattagtgacatgggcatgtgtgatgtggagtcagccctcagaggggacgtgcaggagaggacagatggaagacagctaaggaggcaaactcctcctgaggtcttggctagctcctccttaggtcctggctggcagctggcacctgtgctcagggctgcacaggtagacagagggcccagcataagtgctggagggaaacggcttccaagcaataagggccgcactgaatggggcaagtccaaccaaaggctccgtgctgggcatggtggctcatgtgcagaactcagcttctttgcacgtacactgctgagtcattctccaggggcctcccactgtctggcacacatggtaggacttttagaagtacaaaaaagggagttctacccctacatcctcatagctgagtcaccaggctgactgcatggatggctcctccctggagagaggaggaccatctgactgccaagatggggccagcgccacctctttgagcccctcctagggtgctgaaacagcagctgaatggctgctgggcttagcatggctgaggtggcatcatgagagagaggctggggatgatgtgacatggaccttccccgccggaaatcagtcccgcatcaatcccgctgagcccggcagcttcacttgctgtgaactgaggacagctgcaggtcaggttgtcatgtgagctaaggacaaactccagcctgctaaggtatcagaatatgtgccctgtgggggatgaagatgaccggaaggaggcaggaagggttgtgggcacgttcaggtccttggtgtgggtgctgcagtcagtttttgagcattcatccagctgtttgcttatggtctacacacttttcggtatatatttcatattcaataaaagagttacaaagttccagctggctgggagattcatccttactctgatagcttttttagtccttccccaagaaaaaaccaaaccaaactaaaacaaaacaaaaaacccaaaaacaaaacaaaaaaaaaccctagtgtgttcaaaacaacagagcaaccagaaagaatgactgtattggagctagacccgagagcacatcatgttagctgagaatgggcgtggtgtttcatccctgatgatatcagatattggcttgctgcttcttggatgtgagctggttgagaaatagatgaaaacccctgtttgctcaagatctgcaaagtcttaaacgcgatgggatggcagaagaacatggatgacaagccttcctcctggagggtgcgccaacccctatcacagccccacagggcacccgcgaggccagcccctccatcctgttcaggaaaccttggaaagaaggtggcctggcacgggggtgccaggtggctggctgtggctgtggccgcacatgcttacaggtcagcctgcccagttctctgttgcggcaggccagccctcgtggccctcggctctggcaggactcggtgtgagccgggcagtgctgtgcattccttttgctgcactccttggttcctctcccagataatacattgtccgtcttaaagaatttcctttggaaatcagggggagatcctccactggggcaaacctcattttcatgtccctgaagtcctccaggcccacacctccacccgccttctgtcctgtatctgcggaaatatttattttctgtaatgaactttcttggggctccagacaccctctcagcctcttcccacacagaactagaaatggaacacatgaaaggaggccaggaagcaaactcttgactttctattcttcagcagtgataaaggcactgtgtgacctcacacctgaattgcaatataaaaagcaggctgcagtgagagctcaggggagactcaaaacagcagggagcacctgcaattaatagaccgagggctcttgtctctatcaaagggagggaggcttggccatctcaaaacattccagccacttctcgcgactcccagctgccatcctgaggatgaataaggggcacaaagtactctcaggagagccggaaaaggccagacatgtttttcttttttcttttttttctttttttttttgagatggagtctcgctctgccacccagactggagtgcagtggtgcaatcttggctcactgcaacctccgcctcccaggttcaagcgattctcctgcctcagactcccaagtagctgggattacaggcacccaccaccacgcccggctaatctttgtatttttaatagagacggggtttcaccatgttgaccaggctggtctcgaactcctgacttcaggtgacccacctgccttggcctcccaaagtggtgggattacaggcatgagccaccgtgccccgcccagatatgcttttcctatcttttctttttttcttttttttttttttttgagacagggctttgtcatccaggctggagtgcagtggcacaatcactgctcgctgcagcctccatcacctgggctcaagggattctcctgtctcagcctcccaagtagctaggacgtatgccaccatgccaggctaatttttaaattttttagtagacacaggctacattaccaggctggtcttgaactcctggcctcaaatgagcctcccgcctcggcctcccaaagtgttgggattacaagggtgagccaccgtgcctggcagacatgtttttcataccagcacactgaattcctatccccaaatcccatggatttctgctggggttagaaatccgaccccctatcttgaattaaatctgtgttgtagtttcagttacttctaattgaagttgtgacatctagggtctgtctggatgtggtgtggcccgcctactcatagttacttctcatctttcctgaattgcagaattggggtttgtgcgtatcctggaggcttttggcctgtggctgccaaaatgcctacatttttgtgttcacagctggcctcatcagctgagtaaaaacatagggaagctagcattagttcctaaagacaggcatagtggaacagaggatgaggcagaaaaccaggaggaagaagcggaaactttacagaccccagaaccaggcgacctccatggaaatatctgctaggccactttctgtctggtgcgccttaggaaagtaatgacctctctgagccttggttccttagctacaagatgagaatcatggcatctacaccagtggttctcaaagtgtggtccctgggccagcagcattagcatcacctaagccaaatgcaaattctcagcccatcccaggcctacctcctaaccagaaactctggggggcggggcccagaaatttgttttaacaagtcctccaggtgattctgctgctcactcaagtttgagaatcccagctgtgcttcagagggttgtggtaaggatcaaataagataacacatggagagaggctcacacagggcctagcacatacaaagctaactgtagtttctttctctttgcctcgcagagctatggtgcagattaaatgaactaatatggagggaaaggccttgtaaactctacagcaccaaacgcatgagagctctatttttgttaggaagggttctgcttcttcacacttttctgaattgtgagtttttacagccaggaaatactccttttatattttcaataaacaaagggtatttcctttttgagtaagaaaggaatttaaaaaacacaaggactgcaagctctcgtcccaagggcctcacaggccagaatgtcctttctagcctggttcttcagaccaaggtgaagtcaggtctcatctccctggtgctttcctggcatccaggaaccagatatctggttccataaccatggcctcctcagccaagcccctgaagtctcccagagagcaggcaaattctctggttccctgtctagcccatgggggctgagcctagtttggggttcaggagtggaggcctgagcctaggaagaaacttggggctgagctatttgggattgacaccagcctagcctcatgcagcgcccttttcccactggggcagcatcaagccttggaaccgcaggtgcagcgggctggcaggtgaggaggaaggacgagctgtggggctgtcctgccagggcctttcaggcctctggctgtgctccgacttgacccttctgctacctgctggtcttgagccccgggcattcaggtgagggcagggcatggcttctgcaagagctggccagagcttttggcaacgcatccccttaagaagaggagccagtgtgctgccctgtgaacctgctcaaaataaatctttcaagcaaaaaggctgaattcaaagcatgagtgggaaggtggctgcgggcaggagggagaaagtcctggttctccttgaggaagagaataggtcagagaatgtttcctcgggatcctgcagtctcagaaggagcaggggcctccttcctggcctgttactctcttccttcgcaggggcaactgctgggcgaagggtgcaggcaccacggtggagcgcaggcaccatggccagtctcttccaggggccacaccaccaggccaagaaagagagatagcacctgctacagtcaaaggtcctattttattggtcctaagatgtccactttccccacattttagcatctctgaaattgggatatatcttgttatcagttgcattgagaagcaatgaaataggatagctattccacgaatacagagaagcaccatgttagatgctaagaacacacagaaaggggctgaaacgattaatttcaacaatactgaaaacagtggaggcaaaacggtataaaaataacggccattatgcacctggtctgacacagcacgtaagtatgatggggaatcatgtcagatcttgaactatagctttttccaacttgcagttaattcacagttcacgtatactttttggtgatgttgggtcgttctcacaagtatgtaaaaacaaagtaatttaggcactagtttttttagtttatgtaagtattcatttaaggagaaaactttccaattacctgacaagcgttcaatttatgccaaccaggaagaaacaaatactagctgccacctccttgagtctataaacattgactcagagctggtgtaactccaaatacgtagatcacttagctcattttaacttttaaacaattttgcaattattaactcgtgactaggtcagctatggtgtgaaatggatgcaacccatccagttctcagaaagatacctgcagattcagggcaagtggcacatgctgccccctccttctaggacacagggctctgcaaagtctcctaggtaatgatgacagtgagatttccttatgtaaggtcatgctggcattggcaagtggggcctggtgccttcccagggtggctcctcattggcacaccacttttctggaaactctatcagaaatggagaaaggagaaaagatggaactctcaatgtcgtggaagaaagttttgaagcaagtatgaggcagtgtttactgttgactcttttggctttggtcaccaggaagcccagaggaaaattgatgtctccaacttgagcaaatgtctattcttctatgacctgcaaatctaaagaagccatgctggctgggtgcggtggctcacagctgtaatcccagcaccttgggaggccgaggcgggtggatcacttgaggtcaggagtttgagaccagcctggccaacatggtgaaaccctatctctactaaaaatacaaaaattagccaggcattgtggcatgtgccggtagtctcagctacttgggaagctgaggcaggagaatcgctggaacctaggaggcagaggctgcagtgagccaagatcataccactgcactccagtctgggcgacaaagcaagagtccatctcaaaaaataaaataaaataaataaataagccaccttagtgttacccttctagcttggggatcttatttcctgatcctgagccaaaaccttgtaacagatttctggattttcatctagaaagagccttagtctagtggtaccctacattttcaccactgttttattctgccttcccccaccacatgggtaccatgatttaaacagtttttaaacatatttatatagtaatgaagtagtttaaaatttcccacttgttattaatcaaaggcagatgtaaaaaccaaccaaagttttcaacttgcctgagataaatggttcacattcattccacaaatattcactgagtgaagactaagtgccaaatattggactaaagaaacggataagtattggtactcaggaaatggttgacaaggcttggtccctaccattatgagactaagaatctggaggacagagcaattaagcggggccttacagtacagaggagagagacctcactcagtattttggaggaaaggattaaagaaggcttcctgggggaggtgatgtccaagatgagacctgaaggacacataagagcaagccaggcaaagggcaggggatggagggcctctgggacaaagggacagcctgtgcaaagaaggaagctgctatgttctggagattcctgaggacctcagtgatgagggaaggggcttggggccagagtgtgaagagctgagccaggccaaagagccaggacctcgttctagacacagcagggaactgcaggacatgcttttttttttttttttttttttgagatagtctcgctctgtcacccaggctggagtgcaggggtgcaatctcagttcactgcaaccactgcctcccagtttccagcaattctcatgcctcagcctcccaagtagctgggactacaggcacacgccatcacgcccagctaattttttgtatttttagtagagatgggggtgtcaccatgttggccaggctggtctcaaactcctgacctcaagtgatctccccgccttgccctcccaaagtgctgagattatagtcatgagccactggacctggcccactgctggaccttctaagtagaacactgacaaactgggattagcattttaggagaatcatcccagctgcagggtggagaatggattgagtgtgaaaccccagaggaagggagaccagagggatgtaggggaaagggagaggatctggaccaagggaggagaaatgggggtcctgaccttttgatataattgggccagaaatgtagatacccaacattgcaattgcctggagcagcctgattgtggctgaaagcccgtctctgctgggcttcacaaagtattcaaataggtgcccagacagccgttattgcttaggtgggccccaggcaggggaggggaagctcatgtcaccaaaccctgcccctgtttacaactgaagccaggaaagctcaaaactgtcaggtggctccagcagcctgaggagcagagtcagaacttgggcctcttaactccctcccggtgctctttcccagtccattggtggatgctcgttttatgccaggcactgtgtgccctgcactacacctcatgccgttgaggaaatgcagggattttttttgaagagtaaatagtgtagatttgccaggaattatgccaagttcacttgcttttcttccccccatcaggatcaaaggcttagcagttaaagaaaacacaatagacttaatacctattgacataaataaatattttacactgttcgttgtgacatgctcatgggaaatgtggatcaaagaccagtgtgtccggatgaggtggcttatgcctgtaatcccagaactctgggaggctgaggtgggaggatcacttgagtctaggaggttgaggctgcagtgaactgtgattgtgccactgcactcagccccagcaacagagagagaccctgtcgcaacacaaacaaacaaacacacacacaccagtgcagttgctaggaagacaaaatagaatccagtcattgctgtcagcagcacagggctgaaagaggtgcaggagttcctccaggaacaatcttgaaacagtgccctcaggaacacatctttggaagaggttgggcagtggagggagtgcggtgattagcactggacaggaccacattggaagagggaacacagaggacaggccatgcacagtgaagaggcatatgccagaaatgtgcctggacgatgggccagggctgcagggcctgggcagcaagccgtgattcagtgagcagatatcatatgagaacggcacactgcgaggcaagagcccaggctgcaaagactgattgaagaggagcgcccacatcccccaatctgtgttcatctgcgtatttgtgttcttagatgtgtctgtactcacacatactcccagctgcatctcctgtacagtttaactgggacccagcctctcagctggtttctgagttactcacatgtgcatttatagctccctgcttggaaccgtgcttaggtgaaatcttaaagagactccttgtggcagtttcctaagagtcccactgtttttttttttttttttttttttctagtgacggggtttcactgtttcactgtgttgcccaggtgggtctcaaactcctgggctcaagtgatctacctgccttggcctcccaaagtgctctaagattgtgagccatcgcacctagccaagtctcctcaccgcccccccactttttttttgagacagagttttactcttgttgcccaggctggcacgatctctgctcactgcaacctccgcctccagggttcaagcgattctcctaccttagcctcctgagtacctgggattacaggcatgcgccaccacgcccggctaattttgtatttttagtagagatggggtttctccatgttggtcaggctggtctcgaactcccgacctcaggtgatccgccctcctcggcctcccaaagtgccaggattacaggcgtgagccaccgcatccggccaagtctcccactcttgataagccttttagtggaatgcttaacttgtacatcagcaaggatgaagcagggagcgacccatcccttggtcagactgcatctgcacagatgccctgtcagaaaacttgttatgccctggtaaaaagttaagaattataggcatcaactgtttcctgccacataactgtcccatgatggcatgggtacttcttgggttaataatcaggtgttggctttcctgcaaaggctgattatcacttgtcaaattatcactgctgaattgtttaatcaatggtggcttttgagcttgagcctgctgcatgcacagcagtgttctaggacttccaagaggaacagagggtgaccaaggagccatttttaccctcaagaagagttatctagaaggagggtgtgtctgcacagcttaggggtcagcgtccccacagcagctgcataggcagatagatgcacatagcctggcccaggggaggtgctcaggaaacacttgttgatgattgaggaaagaatgggttatttctctattaatttttggctctgggactcagggaaggcaccagagagaaggtgacattgatctgggatggtcggatttcagaggtgaaactggcctgaaaggaaatgccacatcaccatgtgcatctcattagaagtaaaaggagacatgtaggaaaccttagatttgtttttggtgaagtgaaagagagaagttgctctaaaaggttggaaaccagcccctaagaaaaaaagaaagaactgagacaaatcaactcaggagggcctgggacccagcgtgcgtaagagtctaccttgtctagacatggctcttacgcagtgattcctcacagcacagcacccggtgagataggtactgccacttccattttgtaagtgaagcccagagaagcaaagaaatgtgccctaggtcacatagctagtcggtggcagagctgtgattggcaggttggtcgaatgcctccaaagccctcgaccttcccactatacttcacgcatctctagagaagagacagaagtagccaggatgaaggtcttcaggtttaagaagaactatgaaaaagcaaaagatttttgttttcgtggtttttttactataaaggaaaactttaaataatagcaagagtgctataggtaagatatcagaaagaacatccttattgtgaaagctgttacgtgaaacattgagccagcatcaggtcaacgtccagcggccaatcttcactttagttcaggcttcatcctggggaacttcaggaagtttctgtcttttatcagatcccctctttgggtaatttccagactccccagggattgttcacaaagtcacaaatggctagttctccactccctccagctctggaccattgcccagggcttatctgctggtcacgtctcaccacctcatagccgttgctactgcctgggctctggtccctccaaagagcattgagaagctgctgtcgtggaagatgtgaactgtcatggttcagagctcaggcttgctactcactggcagtgtgactttggtcatattagtcaatccttctgtgcctgggttcctttgtctattaaaaggaacacagtgtctatatcatagcattgttattcagattgcagtaattaacacatgttaagcttacagaatggcagttgacaaactgtggcccatgggtcaagtccagcccaacacctgttttataaataaatttctttggaacacagctacattcatttgtttgcatattctctgtgactgcttttgggctacaatagcagagctggtagtgacagaaaccacagggcccgcaaagcttcaaaaacttactctctggccttttgcagaaaaagttagccaacccctgatatagaatgatgcctggcacatagaaagtgctcattaaatggtagcttaaacaaagaaaagggaaagaagcctcactagttcttgagtttaacaaaatttgaatgaggtcctatgatgaatgcttagacaatgacaacctaaaaggaacatctaacacagctgtttgtgtgatcagtgctccctgagggtggtgatctcttcctgcctcctcaatgccaggaggtgctgccatcatgctgtgtcccatggactggagtccctcctgactgtgttctcccaccactctttcctgccccagagaacgactgacagggagagcagccaactccatcaagatcaacctccgctgtggggcatgctctggttcctctttcctcacggccctgaggggacaattacaatagtccagtctcgaccttccagtctcttccctgtggatattttgggcaggataactctctgttgtgcaggactgtcctgcacattgcaggatccttagcagattccctggcctctgcccactagatgctagtagcacccccccaagttgtgacagctgaaaatgtcttcagacattgccaatgtcccctgaagggcaaaatcgccccagttgaaaatcactggcttagtctaaaataacatcacaggtggggcaacagcaacccggtctaggatggcttaacttcatcctttgaaaaacagtgttctttgcaaaggcacaaactgctaaagatgcctccagtttgtattattgtatcattaaacagagcatctcacctcgaagcagcagcatctggactgctccgttgggggctacacttccactgggcagctccctgcctcacatctgtgtaggtaagagggtctatcaaagagctaccttccacagcccagagacggcctgccccagagtgtggaagatgcttatgaatccccccacccctggccccatgctagctttccagcttcactgtatttacatccgatgccacctcaagtgtcaggaagaaactgttgacagctttaaaataatagtttattcaccgattcgcttattctcccctccagtctttaatgaatccctttgtgggctggtcacagggaaccagagacagagcccttaccttcaatgggctggtaggtgagggggaggtagacatataagcaggtaattacaatgaagcacactaagtgctatgatgacgtgtgctggtgttgtggaacacagaggggacaaataacctcaattcgggggcatgtgcgtctgtcagcaaaggcttgcctgaggagctaattctggaaacacacaggagttagcagggcaaggagaatatgtgagtatttatgtgcatgggtggtgagtgttttagggatgaggatggcatcccattgcaggcaacagaggccctaaaaagcaggcgagagcacgtggcacaattagagactcagtagcctaatgtttgaggggtagtgttgggagacagttctccatgggtctttcatgtttcagcatatctgtgaacagagacactagacaggttttgttccagacttgcttttaaaggacgtttatgtaacaaacagtcttagatgatagtgacaatatctccctgcagggcaaagagtgatttatttgctgtcagcataataaagatcacgtctcctttcagaggtaaatgttggacaggtttgctagccgccccctttaaaagaatgaggtttcccaagccttgagttcctcagccaatgatgctgagcagtttgcatatgccagtgtcacttggtccacatatcattctgtggaactggggctggggaaacaggtgcaaacgttactctggctactgctgtgagtattaaactgtcccttgtctctgacccaggcatctcatgtcttctgccgatatccatgaaactggcagactaacttgttaacttgcaagcaggataaaagctctgaccctccacacttttggacaggtgatgagtggggaaagcaaagcctggagaagtgagtgggattgtgaaggtcttgtgtgctacatgacagagcttgatatttatctcaaggagccactgaagaactttcagcagagaactgtctggatctggtgtgcactgttgtggagagtggagagctggagggtgagcctggagaaacacggccaatgaggggtacagctgtggggcaagtggtctgaacaagggctgtgccagttgggagagtggcggtcaagtttaaaacaaacttcatactatccttgatagcattttttttctgatccaggattcaatccagatagcatttatctgtggtatctctttagaccttttatgcccttgacatttctgaagcatgtagaacggaccttgtagcatatagcatatagatcttagagaatgtccctcgatttttatttgtctgagggtttctcatgacgggagtgaggttgcatgtgtatatatatttgtgtgtgtgtatgtgtgtgtgtgtgtacatatatatggttagggttaaggtacatatacacagtagagggtgtgagagaaagcaagtgtgcaaaatgttaacaactggtgattctaggtgatggctggaagtgagggttgaaggagaggagaggaacgagtcagttgtgatcgccaggcatttggtgtggtggctggtattaccagctgacatagagggttggggggagctttggagggaggaagggggaggaaaagatggtgagtttggttatttttaaaaatgatttgctagcctgagtccccttccagccacatctggttttaggatcccatggattatccaaagggggtagccagcaggcaggtggtctggagctcagaggaaaactgggcaggggcagagctggtgttgaagccatgggaggggacagcttcaccccaggggagtgtgtctgtaagaaggagaaggggccaacaacaaaaccaccgtgacagctgacattgaggggcaagtggccacagagatctgagaaagggcagggaaacgggaggacaattcaacaaagcagtgtccccagaaacagagggttcagaaatcaggagtggggggttagtgccaccagggtcaagggctgcatgaagtgcgagggccgaagagtctgtgtggactcagtgggacatgggcgtggaagagcagggaggtctgaatgggaagtaaagacacagatgcgggtatgcacacagttctttgaagatgctcggccgaggagacaagagtaatcaggtcaggggcaaaaaggggtactcgcctgaggaagtaaacattggatgtccacagctcagagttagttcaaggtcacattcaaattagataccccgatttcccccggcctgctgtctaaatgccaaatcaagtcatggcttctcacctaccgcttcacactcttcacaaagatgagtgctgggaaggcggatggggagagggagcatttttttgtcagccaggggagacagctgtaccagtgatgaaaagcacctgtgacattttcaagtctctctctgccaggaaaggagcctgtcacaaaagcagcctctgcccacagtattcgctctcccactggtttcccgtgagtgccggggaacattgctacatcaccctgtgtggaatatggctttatgatcatgatcatttgaagttttctcttttcactcaagagcttgtcacaaataatagccttgttgaccccaggccctcattttctggaaaccaggctgtattttctccatcttcctttccttccagctgccttgcagcactctgcacagcttattttctaaaactcaaacaggagaaacaccaacattttatttcggtcaataactattttacacaagagaatccatagcaatttaactagagtcaaatatttaaactacaataaaatgcagtcctatgaatgaataaccaaattgtgatatatccatagaatgggatattatgccatcataaaaaggcatgaaggccctttttattgcataggaaggaatgctacaacatggatgaaccttggaaacattatgccagatgaaagaagccacctgcaattgaccacatattgtatgattctgtttatatgaactatccggaagaggcaaatccatggaggcagagagcagattagtggttgcccggtgctgagagcagggagagtgggaggtgactgcttcacaggtatgaggtttcctttggaatattgaaatgttctggatctaagtaggggtaatggttgcacaacatcgtgaatatactaaattttactaatggtagttttatgctctatgtattttaccacaacaaaaaattaatttaaaaaaaaagaaagaaagaaagcaacttcaccctgagaccagagagaaaaaggccctgactctgctcacaagaaccacaaggccttcagtgtgatgagggtttcacagcagctcttccctactttggctgcccatgagaatcatgtgagcagttttttaaagcacctcccacctcaacaccaagaccaattaatcctgatctcagggactggggctgggagcaaaatcaggagctcttggagattccactatgtagccatggttgagaaatatggctctgggctggggattctccaaatgtggttcctggacccagcagcagcagcatcacctgggaatgtgttagaaatgcagatgctagggctccgtccgtgaagtactgaatcagaaactctgagggtgtggcccagcagtctgtgtgggaacaagccctctaggagattctgattgtgcactcaagttctggcaaccactattcaagtctaggccaagtaaactacagagtttttctcaaccagtgagtattcattgagcatctgccatacgtttggttccataaagggtgccgtgaaaataaaaagacctatcccagctcctctcaagcatctggtgggttagattcttggaaaagaaatggtacattaaaatgagatcagcctttttacggctaaacaatattccattgtatgtctgtgccacattttgtttatccatgcatctgttgatggacaattgacttatttccaccttttgactaatataaataatgctgctatgaacacaggtgtacaggtatctctttgaatccctgcttttaatactttgggatctatatctaggattagaattactggatcaggccaggcgtgttggctcacacctgtaatcccagcactttgggaggccaaggtgggtggatcacttgaagtcaggagatcgagactggtgaaaccccatttctattaaaaatacaaaaattagctgggtgtggtgatgtgcatctgtaatcccagctacgtgagaggctgaggcacgagaatcgcttgaacccaggaggcagaggttgcagtgagctgagatcacgccactgcattccagcttgggcaacagagcgagagactctgtctcaaaaaaaaaaaagaattgctggattatatggtaattctatcttaacgttttaaggcaccgccaaactatttgatgttcccaccaacaataaatgtttgagataatgaaaaagctctgttatgtatattttactacaatttttaattttttatttgagatgctctgtcacccaggccggagtgcagtggcgcaatctcagcttacggcaacctccatctcctggatttaagcgattctcctgcctcagcctcccgagtagctgggactacaggcgtatgccaccatgcccagctattttttgtatttttagtacagacggggtttcaccatgttggccaggctggtctccaactcctggcctcaggtgatctgccctccttggcctcccaaagtgctgggattacaggcgtgagccaccgtgcccggccgacaatttttaaaaagagattaagccatgaaaacatggttagaaacatgaccatgtttctgatggtcaacactgaataaaaattacttcaaacaccatatttaatcatgtaaatgttatgcatataacagtgcatgaaaaagacggtatctgtagtcctttctgttcagagatggttaccagtcgttgcctgagcctggagccccctatttgaatattatgtttaagaaagacagagcaggatgtcttgcgagggcggtggctacagggctgtggacttaacactttcacatctagcacgattcctcacatgaatgggccaaggaagatgaaggaggataacatgtggtgagcactgatggggggctcaggcctggctagttttcatgataggggttaggttgttagcatgtcagcagtttgtttaacttagtggtttgctgttgtttgttgcttagttcgagagctgtttgttgaacacttcagtgtgccaggctctgcagcaggagccaggtgtacacgcatgcagaaagcgagctgacagtctagtgcagcgcttctcagcctcagcccgcagcagcatcgcctggcagccttgtccaacggcagatgctgggcgccacccccagagtgtccggttcggtaggcctggggtggggcccgagactctgcattttgaatgagttcctaggcggtgatgataatgcttgtctggagccacgctttgagaaccactggactactggggtggaaaggcagacaatattgctttgatcagtgtggctgctgcaaggaagagaaatgcaaaggctgtataggagcacagaagagggggaaaccctttgccctgccccagcgaggggagggtgtttcagggagatgtgaagcagcttggtgtgtctgcaggatgcaagcagctcagcgctgctggaacgaaaaggaggggtgggagcagacacagaaaagtccagagagaggtgggcagagcctctccacgatgaacatactctaaggtcacaggtcatgagaacctaagaggaggttagaaatggagaagcaaaagcaaacagatcgtcaccctttacctttggcagcctggaaaccccacccgcctccctgtaataaacctcatctccagaaggaacctgatgcaggccttgacaccagtgtgtaaatgactgcggagcctttttgtccccgcctcatcccccacccagcaatattagacggggattattggcggggtggaggagaaggacttcctgagggtgggtggagggctgagctggcagccccagccttatggttcacctcttctggcctccagcctgcactcctggcccccaccaccatggctggatgggaaatgattcccatctctctctgtgttaatacatccatcagtcctgcccctgtgactagagccacagagaacacagctaagccacaagactcagagggaacagcagccttcatgtcccctctaaatccatctggaaatcagacatcctcaggatggtgtctgcatgtagaagccactttttttgttgtttagagatggggtcttgctatgttgcccaggcttgtctcaaactcctgggctcaactgatcctcctgcctccccaagaggagatttggggggatttaccaagcccaagtctcaaccctccgtctccagctgacccaaacaaaaattagacaaaagtttgatgcaaagtatggattaaagcatctttagaaaatgtgtttatttttattgatctataatgtaaaatccaagaaaaagagttggcctgctatggcaagtccagctttgagctttattcataacaagtaaccctccccttctagccctccctcactgtcccgggaccacctctgattcagtggtgatactgacaaaggaaaactctaacgctagtttgattcctcgccctctgtttgtacataataacatcataagacctcatccatcaattattaacccatgtccttggtcacctcctttccttctgggcaggacattggggtttatgactgtgcctctccgcctacccagcaggaaaacaggtagaattcagcaggttgtggccttctgtgcggtgggtcaacctcttaccaaggtgatgctgtgggaaccacactactgactggctgaacccactgggtttttatgagaagacatagatattttaatcagcttcagaagtgaactgcaggacctataaatatattttaaacatgtttttaaaatgtagcttctaggctgggtgcagtggctcacatctataatcccagcactttgggaggctgaggcaggaggatcatttcagcccaggagtctgagaccagcctgggcaatatagcaagaccccatctctttaaaaaaatggcttttacatgcagacaccatcctgaggatgtctggtttccagatggatttagaggggacatgaagtctgcggtcccctctgagtcctgtggcttagctgtgttctctgtggctctagccacaagagcgggactgttggatgacccccagagagaggcaggtactagcctcccaacaggaagacctttctaacagatggaggaatgtacacaagcaggtgtcaaatgatcctagctcagccttggcacagggcaggacccagacctggcaaagggaggccggatggatcccagactctttctgagtcaatgcatcacacatccctagaatataccagcctctccactgcagcagggcctctgagcttgctgggccctctctagtgaacgccattcctcacgtttcactcatggttggttctacttgtcctttaaatctcagctttaacggcgcctcctctgggaagcctgcctgcatcatctgcttgacagggatccctccatttttctgttgcagccctcgtttaattcctttgcagcgctcattgcagattgcaattatttccttgtgcattggtttacttgttatttattatcagtctcttacactggtctgtgagtgccgcaaggtcagagactagagctgttttgttctccattgcatcttcagcacctagtacagtgcctgacacatactagacacatttgttgaagaaatgaatgcattaactccaaaattaaattgcactccaagaaggagagcatttagagatttttctccttcattcaacatttgagtactcgttttttattgcaaatacaatccatcttattaaatgtgtattcaaatttggtacataatttttgatcattttcatatagatacacatgcctttcattatggtcagacctccttacaaaacaaactttgagggactaaccaaaagctatcattgtcctgaaattgtgcctatttgttgaaaaagggcgtgtcatcatctagaatgtgtaaactttgccactacagtggtatcctttggggcaagttttgatctgactgcgtgttggtagccggcccaaagagatgtaccctggagcttgggcccaggcaggttctccaggaagctgcctgcagtgagcactgacacagacacaggggggtccacctcagagtatgacctccaagaagtgtcatggggcagaattaatgttgactctggtgcctggatccccccactgtcttctcatggctacctttcatcagtgagcccctctttcttctgtctccaaccttccttctctggtctcttttgccgtctgcatagcagtttgctcaagcctcttcataaaaaacaaaaacacaggctgggtgcggtggctcgcgcctgtattcccagcactttgggaggccaaggcaggtggatcgctttaggtcaggagtctgagaccagcctggccaacatggcgaaaccccatgtcgactaaaaatataaaaaattagctgggcgtggaggcacgcacctgtaatcccagctacttgggaggctgaggcagaagaattgcttgaacctgggaggcggaggttgcagtgagctgagattgcaccactgcactccagccttggtgacagagcaagactcagtctcaaaaacaaaaacagaaacaaaaaacaaaatctttcacattaccctcaccttaccataaccaccacgcatacacccttctctcatccctttatggctaaatttctgaaatgagcttaaaaaaaccctccacatccattcaaggatgtgttcagacataagtagggatatgacataaagttctggtcttccaaaggtctttgaaactcatattctgagctctagtctgtaataagtttctgtactagtctggctctaacagtcacaggtgaggcaggctaacaatcatcactgcttgctagtgtgcacaacccgagtaggctggccgagaagttcaagtcagggactagaaagcactggggtagctttggcaggacctgagctggactttgaagagtggacgaaatttggaaaggtgcagaggaaagaagagggcatttgagcagattttttcataacggcatttgtgaaggtgggttggcatagcctgttcttaggctcagggagctggctgaagcatggggcaggctggggcgggatgtgggggcctttgaagactttgacaggttggggcacttcaaggccatgaaaaacagctaggctgtgctttgtcttgttggggtggggcagggcatgctagggagaaagggagtgtacggatgggtggtggggtggtgccacccaagccaggctatgacaagattgatctggttactgcaggagagccagcctggcagtgtaacaaggaaggctggggctggttgcctgtgggaagcctttgcagtgtgacatggcgagggcctaacccatggaagcatgggagtccatgacccactaagggcaaaggatagaccaagctggctctgagatgttgagccttggaggagcggggcccaggtgttctctgatgaggcattccaccatcaagctgtaatctaggccataacacatcctctaattgcaatattgcaaaaaatatatggactgtatgtgaaccctgaaatttacaaactgttaaaaatttatgacctatttggaaaaatttgaattctaattggattcggtaatcttaaggtattaattcttaactctctaggtgtggtcatggtactgtggttttaagagcccttatgttttagagaaacatatgaaatatatacagatgaaatatatctggatttgtttccagttatccaggtagataaggggagaatgggcttagcatagatgaggcaggactgtttctgaattgtaaactgtccaagctgggtgacatggggttcattccactcctctctctacattgtatacatttgaaattttctgtaaaaacattctggtccttggataatgcaggtcctacaccctgggcctcaaaattcccaatcagaaatcacgagaggcattttgagctgtgccatgttaatctcttgttacctttcgaaacaggaattctgaccacttctgttttgcctagagcaggaaaaacacatagacaggaaagaaataatgccttggctttatttagaaaaacaaactgtgaaagacacgtgatcctcctgtatcacgatcatgggaggagtccaaccaactggagaggcgaagtcaaaactcagaagagcaaaggcaaagttttagctggaaataaatgcttcttttaggagagtcactcccagtggaggatttctggcagtggagcacttggcatgagtgtgaaagctgacactgagttggaaaatggtagcccagggtgtagcggccagcataaggccagcactgtgcagtcacatgtcacagctcagggaacagaaaggcctgctgttgtcacctctgatattggttgtcccggtgcccaccctcatggcacctctatctctcacatgccacaaagacaggaggctgctctgacagtgtccccagctatgcaaggcggggacacccactagccattacatgctgggggagggccctatgaacttccttggcaggccatctcccaggctacagggcagaaatcagatttctttttcaattagtgcccccaaacagaaaccatttgcacacaggtaagctagaaagctaggagggtacattttgaacctgagcaagtgatctcatttttcctcctcttttttgaggagaagaaatacatgagggaattaaggtgggtgcacgttccctgggaaaggaacaagcatgaaacaggtgttgagagttcagcttagtaaacatgtgagggcccactctgtgccaggcactgtgggaagtgcagcgatggatgagccgtggtccttgtcttcaaggacagcgtggggaagccaggaaattccaggtgcacaaaatctcctggataaatactgaaggacacataagtcctgtgacccaagcaaagtaactgttacttagccaaagtcaaacttccggcaaatcgcttaaatctctatttttcacccataaaatggtgcaattctgccttgcttaccccgtaaggttatagagttataaggatcaaagctactacaatataataacaatgaggaggaggaggaggaggcgaagacaaggctttcttgaccttgctgacctacagacctgtgactggtgcccaaggacgaactccgctgtggatggcagccaggaccagggcaggttcctgatgcagatggctgtctgatcccagccagtcctggagcaccggtgccctgtgccctcattcccgaagctggttcccctgggcaccttgtcacatgcccagtagctgccttgacatgagcaacctctctgactcattcaaatttgcctgacagatggagaaggtgcttagtcctagtattcttaataaatatcagagcttaagagccagaaggaaccttccagaacatagcttccacacacatcccatccccaccactacgcccaccacccccaccatttgcacgaagggcaatggaggctccagcagggaacataacccactgaagtgttgggacagctgatgctggaatctcattctctggactcccctggtccaacatagctgcttctctttccaagacaggttttgccaacaccaactctactgcctttaatatccttagtctttcctgccccccaaataccttatttggtcctaacttccaataaagcgtatttagagcaagagaaaaaggaaacattccccaagtcacattttcccaagccctctgttctttttcactctttgggaaaatgtttcctaaatgcccatgggggcacgtgaccctacttataatatgggttcacagagacgaagatgaggggtccctatcttcacgaggctctcgtttagctatcagtaaaatgccctcttgatgaaacctttttgaacctccactgtgggaaaagaaaacccttctaatccagttccctttagtcatgtgtgcaaagagaaagcttctcaatgatgcatctctttacttcctgagttttttgcattcatgcctgcctggcagcttccgccctgctggctgtgggcccaggcagtattgtgagcacagaaaaggctggcagcctcacttagggagtcttaccctgtgctgtgtctcttcctgaccctggggttctacatgaggcctcacggttgcttcattctgctccccgctgcccctaaagcattcggtttggcccccagctgaataattgtcttactccagtttggccctggagtgcctgctttgatatcctccagcctccctcttccctagtcaccatcttggtgtagttgagttattttgaggccttgaaaataagaatagtagagctcagcggagactctgccatgcccaagtgagaagactggtgtccagtgaaaggttggactggagattctgcaattccgtcatgctgtaacatttctgaaaatgcatagcctaaggttgacagcctgaaaaatcagtagggttccgatgtgtgtgtccggacctagaagtaagaactaactaagcctgggaccaacgcctcatagcatttgaaatgaacctgggtaccaagtatcacttcggattcttcccactctcagatacggtcccctagttagagagcacgatgtagggggttgggattctgtggggccaatataacatttacacccttgtgaaacagtgcaggggtctacagaagaattcccagaagaggtggtgttcctttccccttttctctatttacccaccttccttgtgttgaaatactgatgaacggacccccagatggcaaagcttgatccccagctctgatagagcccacaggacaccctgggtctaccctaacgagccatgacatgccaattctttgcttttctggagaaaccttggcctgaaagtctgtttaattaccgtggagataatcttttaaacatagatttacattctttaaagactttttccctgtgggagtaggaaagttcatctgcacatagcatgtttattttcatttccaggggaggaactgctatctggtagttagcaagaagcttgagccctggaggaatttctttttttaaagtctgttcctcttcactgatagtgtgtcaattatattgtaataattagtttatagtgtggtcatatttttttccagcttaaactctgcacttcactctgtgattccaggcctataattatttaacatttgtcaatcatccctatcagattgggttctatagttactctaaatgtgggtatcaagagtcaatgtcctcaggggtttctcttcaggaaggtcatacttgcaaagccagcagccacaaagacctatttaggttggtgcaaaagcagttgtggtttttgcctgaaaggaatggcaaaaaccgcaattatttttgcaccaagataatacttggcactgtggtcagtaagacactaatttttcccacctggggtggccccgcagatttgctaaattcttccccgctagaatgccagcttggatgagcaggggctctattgtattcaacctggcagccccaagacccagagtaattcctggctcataataggtactggctaagcagatgctgaattgctgaaagtcaacaggtcttgacgtgtgtgtcaaacaggaacaatgtacaaaataaagcagagttcggtggccttctggctctggcctgtgcagccctagtccttctttccccacatcacttaagagcaggtggtcctgagtggttgctggacctgattctggaggccaagactctgagccttgaagatttacctccggggattcagaaaagaggagaaaaggagtaattgtattgaacagagaattagaagataaggaaaatccctttgtgagaaactctaaatcttgagcatggatctctgtgtccaggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcaggtgagggagaggccttggagacctgaggggtatgtctgagtctccctcagctgccaggcctgtccttttccatctggcagggaggtgttccgtggaagcatccaggaggaggggtggggcggggcgggggtgtctttgagagattccaggagcactctctccaggggatgctggaggctctgggctctgaggatcctgccagggccgcacttcccagaagaagcacatctctcaggatggggcaggagaccggcctgagcactgtagttcattggctgtgcagctggagtgaattctggaccataaacgattcaaggaaccacacagtttggcggggggtgcccaggctttggagtcagaccaacctggatttgaactctggcttgactgcttacgagccatgagaatctaggtgagaattttagtctccttgagcttccatctggaaatggacatattgatggataccgtgaagactggagattatgtacgttggggtctggcatacagagtgaagtaaatgcttcataaatagcagttatcgttgctgttgctatataattctaaagcttggaaggtacttcactaaaggtgtctgatccatcaatatgtaaataaacacccatccgttggtctagtgttagcgtttctggcatcactttccaaggtgaaccaagaaggtgctggtgccactggagttgctttggggaaaagggaacattctcagggaaagagcccaggtgtctgacctttaggctgcatctctgctccgcacctcactccatccacctgcctctctctgggctccagggggtggcagcaggggtggagggagcattgcctacctgactgctctctggcagtgcacagctggccggggctctgaaggctgctcctccactccccgcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgaggtaagtagggctgccagtctggcagaggctgctctgcagtgggtggtgtggcaccttctcgacctggctgctgtgcagataacaccagagcatgggacaggctgccttcaggctctctgccccacctctggccctggcacaaggggcgcagccactccactagcctgtagctcatctgcactgtcctggtccctttcttctcctgaacatgctaagtttgtccctgtgtcttttactgagtgatgctgctggggaggcagtattcccagggtggcccagtgggacatacatgcccttcttttagacattgccttcctatctgtgcagataaaaatctcctgctgactcacactgggctcactgctcccccaaacttctcagcctttcttcatatgtcatgctgtttgcatcattttgatgctatctttccctctctgggcatgggttgtgtttagaacatggggacatgggtctagggccacccttctacctggccacaagtctaggggtacctggcagtctaatgtgcagggcatcacggcaagcagactcactagggacaagatgtcagccagcacagcatcgtgtcatgttgccttgagaagctactccgaaatgccaaaagaaaattagaagacgggcagagcatttgtcctatgcaattgcaggatggggtggggcaaggagggggttgagatgctccattttggcactccaatagccctgaactgggggtgtggctctgaatatttacagggaaatacaagcagataaatgctgctgactgatcagccaggggagtccgtggtaaatagagaccattcccctccagtcataactgctgaactgcttaatgtttcagactaatcataggtctacttgcaagcatggaagggataggatctggttcaataggatggtaccactggaggttcacatatttcagagcggcccttccctgaagctcaagaactgaaatttcctccaggctaattgcagtgttgagacttctgcttcccccatggggaataaagaaggtgtaaaccaaaaagtgtctgagactcaatccatttagaagtttattttgccaaggttaaggacacatgcccgggagacagggagacaagtctgtgcctttctacaaagatgattttgagggcttcaatatttaaaggggaaagggcagacactggggaaagagggagaaatgtttaaaaggtgtggggaggtaagaggcaagaggtcgcattcttctgagtttttgatcagccgttcacatgtgagagaggggtagaggaatagtcacttgtgcattcatctagctcagcgaatctgcattcttacaaaataaaacagacatgggcagaggaagcaattagaaatgcatttgtctcaggtgagcagagggatgactttgagttctatcctttgtcctgaacccatgaagataagttatccatttacattgtcacggtgaaattcaacagaactgttttagggtaaagaccttgcggcccacagtgaatttcctagtgggcaaaatgtgaggtgtgttgcttttttatctttgtagccgtcttatttaggaatagaatgggaggcagctcccagcttgacttttctctttggcttagtgatttgggggtctcgagatttattttcctttcacaaaggaggttagggtgtagattggcagggtttatgtgttttaaaatatttctacttcttgtattttctgctattaagtcacagcatcagaccaagagtctggttaagatggaccataaatgccaatactagagaaaaggcatcagggtgtccctaaagtgggtcctctaaggaaggaccttggaagtgtagtggttctttgggatggagttcatataagaagattctggtggggcatgttggctcacacctataatcccagcactttgggaggctgagacgggtggatcaccggaggtcaggagttcgagaccagcctgaccaacatggtgaaaccccatctctactaaaaatgcaaaattagccgggcttggtggcacatgcctgtaatcctagctactcgggaggctgaggcaggggaatcgcttgaacctgggaggcggaggttgcggtgagccaagatcacgccattgcactccagcctgggcaacaagagcgaaactccattaaaaaaaaaaaaaaaaaaaaaaaagattctttctatcttaatctcctcaacagggagctcctttatgcttggattagtcttcacttcctctgagcacaataagaaaagtacagacaaaccacaagctcaaaggtcagctgtaaaaggaaataggggcttaggacctcaggggttttaatcatatagaattcagctctgtttctcaaagtgatgccaggccgagatggtgtgggcagtgtggcagactaagtcctttgaggggaagatggtgaagtaggagctctgaagaaatccttaatagaggaccacttaaaagaagaaataatttgatatataattttttttaagttagaaggagccacttaaagttcgaaatgggaaaattaagctgtattcaataacatatgttgaactgtatttataaacacatgagatggaaaaggatgaatgaaaagagaaaagaaatagagttaaaatctcaatatgtcatagtctcaaggacaaagaaccagcaaaaatgcatgggttgtgtaaaccaaaaataaattctaagccccccaccccacccacctgccatctgaatggacctctcctcttgaccaagggcattccaaagttaacatgaaaactagttcaggccatgatgggaagagggagttggacatgacccattataccctcctcccttttggaatttaggaaaagcccacattcattaacatcaacacagaccttaggtctgatcagaaatatttacagtctattctctctgaagcctgctacttgtattcttcctctgcatgataaaatcttggtctctacaaccccttattggaacccagacattcctttctattgatgataactctcaaccgattgccagtcagaaaaaagttaaatctacctatgtcctggaagcctccaatttgagttttcctgcccttccagatcaaaccagtgtatcttgtacgtattgattgatgtattatgtctctaaaatgtatcaaaacaagccatgccctgaccaccttgggcacatgtccttatccttggcaaaataaggggagggtctgagagacctaacctagtctggggggctgagggggctggggttctgtcctcacagttggagtcaagtcttctgcagaagcgacaggctcccatgagtcgcttatctcctaatgggtggcttctcccccactgcagctgcacattgtccattataactcagacctttatcctgacgccagcactgccagcaacaagtcagaaggcctcgctgtcctggctgttctcattgaggtaagagatatttaaaaggttcttaggtgaaatttgaagcagggatgagattgggattccaccttttgttccatgcatacctgttgataatcagctgttcctgtatcgactccgtgtcaactccagagcagggggtatcctcctgtagtgcaccttctctcttggcctggaggcagcactttctgtgcctgggcagcagaaatggggaatgttctttggtccgttggaaaaacgggccccaacatctagccctgttgcataaggcatggaattgcccagttggggaggacctgtgctggaaagggatcatcaaactccatctgccccatcagatgcctgaactcttgatacaactcctgccatccaagctcctctagatccaagggacctctagatcagtggtccccaacctttttggcaccagggaccagtttcatagaagacaatttttccacggaccatggaccagggagggagatggttttgggatgaaactgttccacctcagatcatcaagcattagttagattccgtaaggaatacacagcctagatcccttgcatgcgcagttcacaatagggcttgtgctcctatgagaatgggaggcctctgctgatttgacagggggcggagctcaggctgtaatgcttgcttgcccgctgctcacctcctgctgtgcggcccagttcctaacaggccacagaccggtactggtccacagcctgggggctgggcacccctgctctatatgtaccctggaatgaattctttttttatcccaagatagaggaatgtcttctgattggcttgcatgtttttttttcctaatgaggctgtatgtacctcatttcccaacatgctcatttgtctgacgtggcttttgtgaactcagagctccttaagttctgtgtgacatggatgttagtcaaagccttcaggctcatatctggatcatcaagagcacacacggtaccctatgccccaggacattcaagcccaactccttaagctgaaaacaggacgtcctgagatgcaagaggcaggaccattacactaactcccaagagcctagtgatccatcataattgtccagtaaagtggatccttcaggcagtggtggcaacatacccacagctttgcccttctgatagcaatcgtcaatcctggctcagcctatcctgttctgtcccagtttaacctgccctgtctctgttgcagatgggctccttcaatccgtcctatgacaagatcttcagtcaccttcaacatgtaaagtacaaaggtgaggggtccttgcatgcatattcactctctgctggagaaggaggtagtcagccctgtgtgactttaagaaaagcaaacacaaggggcaggtgctgtctgtgttcaccaggttaagagcagcaggttgttgaacaatgttgcaaccaggtcctggggttagatgaccctgaaaggggctagttcatgtttctaggctcagtcgctctgttcagctgcacttatgccctacggagggaggctgacactatcacctctgcaacatgtctctctaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcaggtaactgtcgtgccagactcagccagagtccacgcggcacctcagtccccatcatcctccatatcacaatcaatgacttgatttcctcatttagtttcattggcagctcttcaaaacctctccaaatatcacaggtgtctgaaagcaccgcagaaattccaggctgagcttcaaaagaagtcaagctaggcaaatgaatagatgtctcctagttcttttttaaaaaaaagagctctaaatctgcatttgctaatatatcctcagtggctgggtggtattcacttcccaggcaggagagagcctggttcctttacagggcagaataaagacaggatcagatgaaatcatttaagagatgggattgcagcaatgactaagtgagggtccctgcccccaagaagctcaaggtctagtgcaaactggggaacaaaatccttagccatcacctctaaagcttcttatttgataggagatgagagagaagagtagaagtctgtgggatcacccgcgggttagtgacaaagctgagacccaaagttaggtcatctgagttccatgtcactgctcatacctgtcctccacagcctaaattcatgagaagaaaaatggctccccaggagacggggctggggccagcactacaccctggctcacagccccacgccagcttcatgcgtccagggcagcctcacagctgctcctctttacagtaagcttctgctctgagtcacctggtaaatggcagcaggtgggtggacaggaatgaggacatgatgaaccaagagatggatgaaacatgtggggaagcagcaacatcctacctcagaaactgccttgggaaagggttatataatctatgcaggtgcatgaaaatgccatggaacccgcaatcagatggcctgtgaaactcttaactccctcctttattccttctgatatgaccatcagaacaagccctgcgaccctctggttgagagctggcctctaatttaagttcatgagaggaactcagtctctgtggaggttaaggagcactccatcaccccaggtttccctccacgcagggcagattccaggtataattggaaactaacagcactgcctttccctgaagtctcgggtgctgggaagataaacccagcgctgcccagctcccactcacccactgtggagggaagcagttctgtggctttccctctgctttctaatatctcccacccggccccacagaagctggttccagaggcttctcccaggtgcaagagcggagagctagcctcttcccaggggatcaggtgaggaggtcattctgcctgcgggctatttctgctcttgccctcagctgctggctttggagacagccctgtactgcacacacatggacgacccttcccccagagaaatgatcaacaacttccggcaggtccagaagttcgatgagaggctggtatacacctccttctcccaaggtgaggagaggcagtgctggggggagggggtgcgggagtgtggtgccaagacattgggatcttctgtgaatgcagctctggcactgatgccctcaagaagttggctgagagctccctggctgccacgggaaccaggcgccttgtgagactaggtgtggggctcactggggtccccccttcagtgagtctttgcagagaagcaaaaagccgaggcccccaggcacatggaccagagcactctttaagcctgggagtcttgcacagatgggtaagagagaattccctggggacttctctgttccagacaatgatcccttctctaagacacaggataggaccctttccatgagatcagacttctaacttccctccctaggctttcttggcatcaaaggctgcagccagcctatcttaggcctggccaggtgattcatgcaccaccaccaaatgagcaagaatgttcctatgttagatgtaaaacagtgagtgtaacccacaaccatgtctaatgtagcagggcctgttaggcaaggaagcacccttgtgcactgcatttttgtctaacctccttggagcttgcataagcacaagcacataagttcccaattgaacaaaacttaatagcttggtttcttcctaatgctacaagggctcgggtctccctttcacagctgtaaccaataactccccagtagaacattaaccgttttccttgctcagtgcctacatcaacactgctggaaactgggcatcaggggaaaggggtgagggagcacttttggggcccacacccctcttcagacctctgagttcactttcaagctcactttcttactgtagattctcgactgcttcccagcttgggaatcttcatggctggtctgtgcagttccatttcatccccagcatcacgtgtggaccaaaccgggcctggcgttcatatttaaagataacccgttctcacctgcaatcccagcactttgggaggccaaggcaagcggatcacctgaggtcaggagttcaagtccagcctgaccaacatggtgaaaccccatctctactaaaaatacaaaaattagccgggcacggtgtcttgcctcctttgggaggccgaggtgggtggatcatgaggtcaggatttcgagaccagccggaccaacatggtgaaaccacgtctctactaaaaatacaaaaattagccgggcgtggtggcacatgcctgtaatcccagctactcaagaggctgaggcaggagaatcgcttgaacccaggaggcagaggttgcaatgagccgagatcacaccactgcactctagcctgggtgacagggcgagactccgtctcaaaaaaaaaccaaaaaacaaaaacaaaagaaacccgttaacccacttgtcagaatctgctctcctcgtctcacctggtgcacttttttgggttcctttcttattatatgaggttataacgatcacctcctaaacttagttgaacatatggagactgtatttgaaggccctttccaggaagctttagaaactgacccatccttacggtcaggattacatcattctctgtcttttcatgaagaactgcccaagaatttgtcttttgtgttttctcctctccaggtacaactaattaagatcatttccctctttcctcagtttctcagttggaaaacagaatctgtgaacagtagccttcctgaaaattcaaaatccatgtgatgataactaacagtttcttttctaggaaatgaactgagtgcatggaatgtatctgttatggatacaacgctgtcttttctcattcttctaagtggagaatgtagtatccaagggttaaatggaactacttcaactcttaaaaccaaaaacataaaaactctgccaggagattaggaactttgcccacatagatcagatagaattttgctcgcgatcccaggaccccattgccggctctgttctctgagctcacctatgcacacccagggaaggggtggcacatattctccttacagtcaggaggcctaggttcaaggcctggctttgcttcctcctggctgcaggctgtggacaaatcgtgtcccttctttggccttggtttcctcagccacaaaatgccaggtaatcccagctactcaggaagctgaggcaggagaatcgcttgaacccgggaggtggaggttgcagtgagccaagatcatgccactgcactccagcctgggtgacagagtgagactctgtctcaaaaaaaaaaaaaaaaaaaaaaaagccaggttggattaggtgatctcatgtcctttcggtgctaatatgttgtgatggttaagtggacactaacaactgccaatcctgactttacattgcagggacagtgtttgagggcagttacagaggatcagaagaaaccgggcaggagcttgactctgacatccaaaagtaacccccgcttgtaacgatggactatggcattggggataattagccatcttcttagaccggcttgtgtctaagcagctgcttgtagtggggcagcgtaggcaggtttttagccaagcgcttcagtagattctcccagtctggataggggagcttgaggggcctctaagcagaagtctggagaccatctcccagcttaggacgtcaagatcaaagcccaaatgcagcgttgccactgctcttcctccacggtttgcccagagctggtgcttccacaagcccaggttgggaccagctttctcctctgagtgagactctgtggcagtccaaggaaaacctgtccatctggaggctgattatagaagcttggccagaattctcctcccctccctttcacttcccaaagacacaggcagcaagtgcggctgcttcccaaggagcaatgaggaggcagtcccaaaggggtgaaggcccaaacctcatctgcccagggggctgcattcacgaggcctttcttacccagctcggagcaggcctcagactgtaacatgatgtttcaggtttacggtgtgagactttgtcagtgtgaaccttgagcagtttggactcaaattgtagcctcatccactgaggcatgtttgtaattagggtctggcttactcagggctttctctggaagttaacaagaactacagagtcagaaaattctgccaggagaaaagtgatgtttaaaaaatcatctaggatggccgggtgtggtggctcatgcttgtaatcccagcactttgggaggctgaggtgggaggatcacattagcccaagagtttgaggctgcagtgagccatgatcacaccactgcactccagcttgggtgacagagtgagaccctgtctcttaaataattaaaatttaaaaattaaaaaaaaattccctatgagagaaagtacatggactttggggaaggatctgaagtttagccaggttgggacaatttggaccgaatcatttaacttaaccctgctattttcctcaactgtgcttagaaaaggggtacaggacctgatttctgtccttaagaggtttatagtccagctacaccttagcctgggggcagagtttctcaaccttagcactactgacaacttaggcaggataattcttacagtggggggtgtcctgtgtgttgtagcattggcagcaccgttggtctctacccagtagatgccagttgcccctccccagttttaacaggcaaaactgtttccagacattgccaactctgtgcaggcaggaggggcaagttttcccctgatggaaaaccactgccccagggtttctgcggcccagaactcattgttttcactgatgtcataggagtctggagttttatatcacatgccctggtcttcattgttttatggcatgaacatttcagtgtgatgatggttatccctgaaacagtaaggctgaagttactgaggcagaacaaaccaacccaagagagaccttgttccccatcttcctttagaattcaagtatagattcttttttatatgattgggtaagaccaagagacgtagcgtgagagagaactgtgcacccttaggagtgtacaaatcctttatcaggggtgcagatgcctctgaagtagcaacttcttcaggatcccccctttattctttttctctctcccttttgtatgagtttttctctcttgtatgttatgtttcttgttgcctttagttaaaacgtccactctttatggaaaagtgaaagtcatgtcaggcacttttttccattcttaaaaagtgcctcttccattggctgggtgtggctcatgcctgtaatcccagcattttgggaggccaaggcaggtggatcacctgaggttgggagttcgagaccagcctggccaacatggtgaaaccccctctctacttaaaaaaaaaaaaatcagccaggcatggtggtgcatgccagtagtcccatctactgtggaggctgaggcaggagaatcacttgaacccagaaggcagaggttgcagtgagccaagattgcaccagtgcactccagcctgggcgacagagtgatactccatctgaaaaaaaaaaaaaaaaaaaaaaaaaaaaaaagtgcctcttccaagtggcagttggaagatttgagctgaaggagaaagcaagactcgtcctcaaggtgggcccctgggaggggacacgtcctcaggccagttcgggtttcaagtcaggtgctcttagtgggaaaggggaaagacggcagaggcagggggacatcacaggggctcaggcttagggctttggcctggttcttggttcctttgagttcacctcctcctagccagtggcaccaacactgggcccagatgctgggtaatgaagcaagagcccatcagacaaaaatgctaacaccatctagccctgtgctcaacatgtcagggccatggaaacttgagggacaaaaggaagccaagaagtttctataatcacatcattagtgggcttgctctaagcaactgcatgtcacccaccagagcagctatggcacactcagacaagggtgccaggcagcaaaccgcaagggcaaatctatagtcctgcaattaggatctgcttaagcctagacctgggcaattttatgaaaccttaaaaggagggagaaggaaatcagacatggctaagatggctaattatctaattttttgaggctagaatgcatgtgttatcattattgaccttgtatttcttaaagtttccatttataagtaaaagctattagctgaaagaatatcatcgattctcccaaaggatccaaatgattagccagcatcatttccaccttcagtcgctggtctgggtcagaggccgaacagtcaggagcattggtccaaggtgctaagaagtgaggtcctagtgcctttcacacaccacatgtttcccgagcacagtccgagttatgcgctatgggggacagaaaaccccatggtgggtgtcatcttgctcttaaacacagcccgtggcacagggcagactatgttcaggaaagacaatgggaaaaggggctgggcagacggctggacccacccttggtgatggggccctagccgatccttccacatcatctccccacagccccatccctgccctcttagcctcagcccccaaaactgtagggcagatgctttcaagtacacacacttgatgtctgggatgccccctccctcctccatctggaaaattctttcaagacccaactctaatcacgtcctcctggaagtcctccccatccctctaaaggtgacttaatctccctcagtgcagccagaaccacgtctccatctctgttatgttacttgacacaccatagagtaattattaccacacagcaaagacgaatagaaaaagaacaatacgtacatattatacacatactacaagctccttaaggccagggatgactgacgtgttactcatttttatgcctggcatggtgcctggtgctcaatataagcttgttgaaagaatgtccctgacccatctccagttccctcccctcctcagtgtcttctctgcagaatgatttacacataagcctggccagttgtcaccttttcgttttattgtcttgtttttctgtggtctccatttgctaacaatgttaaaaatcaaccatttgtttaagagagattaacgatcagaacttagctgtcagttttgaaggtctgggaggaagttgcctagagatgctgttgtgccttctgtagctctggcttgatagggatcaaaggcccccgtcccaccacccattctttccccagggacagtgaagacagcttagagtgccaagcaccaagtgccagcattgtaacctgcccctgaggctctgggatttaggcccttcagagcaacgtgctgtctgcaggggctgcattcctgtaatctacaggcaaagccctcagtcccatcatagctgtataaaaccagttcccccatgtaatctggtactatcttgttggcagatttctttgtagcaattcttgttttgggttgcatagcgttcataaggaaaactccgcagttaaatatgtcctctgaagatggctccactctgtggtgagggcatcttccttgtcttggcaaagcatcatctgaagatagcactggatttgcagtttcttgactctctgattttttattaggtgtaataataaggggctttttaccttcctaacagattttgtgtatttaaactatcaaacccctgataaatctaaactctctgacctcttttacaaggctggagacggctaaggatatcgctacgtaacatgccatctatgtaaacagtgtgtactttaaaataatacttgaaaaggattatagtccacagtcaaacagaatcgtaaatagagctagaaaatactagactgttgttccaggaacctccagatgtgaaagtgaggtgcttgttcctcgtgctggactcttctgtgtttatgcttgaggcttcagaagacctcaaaagcccttaaccagcatccctcagtccagcaagatgccggtggaagacgcagctcctgggcctgccagaacaggtagcaaggcccttgtggcaagcagctcaccgaccttctccgggtgtctgtaccttcctgggcaaggtgtgtgaccatcgagttcttctatatctgtgtggtttccttgtgtgtgtcacactgccgtctctctgctcgccctgagtcatacccgagcactttgtgaacaggcggctctcccacgtcctcatggtgtgcaccctcttaccagccagccccagagctccttctgttgggctgccactcgatgcctctcgtgggccacctctgtgacctagcctgtctccatttctactgtctgtcccattgttcttccgtgggaatcgcctcccttctttcctattcagaaacaaaccatttctttaacctgaaagtgaatttctctagttctgcccctccctgtaccatctttgatgcctgttctctacagtgcctagaggcttcgctctcacccagccgaggctctgctgggaaacaggctttggcttcgcactcaggttctagttctctggttgccctgacagttctccctgtgtcccgaaagtctcgctgactttctctctcccatcagataacagatgttttggcatctgcctccaatgggactcaagcccatttctgcaaagaagctgagcctccatgatggttggtgctgtctcgattggcagggacagcattccaacaacaccttcctgccctgggcttcctgaggtggtggaactatcgggtgacaccctcgccggcattcctcttccttaacagcttatgatgttggctcagtcaagctgcttcgtttttgctgtatcaaagtcttggctgaaaagtatctgtcccagtctctgggcctttctttgtcttcatgcctgtttggtctcatttcgttgtttccaaggagagtccatttaggccttgacaagtggtcctcaaggagcaaagatcccaggtcacagcactgggttcaactatgctgttgcttacaggacctccaacaggaaccccgcgtaataaccgggggaagccagactctccctccagagaagccaccacgcagggcatgtgccctgagaaaagccccacccttgctggggccttgctctccatagactttgctcagctccccaagaccaggcatgaagggtacccccaccagccacagactgggctgctcagtggtctggggcctgtgtgactctcagaatgtttgaggtgactgtgaaagagatgactttagaaaccatccagcctggatggcttagccaggtggtaaggcttcctagtaatagtcttcaggtggcgagaactggtttggcaccacaagcatctggagcttcaggaacaaagaacgagagtgtatttcatcaaagggttgggaagaaaaaccatggctaggtttattatgtttgtttttttaagattccagggaccatggtctctggttacatttaaaaaagaaacaaccaaccctaataccaagttccactgtgcagaggccacaggccctgcaggaaacagagcttgtgctgtacaaacactggaagctccctccaggtggagactcatgtcctcagtacctccccaagccacaggctggtccttgtgttcaggttacacgaagaggcctggggcagggagtctggccagtggagccactctgccacttgggaggtcatgagcagctggtggtggtgagcagagtagggagaataggcttccctgtccttggggacagctcttctccctgcctgctctgctaaccctcacagcagcccggtgccacctggggaagccagaccaggaacccccagggcccagccttggaccagggaggctctgcaggttcaatgtgagattgcagaaaaagacaatcggaaaagcacacggctgatggctcctggggaatcagctagacttgggccatacgacaggagaaggggcagtgagcaaaacctcaccctgcagcctcagatctggttccccaggctgttaagggccccaagggagagtccttggccccctgctggcatcttacacttgaccagggctctcccagggcctcagccaccactgtgggttctatgggcacaggatcttctgtgtcaggctgggtggccaccatctgtacaactgtggctcccagtgtgagttagaacaaataccccttcttcctccaagacacacacacatgctagaagtttccattgagatgagaaaaccaccagacagaagggtacctgtaaatctacactttctttagacaaaggacctgattaggagaatggggaatggctgtgggaaccttggaaaaaacaggctgagggttttcaggggagacttcatgactgggatcctctgctcactcaagacaatggattctcatgtgattttccccccaggaggtggctagtaggctgactgtgagacttaggtagctgggcacgggttcagccacactgaggacttctctctcaccttatttatcctcaacagtaacttgctggttgaagccgtaataccctggttccatggagcagagaagtggggctgatgtggtgaaggcgtttgtccaggagggacaaagcaaaaatagaaccaaaccatgatgacaagctgatgggctgggggagaagtctggtgatggattccttgcttaggaagtgaggcaggtaccagggacatggacaggagcctgcccaagcaggctttgatccctacctttcttcatctttcctctttggccatgttgtattaaaaactgaaatcttggctgggcgccgtggctcacacctgtaatccccatagtttgggaggccgaggcaggtggatcacttgagatcaggagttcgagaccagcctggtcaacatggcaaaaccccatctctactaaaaatacaaaaattagccaagcgttgtggtgcacgcctgcagtcccagctgctcgggaggctgaggcatgagaattgcttgaacccaggaggtggaggttgcagtgagccaagattgtgccactgcactccagcatgtgtgacagagcgagactctgtctcaaaaaaaacacaaacaaacaaacaaacaaaaactcaagtgaagtcttgccctagccaggaaactgttgtgataaaggagcatcggggccgggcgcaggggctcacgcctataatcccaacactttggaaggccaaggcaggtggataatgaggtcaggagttcaagaccagcctggccaagatggtgaaaccctgtctctactaaaaatccaaaaattagctgggtgtggtggcaggtgcttgtaatcccagctacttgggagactgaggcagagaattgcttgaacccaggaggcggaggttgaagtgagccaagatcgcaccactgcattccagcctgggcggcagagcgagattccatctcaaaaaaaaaaaaaaaaaggagcatcggaaggagggattgcagtatgaattccctagatgggcaatttcctgtacttcatcaggcaatccctgagccaagggtggacatccctagaggtctgtcagcctaagaccaaacaaatggtagagcgtctctcaacacgctgctcaaatccagtgtggtttgactctagagtaacctcgtcttttcctctccccttttaagtgcaagtctgtactgcggcaggactgagtctgggtatgtggctgggcagccagccgtgcatgctgcagctgggtgatcactgtgattcttggtgtgatccaagcccgtcctctctgcttctctgtactattgctctggctcctggccctctccttgctatgggtcttaccctcaagtcgctctgtgattcaaagatgaactgccaatcaaatgttcctctaatgaaagatccaatcactctacagcatgtgtgtattcaaagaacctatctaagactttcttttggtcatggtgggaggctgttgctgaaaacataccagagcccattgtggaggtcagctgacaggccgcatgaccttggcaatggactactggtcatctgggactgcttaggactgtgcaatggaacttgggggcaaaactgatggagacagccaatgggccttaaatccagcaggcaaagacagagtaagttcttatttgtgtagcccagggcttatcaaagtgtggttcttggaccacgtgcatcagtatcagctgtaagtatttggcaaaatgcagattcccgggccctgcaccaaacagattgactttgaatctctgggggttgggctaaaaaaaaaaaaaaaaccctacattttaaacaagctcttcagatgacccttgtgtaagtttgagagcatctgctggaaaaccactagaatttgcaaacggccacctcaaaatactccagccagtcccactaagccaaagaccagaatctgagaacagggatggggaaattattcctttctgtggatgattatgcagctgggccatgatttcacacccgggggccatgggctaagatggaggggaaggaaggaatgtaatgtgtgccctctacctcttcaccaggcatcatcctctcactggccctggctggcattcttggcatctgtattgtggtggtggtgtccatttggcttttcagaaggaagaggtgagctggtttgggtccaaaatgggaatggacagctatgtgtccatgatgattagtctgcctgggaaggcagctttgtggcatgaagagccgcagtcacctggaccaccacttaccctaggagggccgtccccaaagcacccgtgccctggcctcctttgcatgagacgcacatgtgaccctggtcgttcaaagggttcaggggtcactgtgctcagatttggaagcgtgtgtgccttgcttgctgctattgcatggccttggacgagtctcttgacttggggcttgtgcctgaagttaagcagccaggctgtcttcttatcaagatctttacatatgctttttggtctatgaattcaaaaagaaagatgaaggaaaacctgatctctcactcacattaactcttcatgccctttgtccatgtttttattgtgacatttggcttttcctaaaacctaatttatttggggggggtatgaaaaataaaaaggtttctgggaaccctgttatggaatcagaggtttgaagaggggggtgacaacgagacctctttcaaaatataggtctactactgttaggtgtgaaagagaacagttggaaaacgaacaagttctgtttttgttaaagctttatttggtgacactccctcccaagaccaacagaattggggaaaggtcccaaagagaggaatccaacttttaaaaacggcctcattccatacctgagtcaggctgctctctggctcgctcgctctcctctctaacaagagttatgtgttctttctgttctagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaattctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaattattctgtaccatcacaacttttcacaacgatggcaagccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaaaagactctgtatatcttttgtggatgagttttgtgagagaacagagagaccattgtacctggcacaagggctgttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccaggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactgtaactacaagaaattataaatgtttttcacatcaggctgttctttttttttttttggaggcgaggttaaagcattactatttgcaaagcactctgtagctccctgttatggggataggtaactaatcagaataataatgtcactcgcatccacttcttagaacctggctccaaaggaaaataagctgatagactcaatcactttcctgaggatggaggcctatggcatgtgtggctgcaggtcgcgaagctgcttaatggtgctgggaagcctagaggaattaaataaagaccctggaggaggtgggatcggagctgcaccttgaacaaatagctcagatttgaacagatggatggaaaagagggaggtgttcccaaccaaggggacatgatacagggaacaggtcctatgtctctttactcctgagagtattaaacctagtaggtgggcagcccctcttggttgcctgttaccttattttgaattctttttgcaaaacatactatcacccgtccaaataatcttttgtctaaatccagacttcacattctgactggggcaaaaagaggcagtccagtaaaggttataaaataggtaccatcattgtttgccttatttagaaaagcatccaattttcactataatcaccctaagcctgagagaggtgaactgttcaagggtactttggctccagtgggtgacagtacctggcccagctttggaattgaaacatttctgatggtctgtactctgctagaacacaggatgcttctgctctccctgctctggcatcctgccaggtgtcatggccacgcacaggcatgaagacagccgggaagccagagttcccacgaagcactcactccttggactt

SEQ ID NO: 15772 - DNA, 181430 bp, Human
ttaaactttaaaggccaccttggtgtcattttaagaagtggggatgagaccctggggaaagtgttgaaatcctggagaattcgttttaactattagaagtggtttaatatttgtaagtttgtagttctgtgagttctaaagactaagtgcagggatttatgtttttaactcttatgttttagtttacaagtttcatccttaaatcatctatttgtgtaaataaagcttcatctcctctataacaagtgtgttctccccatatttttttttgtctctttctaaggttaatctattacgcatttacattttctatgcatcctttaagggacactgaagatgctttttgatacactttctaaaatattaaataggcataatggctaggaatatgtaacattgaagaaatgtttcagaaactacagaatcaaagaggtttaaagaataaatttcatatctctcttccatgttattttattaggcaaataaaaactacaggagacaatttaacataaaatacaaataaatatctgggggttgtcatcttagagaactccctactataaaaagcagaaacaactcaatttactttatatttccagatagaaaggttggaaaaagtttggagccttatgtgagatcaaactttggatctatcggaaataaaaggaaatcataaatgactgagaaatatttttaaaggaagaaattataggacaaaaaaagaaattcatcttaaacatgtgatcaagttactctgtgtgacctttgaaattgaagatttggcaattaaaattttaaagttcttcctcttattacctacctcttgaatacaaagtgtccgaaactgcctaatggaaaacagatttctctacgcagccttccttgccgttcgggttgaatgaattcaactggagatattggttatgactttttttattcttagtttctctttgaaagataagcattgaataattcctgaaaatggtaaatacttgcgaagagaaaggtcttgctttatgaatttaatacgtagtggcattctttaaaattcagtgtaatttatgcagcgaaatggaaaactatcaaagtggaggcaatccaaggaaaaccttagaaaatgataaacgcgtaaaaaaacgatacgcaaccatcagaaggttctctcctaatgtctcacttcgctcaacaaactatggtgaaaagacagggcggaggagaaggggcgcttaaaacaaaagacttcctttcccactcccttttcctctgtttcttttgccagagcttgttgcaaactcttggaaacattgtttaaacataatacacttggttactttattctttcagggattgtggtgggtggtacctaaaactgacggctcttggagtaacagaaaaagagaagtagaaacttttcaaaaaggcaaaaaacaaagttacccagcccgcggaggttctaacaacaaaaaagtaaaacacactttacttaaaggcacagctcatttcactgtccgggctccgtgcttggtagctgagagaaggcttgcttcgcctctggtttctaaaagatcgcgcggagtacagctatagaaaagagtgtaagttgggagcgttattctcggatttattctgctacgcgaaagctgcggttgctaaaagcagagcgtccaaagcagcacacacctcggctaccatcctcgttctcctctgaacatccagcgcgagctcagaacctggagggaatcctggaccagcaacctgactccgctcggcaccgattggctcctgcctcggaccccgcccccgtggccggggcggccatttcgccgggacccgccccttggccctgggaatcgcctcctggcaggccggctgtgcctgccactcagcccgagtggcggaggctctcagctcggagccccgccccctccccccctaattgatattattggagtgtggagcaagcggccggtctgcagtcggagacttgcaggcagcaaacacggtgcgagcgaacaggagtgggggggaaattaaaaaaagctaaacgtggagcagccgatcggggaccgagaaggggaatcgatgcaaggagcacaataaaacaaaagctacttcggaacaaacagcatttaaaaatccacgactcaagataactgaaacctaaaataaaacctgctcatgcaccatggtttttcaaactcggtacccttcatggattattttatgctacatctggctgctccgctttgcacacacaggggaggcgcaggctgcgaaggaaggtaaggtgatgggaaagcaaagtttgttctgacttatttatttagatgtctacctgcacaagccagctcgtccgcggcgctgccggccgcgcctccggcgccgggcgaccctcccccgccggctccccgccccctcaccgctgaggccgctcctggcggaccagcgagcgcgaaccagggctgttccgagccgcctacagccctgtgcccggagccgtccatccgacgggtgcgggatttctggcgcgggcagtctggagggcgtgagcagcaacgggggtggggtggggttggaggaactgccggcgagcttatttcttagtacctcaggcgggtcacatctctctctagctcggtcttccttgtctccttattcgccttctgtgggagctgcggccagagttgggttggagactgggaaatgcagcccctaccgtctccgccagcccgccggcgagtggcgggagcccggagccttcccagagggaccgagacttcgatgagctcggaaagctcgggttactaatgaagtgctcactgcgtcggaggcggcggcgcggtcctgcggttggcgctcggccgccagcacggaacaataacgccgcggaggtgaagcgcggcgtgcggcgcgcgacccgagggccggggatgtctccattcagcgcgcgctgcgcgtcgggcccagcggtcatgggggcagcggcagcccagcgggcttggtcgggccgtggaggcagggggcgggctggagctgtgcaatttgtaaggatgccgcctgggcgactcaaagtccccaattatttgccccatagtgcagcaattgaggaatccgagtgcccaatccttgccaaagacctgaaccctgagggttggttctggtaggagaaggcaggttttatttggcaagctgttacagatacgcctgtatatggttatgttttccttctttgaacctttgacagaaggtaaaatacctttcggtgcctgtagttggagctggggaaaaataaaccctgtcaatggaagtctcttgcttttgagcagtgtcacaatcccatccccaacccccctcatcccgtcgcccccctggtctttcaggctgtgtatctaagtttcatttttcgatctgttaaaagcagaagagaaataattacttattcctgatgtgtagagggagaggaatctgttatgaaatttaggtcatggtggttatcgggcggggtgttgaggggacttacatataggtccttgattcatctatttctgaaaacttagtgcaccttttctttattctcatcgtgcactcctcttagttcgctcaagcccccctcaaacccggcgccaaattctagtccttctttcagcctgaccttctgaccccactttccacatctgcaacctgtatagatgctgaacccattcagagaaccccgtgcctccaagctggcggttacgcgtttgcagaaggacggacatctgctagaaacgcacgctcatcccctccaaaaccacatttctactcccctgacgttagcgatcagaaaccttcagccctggcatactgtgattcctctggaatagcggaccagaggaaaagtttgcaccgccgcggcgaaaccccgcgcgcgaacacacgcagactcgggctggagtttgggctataaataactgcatcactagggggagaggttcctgcagccagaatgtctagttctctttgctcttctgggtgcaagctacgtgaagaggattctgattctaagagcctgaattctttagatgcagaagtgtgatgtataaaaggcgcgggggtgatgggagggagggtggtgatctgtggctggcgggcggcgagtgcgcccggcttctaggcggcgacgcctctagggcgcagcggcgaccaagagctggcgttctaggagttcacaagccccgaggcggcccgcagtacccaagggctagcgctgggaaccgcttgaagcaggtgccgggcctcctggggcatttgggggtggctagaggaagataagaaacccccttccctcactttccttgtgcacgttctctcgggttggtcagttatcatcgctacagggagcgcgtgtcagagtctgacgcttgaaggcaaagtgcagctgcttactttttctctccgtaaatgccgccgccgccgccgcctcttcctcagaggagatgcttcccgaaagccactctcctcttcccgaaagccactctcctcttcccgactccttctcgagcgagggcgccaccggctccctggagtgcccaggtctggcagaggcgtaatggatgcttggcgcggctggcgcgcccgcctggcagcccccgccccgcccctccgacggccccgccccagccccgggacgccagcctttgcccgcgcggtcgttgcctgggtctgtcagggcgcgcccccagtctagcccctctcccatcacctgttggcccacaggactccggggcgcggagccctggagtcctaggcctggcccccagcgtccgggtgagccgagggactgcgcctccgcgggcgcaaagggaggtcggcactctgctccgagcgggaagggatacgcgctcttttgagggtttaaccagagagcggaccgagcagaagagagacgcacggatcacttgagagcggcttccgattaaacgttctcgggccgggttctgttttgttttaatttgttagtttgtttctctcttaacttggccatcactgctgtctgcttaggtcccttgcttccacccccaggctgagctgaggggtagcagaatggcaataaacagtaatctcgcaatgtttatttcactctcagaaatgacccaagaaggtcacctgcatttaaaatcctgttgtctatattcagcacacaagaaaaataaaataaaaattaagaaagcatctcaaaaagagtagagtacctgaccacccaccttgtttccctgtgcttcatgtctgttgttgaggataaaaataaactttaaaaattactttttatataaattcgctagtccaacgatttatcgatgttacaagttgaaattcaaattggcattttgaaagtgttgtgggtgtgtttctcatttgaaagggagtcaaatgtttctgatcaagtttttttttttcctgtcagtctccctgagagtcttaagtgtaaaacactaaacaaagaaacaacaacaacaacaaaacaaaaatcctgggtctctatatctattttcatttacagtgagtaactttgactagtgtgaaggaattaaacacataatcaactgttcctttaaacagataatcagttgttcctttgttttcttatcataacacatttttgtctttcaaatacatattttatccctagtgattgagttgtataattattaaaagttcatataagcatgtattttaagtaaaaattttaacatttttctgaggctgatgttaagcctattgacatacttaaaatttattcactattatttctggacaaattgatgcatttgtcaaaatggtgtagagtcagataaatatttttaaagtgcaaaaacttatgtaactctgaaaccagtttgaccaaaagagtgagtgctttagaagagtaattgtccaaaaaagaaataaaatatatcaaatagaaatattatgtgtattaatatataacattctaatgcattctcatactgatagtatcaggagcatttataacactttatatacattttaaattaatcgcattatgctttttgatagcataaaagtgaaatacaagtgattagaagtcagagttgataccattttgagaattatctatcactttgaaaattaagaaattaaaaaaaatgctgaaaaaactgatgcttgactaacctgaataaaatcttgcaaataataggcaatttggttttctgataacattgcttaacagtttttaacatttctgtattcattttagcttaacgacactgtatgtggaaagattttttaaaagataaactccaattctcaaaagacaatagaaaatactgctggcagaatgttacaaattaatgactggatcaagagtaatataggaattataccttattatgttcatgttattgtatttgacaaatttgaacagctcaatggtttacaaaaccgtaatatataattactgtggaattaatgtatcacatataaaatttctaccctcattctaatattgcattttaagatttaatattgtaattaaagcataccaaatataatattggtgtcttaatatcttttttcctttaaggaagtggaatatacatgtatcaggagggtgttcatttcaccattgatttacataaataactacagatcttaagtcatatagtgatagttatatgaaaagattcaccttaaaaatgtctacatgtgtgcgtaagtgtttcatgtaacatatggaaatacaactttctttttcagtactactgctggattctaaagcacaacaaacagagttggagtggatttcctctccacccaatggggtaagtttttttcatcataaaatatcacttttttaaaataagaaacaaaacgtttcccttccctccagggtaattattcacactcttcatgtataaactgtttaattccaaatatcttgtccaatattatgttgcatttataatgagacattgagttccctgattagagagggtatacttagaacttggggaaatggaaaaaaaacctcatagccatagtcttttgagttcttattgtgtggaatcatacctcagggtccaggctgtaaatgctaactaattacagggaacattcctttcacaaactcacttaaacctctttagttgctttatatttctagtataatcaccatgtcagtggtatataattctttaaatcagtatgtaatcaatctgttttcctatttttaaaagtttcagcatcattcaaaatgtactttaaaatataactaaaaatgtactatgttcaacattttggtatacaatttactataaaatattatatagattctccaaatttatattatgtgctatccgctgttattaatcagaaatgatggcaaagcctgcacatattacaataaaaatctgcaatagatatgagtgaaaattgtccagtaataacctaccaaaatattagtaaatctttaaaaatactaaccattatttttcatatgtaaatgtagctcagtatccgtgtcttcagatcttatttttaattgtgagagagggcacattctttattccttatcaagtaagagggctttgagaaaggagaagataccctattgctatttgtgtttatctttggcttattaaaaaccgtgtggagtgtaagttatgatacaaaaactgtagcatattttgcaaagagaagaatgaaagtttgaaagagattgttgagatcataaaatcagcatgtcaggaactgaaagtttaagaatgtaaaatatgaacaaaacaaatctgtttaagatatttagagttttcattaaatttaatttttaagattcctttcattcatattgtggttatctgtattggttatgataaattataaatcaatgacaaccattttacagattaaatataaaaattccatgagttggaggtatgaatataacacctttcttgagataagtggtttctgtaagtaaaataatatacattatagacagccattcatgataaaaaatgaaacacctttcttgccaatgacagatgtagcccattttctaccatccatcaattaaaacaaatagagatagaggatggttttatctctgaggagaagtaaactgatatatgattgtagtatttcatccatgtaatacacaaaatgacaaattatgactgtcaatgttatcttggactcaaatgggcattttatcagtccaaagtatcttaacagttaaccctacatgtctgtaaacatcaacacataatattagaaaacaatgatggacaatattttctatatctgtgcaataggttagtttgcatgtgactaaatacctaactaaaaaaaatgttcttgagatataagttttgagaaaatatttctataaacgtactataaaaatgcagtgtctgaatgaagacatttttcccaatggcgtcatttgtggaaatgttcataatgtcttagaaagtgagataataaaacaacagttgtgttaaatgaatttatgtagtctcaatgtttgtagtctacatcatagttttcctgaagcattcccctctggaataaaattttaaataaaaataaaaattaattgggtttcaagggtagtaaaattgatttttcttatacagaataaatgaataaatttgttctcgaagttagataaaggaattcttaggctatattcttttaaaataattagctttggtttcttcaaactgcagagttgttaaaaaggagcacatttatctttggagcttttgattttttggtagatatcattactagttttacttcttttagcaatttcaatctaattaagagactgaaatctagccatccaaatggatgaatttggttatgtttggctgattgccattcagattgtaggcagctaactgaaacaaagggaagctaggcacactgttaactagtcacaaatgcaagttgaactgagtaaaagctgaacattaaaatgggttctttactacatttgagtacctttgatggtattagactgtgtataacaaaatcacaccaaatatataacatcatcaaagaaatttctgaattgtattatattgctaatttgtcagtcttgttaattttctaaggactggttttaaaagtatacattaatattgtacagaacatttaaataaatcaatactcaaatcaagtatttaaaataaaagtatttacccatgatttttattttctcatcttttcttgaaacaatagttaaaatattgcatgctatgcaactttggacttgaacacaaatgttttgtatttgaattttttattggggaaattaatattaacatgacaatttcattattaagacatcataaatacaaagtgggaaaattattaataattgtacgaagaaaacaaaccattcatttaggcttttaagattcctaggtgaaatgattttattgattaatgagcgacagaatattatatatggtttaatagtttgaaattgttgcaaattctgacaaatgcactttttttccttttttgagaaaatatttaatatagatttgtttgtaatgtacattatatcaacatataaatggacatttttaaacatctgatatttttcctgtcagaaggtttatactaaatatgatccagcatgcagatttgccatgtacatttgattgtctattgaaagcaatttatttataaaaatgaatcatactcttataactacttatttatagttatgtggctttgtatgtgatattatatataacactggaataaataaatagctctgtaaaatgttacttccttatatctcattttgaaacgattgtaaaatattccaaattataaatatcaacaggttgttgaatggtttattcagaataccgtgggcattttcttcttcatgtttttaagtactctgtaatcgtaagtatgatatggccacttaaaatgtcaactgagttatcaaaaattctgccaggcatccatatgtatatactttcactgataatttaaataattgtgagctttagtctataaaaattataatctcaatggagaacataaacataagcaaacatgtaaaaaagaaacactaatatactcacagaaagatattaaacaaaatgaaatatttattgtatgtatacacaaagcaagcagcataagtatgttccaccaccaggatgaagcagaacctggaatcttacattctctggtttatagttttgccagcataggaatcaacctaactttttcgaagatctgtatttgtgaagtacttgcactttcaaaagcaaaatgttattttttgctgaatgactgatgaccttttttcaaattttacagtgggaagaaattagtggtttggatgagaactataccccgatacgaacataccaggtgtgccaagtcatggagcccaaccaaaacaactggctgcggactaactggatttccaaaggcaatgcacaaaggatttttgtagaattgaaattcaccctgagggattgtaacagtcttcctggagtactgggaacttgcaaggaaacatttaatttgtactattatgaaacagactatgacactggcaggaatataagagaaaacctctatgtaaaaatagacaccattgctgcagatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtgtactacaagaagtgctggtccattattgagaacttagctatctttccagatacagtgactggttcagaattttcctctttagtcgaggttcgagggacatgtgtcagcagtgcagaggaagaagcggaaaacgcccccaggatgcactgcagtgcagaaggagaatggttagtgcccattggaaaatgtatctgcaaagcaggctaccagcaaaaaggagacacttgtgaacgtaagtaatgtgtcctattaaaactccactttgcctttttaaatttcagtatcagacattttaaactttaatagttatttgaatacgtgaatctgctctgtaccagaagcgcaattcagtagatcttaaacaaagtcaccgttgaacttagtgattgccctacagtagcatctgcactaagtgtatgtaatcaatataggtgataatgaaatttgttactaaaatttaatgtgtcctatgcttaacatggaagtcaatagttgcacgttgggctatggagtttagagaggagtctgggtagttggacatatagcctggcaagactgaggtgacatttaacaggatttaatgagatgccattcctcctgtttttaaacccatattgtctgggcccttgagtagcagtaaataggaggttaagagggctgtgaataagagctctagtgacaggcagggcataaacgaatatatttacaaacttttagaattatcttatataaatactataactttaatacaaaattttcaaatttcacttacaaaatctctgtggttacttctgagaaaggtgtgtgttttttttttttttttttggactaagtaccaaaatgaccacatttttgtgaaagtgggccaaagtaaagttttaattattatagtacaccaattgcatgttttgaaacaatcatgtatgaattagtaaacttttttctttgttttataaaaccgttttttttctttcctagcattatgtggctaaatatttaaaactatgtcatatggaccttcaagattgatagatattctgtttctaggtttcatgaaaataaattataaagttatgttactagtgtctctttttaacttatataaaacataatacattaaaaataacacatatatctatatttatttttacaccagagccagaagcacaggttttatacttggaattcttagttgagctaaaggagactactgataataataactattataactaatttttcttgataacttagtatgtgcagacatcctccatttcctttacatacacaagcttatttaatgaggtaggtatcattatcatttatgttttacacaataaaaaaatagaggatatcaagagtaaatagcttgcttgcagttacgttagtaatatttgtctgagcttaaattcaaacttgagatattctgactttagagcctaggcaacgatattgccctagttttaatcacaaagcaaggagaatcctaggaaatactgtttcaaggctcatagtgtttaggtgcctcatatacatatataaattggattacttccccataaaattctcattctagtagaatatttttaaaattaaataatttttaaaaagtttagacctgtgctatatagtactgaacccagcagccacgtgtggctctttaggttttgaaaaatgactattaaacattgagatgtgctgtaagtaaaagttacacactggatttcaaagctgtactgcaagaaaaaaaaaagaaaaaaaagtaacatatgtccttaacaatttttaaatgttgattacatgtggaaataatcatattttaggtatactgggctagatagaggataatgttaaaatttcagctgtttcttttactcttttttagtgtggctagaaattttaaaattgcatttgtggctcacattgtgtttgtattggatatacttttcaaatggagtaactgagcaaatacctttttctgtcctattcaaagagttaaatacttcatgtggatggctgctaagcatgtaaagtacctatggctctgcactcaattatcatcttcaccagaggtgacattgtgaagtgaactctgagcaaaacaaatggagatgatataggttcaggtcccatagaccagtttagcagtctccttttatgtccctgaaggagtcaaacctgtctcctattgtcctgtttccctttccctcactggcagtatttctaattgagtagaaaatcctgcagtttccatatatgtggaaatcagaaactgatgaagatttatccctgcttgtaggcaaaatgctattccactgggtaagtagagaaatattctcagtgaactaatcaattcaatgaaaggcagcgttcctgttgacaggaggttaacagttacttgaaagtgatggtggattcagcagtaactgttacaaaaaattttaggaacattattgcactttagctatgaaaggagcagtttcaatattatgcagaacttgattgatatgaaaaaggaacttaaaacttttacacaattaaaatgggaaaaataacgaagtagaaatacatataaaagtacacaattaaatttatctgagaaaagataggaaataacattaaaggccctgtgttttaaaggttttaaagaagattacgggtttttgtggcagttgtttcactttgtataatttaactcatttatttgttaagaaaatgtgatttccacatttattcataagaaaatgtgaacaggagctgtttgagttttatgcttctaattatagaatttagtaagaaaagcagtcttaaaccacagtaaatagatatatttatcatgaaaaataaacctcaatttatttcaaatgagaaaaatcatctcatcaaacatggtactgtaaaattacttacattcatcaaatttaattgcaagaattgaaacattttactaccaaaattattgttacctgcaaactataccaaggtatttaaaaataaaataaaattactccactgtcatcttcattaattctgcttttgaatacttgaaattaggtattaatattatagtaacatttaattaaaaataaaaatacacggttaaaggaggcaagatgctgccttatggtttaatcgaaagaatatgtgtgcgttgttataagtcaagtaaattgcttatgacataactttcttaatttttagccttggtgatgttgacaaaagaattaaataccttctacttaaccatggaactatgttcatttgcaaaaacacttccctccttggcataattccaatgcattgctgcaagagtacttgcctctggaatcactccaggcttgcctttatagtattcttcctgtttcctttcaatgatcctgttaagagtttgaaaacaaattccagtcctatattgaggaaaactaatgtgtttgggagaggatgctagtgagtccctagccaaatgagagtggttagccacttaaaggcaagtttatctgggcacattttgaagtagcagcccattgtgatgtttgctagaagacaatatgaaatataaataactataaaaaactgattgtaggtttgatgagttgatgtaaaagcttttcttcatgactgaaaaaatagctcaattttgaaaaccaaatgcttctcaagtctaatatgtggagaacttctgtccaattcttaaacatagtatttttatgaggacatctctttatattgatttaagaatttataatttcatttagtatacttttattgtcattttttaaaatttacaagttatgtaacaactttgatgcaaactagccaatacattttcttagataaaaagtatagttattttaaaaattgagagatcctgttatattttacatatgtaaatatttcgggaagactaataaaataaatatactgaagtatatttcaatttttgtaacttttatgcaattttattcgatttagaaagtagaatagtgcttgtcaaagtgtggatctggatattataacttggatttgcatagacagtttgcagtttatactgaacagtcacattcattttctcatttaaacctcaccacatcactaagatgtggaaaatattattatttttctctttcaacatatgaagaaactgaagctcagagatattaataagtaacaaaattggataagaattcaaaaatcctgtttaccaattcaagtcttttttcctcactccactacttctctaaaatttgttctggactttacccagtagattttagttactaaaaaactaatgaaactttattctatgtagggtgaccatatgcccgatatgcctgggataattgttttttttaattaacactgcttctttttgctttgaaaaatgtttttttttatttggatgataatcctacttgtaaaaaattcttctcatttggaagtaaaaaattcaaagacataagatttacatgcacatatatcagaatatagaaatgtgatttacttgcattactatattgcttaatttaaattttctgaaagcaaatatgtaaaatttttctttcagatgatttcatgtaaaggggaattcaagtaatcatacacttataatttttatgagaacttttcctaatagcagctttttaatagtttctgttaatgttaagaggtctatcattattttaataatatataatttatgaacatatgtataatttaacaaatgaaacaatacattcaattttatagcatcagcaatatttaaattctgtttcttgatcaaagtttttgaaaactgcctttattttcgcagacaagtagcatgtaatttgtaccatgaaattttcataacaaatgagtctttatatagtatttataatcatttatatatatatatatatatatatatatatacacacacacacacacacacacacatatatacagaaatataagaaacaccagtgggttagtagctcagatgccggagtcacagtttcaaaatgctggtttcacaacttattaggtgcataaagtaggacaatctctccaaaccttaatttccttaagtataaaatggggctaatagaaaccctcatagggttcttgtcagaattgaatgaagtaatgtatgtacaaatcctaaaaatagcatgtgggacatagcaaataatcaatgaatgcttatcattaataataaaacaaggaatttgctaagtaaagaaacctcatggtgatgaacaaatgaacatgtatctcacaggccacaaatagttaaatatcctttaagcaagtaatttcacacctgttaatttatctaagaaggcatttcaattaaaaaatattttacataaccctttttttccaccagcagtgtatgcaattttaattattgataataacctaaatgtccaaagttaaggtgtatcaccttgattgaacttagtctatagaatatcaatgatattataaaggaattttgaatttctattaataattttgaatgaaaaacaaaaatttgtataaaatgacatttagaattatgcaaaatatacataggaaaaagagtagatggtagtctaacaatgaatgtatccatgtagtgggattgtgggtgatcttttgttctgtctataattcaaaacatcttgaacattaacttttatttttgtacactataattttaagttctaagtaaccaggtagcttatataaagacaacttgaattgtatctccaaaatatgggtttttaaattaagtttgtttatgtataaacacagggctcaggtactatagcagtagtaagtggcaaatatagtttaaattatataaaaggtagaagatattaatagaaggcattcaataaatacagctcatagattttgttcgtttttagttgttaatagataccaaatcctattttaagtacttgcatgtattaagtaatttaaccttaaagggaggtgttactaatttagtctaatagaatgagactattattacccagtttaaaagagaaaaaatactcttaccgtgagaagtatatgtctctctctctctctccctctctctaaacatgtgtgtatatatatatatatatgattatatgtatacatgtatacatatatatggttatatatcttatataagtttgtatatatataaattcatgaataaaaacaatgtaaggaaactgaagcatagttactttgggttaagtacttatgatcacagagtggtgaactgctttttaatcaagctagtctggcttccgaatccttattcctaaccaataccctggatcatgtctttatagaggaacattttatctattgcaaagtcttttatgaacataaacttttttcagaacatcttgaaaggtgatacaaatctgaacattttctttcatttatcataatttcgaaatatgtgtctctacctttcctaacatcctaaatatttcacttgctttgtcattctctttttgattccagttttttctttagatggccatcagattgtattttgtaaaacacaacatagtatcattattcagaaagcttcaggcttctaattacctagaaaaattgtctgtattttaaacttgcatgtaaatttcctcatcttcaccttattttcttttctaactttcagtcacatttttatcacagttgaagcccctgctccctctgcctgatactgttctctcactctgccttaagcatgcccatagatatttctacgatgtctcattatttaacatttggcctcaactaaaaagaaaaaaattaacaattatatatctcacaattttctattatactttaattatatgcattcttgaagaggcttccctagcttctttttcaaattctgatgttggttactggcggtaccattctccttgttcttaatctatcttgttttttcctacgtagttaccatatattttcttatggtctcccggttgtagaaattctgcctttccttaaaatatcaatttaaataccacgtataccctgttaggtgatctctcctttttcttttttttttttttttaagagatgagtgttgccatgttgcccaggtgggagtgcagtggctattcacaggtgcaaccatagtagatcatagcacactacagcccagcactcctgggctcaagtgatcctctctgcctccacctcccaagtagctgggactgcaggcatctgccactatgcctggcttctctttttgagtacttaaactttgccctttccctaggggaatcattgcatgctatcttattttattccttgtcttttcctcttaaagattctatttttttaaacagctaagccttgtgattttttttttttttacctacccgccatgatacctagcagtttcttacaccaccttagccttccaataaatatttatgaaatttcttaaagaattactcataaactatccactggcaaagcaaagattttctttctctgaattcatttaattcagtgaatttaaattaatttcaatgcaattaattgaatttcttgtatatggctagtctgtatgagtagtcttcaactttgtgaggatgggagtccttaactacattccattttcctcatagcaaataacaggataaaatgctaataattagcaaacataaacaagactgtcttctggagttgaagaatttattcatgtgaagataatataactgttatctattgtcacattctcatgctttcttactgtctttatgtgtcttttcaatttctcccttttcttctctgaggaaacaaaaggcatttcacccttgttagcattatttatgtcttaagaaacagagatctaagagcctgctaacattttctatattaagaaggccttgaagtgtgtttatatttatattatatgggaaagcaacttttgttataaaattatattgtttgcttccaaattatatattataaatattagtttggattgcaaaacaaaaaataacagaaagaaacaaaacatgataattatccctaagctaatattaccctattgtctctgtaagtgggaaattacataaattccatattatgtcaaaacatttttctcctatttgagttatacctacacatattacctttacaattttttatgtccttcattaaattattcacattcagaaactcaaaatacttgttttaagacatttttggataggtaacatacacagatctagaacaaatgtcatccctgtgacccagttccacagtatatttttccaggtacaactattgttattagtttcttgtgtaccttgcaaagataattgctcttaccttccttaaaaacatggagaaatatcattttgatgcttaaaattagaatcatgtcacaatttccaattagaacattgtaggttttatttgaaattatacttctttttacccatatttagtcatctttgttctcacaatgcatttaacatggtacttgtttcagtaaataaagaaggatagaaagaactgatgaaaggggggagaacataaggaaatacggaaggaaataggaaactaatgtgtctgatttagttttctgtggtttgttagtttagtgtgacttcagagtgtttctaattaacctagcattgggaagtatatggtcagtcttttataaatttctagtggaagtttaaattggcatcggtttctggcaggcagttataatacaaatcaattatgccttaaaattttgcatttgatttgtttttctgtgtaattcatagctattttctctaagataaccactaatctatgaaatattcatgatgatattgtctatcattagttattttatagaaataatattttcatgggagaattttgacacagctatatatttgatatttttctctatgtccatacaaatatgatacatgaataccaaaggaaagatttcagaaaatctttttgtttcaatttttctcacatttaaatagctttaaattacctcatcccctgcaaaatatctcacaaatttagttttatggatgcatgtcttcattaggatattaatgtaagtttaatatgtgaaaagtagaaggtcacatgcacatataagtttttattttttaatctggtagtaaaacaactcaatttagaaattagttcaaattaatgagttatagatgttattttttttgttttctacccgtgttacacactttggctaaagttatagaatctgtaggtatatgttacaatattaatctcgaatgatagcatttctcaggaagccaaagtgatacatcagctgaaacaaatgtacattatttttcttatattctgtgattttgttaagagttatggaaggtttattatttaatttactttgtttagcgtcgatgaatgacataagaacaaagaaacccagggaaaatgcactctgggatgtaatagtttgaaagttttttaatggttatattttttatggattttgaattttttcatgttatttagtcatttaagttatttactgctgatgattatgttatctcttgctcctaatgtattagaaaatcagggggctttgaaaggacacatactgtgtttaatattttgtttcatgtgtcacccaattagcacctagtttaacccctggcctgtggtgatggtagcctcagacttaccctgaacccattaacactgaattacaaccttacagagaaaacctagatctggagaagagatcactgtgatgcttttatgaataaagcataatatcaatctgatacaatattaactacatatcatacatttatcatttttaagttgaatgattcaaaaatctattacattagtataacctagtctactttttaaagaaatcattcttggtaggcacagcggctgatgcctgtaatcccagcagtttgggaggctaaggtaggaggattgcttgaggccagacgtttgagaccagcctgagcaacgtagtgagaccccagctctgcaaaaattggaaaagttattcaggtgtagtggtgtgtgtctgtagtcttagctactcaggaggctgagttgggaggattactccaacccaggaggttgaggtcacagtgagcagtgagtgataatggtaccactgcaccccagccagggtgacagttagaccttgtttctaaacaaaacaaacaaaaaagcagggcaggaatcattctttctaaaagagagttggaccaggagagggattaggggtgaatggataggtgtggagggatagaacacatctaaaaaacacttgtatatgtggagttgcttgataaaataaaagcttattctgagaaaaataaatgaaagattagtaattcactgtgcaattctatatttccagtgatttatatgttccctgtttattttaatagtagtttactatcattatttgctaaactagttctcatatagaaaataataccaaatggcattagcttacttaatgacattaacctaatatataggttaaataaacctaatggatttttaaaatgtttcataatatcttctacatttatcccagtaaaataagtgacttgtattatataatgtccctattttagttgacattttcctataaagtacttttatcctcgaagagagatgtgcggtaggatatgcccctcacccactcagatatgatacactctttataacacaaaagttctttgggcattcttgtactcctttagggcataatctctttcaagacaattaatattacaaattcttcaagtttgagtgtgccttaaagatcatcaaagataaattagagggtttttttagtctttttatttttaaataaatgggacaactaaagtcctcatttatacttccaacagttcattaatgacagattcaaaagtaagtcacatcttactctttccagtttcctttctcctttgccagtacacacacataatacatatacacacacacaaccacagatatccaaaagcacgcatatataaatacactcatatgtatgtgcacgcgcacacacacacagagccaacaagaggggaaaacaaaagtcaacatagtggagcaagaaaacaaaatatcttcttgaatcatttttagatttccaaatttctatgcattaattccttaatttgggagtactgaatagttaagatttcttttctatggaaatctcaatttacaattaaaaagaggctaaaaaatcctgtagaatattattgaattatttcacattttaaaaataataaaataaagctacttcaataaaatctttaaatattgcttcacagaacaacaaaggtgtaaacaaacttctttattttcaagtagatatttaggttttctttatcatatggaatacttgaaggctatttatgtctgggaagggaagagaaagtaaacttcactttttatatacctctaagtttctgtggtattttagaacaaaagaacacaaattttagcaattaatgattaggaaatgtgttttaaaatgagaacagtgggcacctcttacgtgatcagaaactgaagatttgtgcaggagcagaagttttgctgttttaccatgtgatttctgaccagatctcctctgagaaacctttaaactttaacctctctgcccttgcaagggaaaaggggcaatcacccttctgcaatatctgtttctcaaaactgacttttaaaattaacacatgttaagcttagacattcaggctgtgagctggaactgggaaaacacgtggctcaagagttatgttgagacagtgttttagtttgcaaaataaacctgacaggaaattttaaagttcactatttagcacatgttctttactgtgtctaatgtttattctgcacaaacattatatacaggagaactgtgtttttaagagctgaacataacaattggatcatttccctcctttgtaaatttttccaatgagacaattactactccaaattcaaacagctctcttgttgattttcaagattatttactaggacatcactgtgtatgtattcatcctctaatatgcctcatccttcattataataaagtgtctcttcttttcaatccctgttccatctgatttctttttttttccttctccatcttctcttatagtgttttagacactggcattaaatgttcatttatctttgagaaaattctacactattcctttaatggaaagataaatagtaatttcaaaataaaaattacaaatcatacggtatggcacattttcataatttgaattctggcctcttttatagagctaagaaaataaatcacactttgatcaatgctgaaggttatagtctcttttgtaacatttggacggtgacttgtataattccagaattaccactctcaatcaatactgtaaaggaactcagccaagatgtttataagagtacttaatcagttaaagttcttaatctttattttttctgaaagctgaagtagttctgttatggtgtgtttcaatttgagaaagagaaatggagaccaataacaaataagaatatacaaataatatatagaaatagtttttgctgccaggaagatagattaagggtgaagaggtaagagtgaacaaggttaaaatactgacacaacttgttctgatctttagtttttaaggattttctgtcattatatactctgttgcagagacaaaaactatatgttagatctgtaaaagaacatacatattcaggaacctgtgaatacaactcatttaagcttatatgttacaagctgggataaagttgactagaaaaacaaaacactgatacataccagagttcacattaagcacacttttttattgcagccactttctttttcttccttttttaaaaaccactttgtagtgtataatatgaaagaaaataacaaaaccaagtctgcttttgaatatagggtaatttacacagaaaacaatgtacattatattcatataaacctaaagggcacggttattattcattaatgttaatagataactgagtatcgcttgccagtcagactggaatccaatggaatgttgacatcgattgatggacatacgcatgagaatattcgtaggtagactgcttaggtcagttgaacacataacactatcctggacccatctttgggggtgataaatcttgctatttttctttattcttaaaaaacattgcatattcttcagaattcatataattaagattaatttagagttttaggaccatatttatcaattaagagtaatgatttatttgatttaaagaaaaactgggttcctggtgcttctggctcccatattggaagaagaattttgattttgtttactctgttttatagaaagaaaattctaagtaaaaattgataattacttttcatatacatatttgaaattattggaacttttcttgaaaaactatttacttgagagaataaaaattgagcatcatggatgcacagcctatatgacattaaaaatagaaggaaactgtgttcttacaagtgttggtattgtatttttttaatgggcttctccaccttagtaagtatacttattttaatgattgcggttaatgatacatctagaacaaagcttttggctgaagaaattttcattgatagttattttcaactataatttgataatgttctcaattttaatgaaaacagtaacactaaaaataatattcagaatattcagaatattttaattaagctcattaatagattctatttcagaatcatataatatattatcatatatttttctctacagtctaacaaaagggttaacatggttagaattagtaattcttcatttttagtgaatttatttttaatttccccatttgtactggggattgtcatatttatatttatgttgcatacatttattggctaactctgaagttccagatgtgcaaatatattgttatattttgtatggaataattttgatagctatatattgtagtactttagagctgagttacaactgcatgtttcataatagtcatttttcctaaaatgtgttacatgtaaatctattcgtaaaaacattttatcattttagcatatgcgtttttgaaaagtggaatttggggttatgtaatctctttaacattcaagtatcaataacaaatctcgaacatattaaaagagctcacagtcaggatctcaagcagcatgtaatttattatatcgttatagcatctttgttaggtattaaatatttttatatgcttttagtcagggtaggatctatatcacagcttcagccactagtaaaaagcaaaatatatttctgaaaattatgtagaatttttttcaggtatgtacattttaaaatatggttgtcagtaacagtttatataaaatgactagaaaagtacattttttctacctactgaatagttctgtataattattgtttacacattagtcatcaaaatggcatgagattttgatttttcacctagaaatatgctgtgagattatccaaggttaatttcgacagataaatgacatgtcactttcattaaaatgacattgggaaactgagataaatagtttagcattttctgtgctgacatgatgtttgcctgtctgattgcatcctttccaatagacagcagagacacaattacaaaaaaagacatctgtgccaaggtttagctagccaaaaagggcatgctcttgtatttaaaaaggtagagaatccaatcgatgaaaacgtctggacctgttagcaccaataaaactgaaggccactgggaagctcagagagggtctttgttgtagagatagaaagagacccaaactatgacactttcagaggagaagggtcagcaaggaggatcatccatcttcttcagtggcagctttctgtcagattctaaccctatttagtggaggaactaagcctcttctgttgacaccaaccgattctcagccaagtgtaaatgaagctaatattcactgaccttatgcatagcaaatgaagccctatgtgtcatttgagaaataatgttatctgacacttcaaaaagtgagtgacggacagatgtgtgtgtgtgtgtgtgtgtgtgtgtgtgtgtgtgaaataagtaaagatatatccttatccactttatatttttagttgactttcacaataaccacagttttaccattttgacagaaatttaagtttgtattatttttgtttacatgtcatgacattttacatgcagagcttgactgtgctgcagaacaagctcgtttggctttcttctgtctctaaatgcagtgcctagttacagaaagagaagattcagtttctactaataaaagctgtaaatttccaagacaattctgaattactagttcacactcaaaacataatgaaggaatatatacatctttcacattattaaaacatgtattggtcttgttagagatcaagtcaaaaaggcttttttaaaaaccatttttaaagcattgtctaaaatcttttctttttagttagtaattctgttaaaatctaataatctttcttagtctttaaatcaagattttcatgttttgcttactaaggattatattttaaattgcatattatgcatttcttgtttggaaggattttccatagtactgtaaaaaaaattctcacaaaaaataaagtttaaaatatgccagtaataagaaaaatgctgtacataaaaaatattaagtatttgctgtattttgtaagtaaaatattaatattagcagaaatgaaaaatagtgataaaaattaaataattttaaagaatgtatggaatttaaggatttggggaaaagataggttaaagcatagcactggattttctgagtttcacggaaggtaattatctgacacggtagatttcctgagaatcaccaggacagatctgcatctaattgacatcaatcatgtttgaactgaaaataaacagttgtaaaatttttggaatctgtggattgatttttgttcacctcatcagtcttgtttatttgtacttattaaagaagtgaacttgctttttgttctaccaaacttaaaaagacagcatctcatcagtaagatattctcttcttagttcttttttgacaagtatctaaaatcagatgagatcttacatagtttcctcctggcattgttcctgaacctaatcatacagacactaaacatgtgtttagtcagttcttcttattttcctcccacatttttgttaatctaagcacctttctaagtaaaatggtgctcaaagaccacagagaaattatctgtgttgatagtaacttcgctgagttctgacttttctctctctctcatcaattgtttatcctcagtaggatttagttatgatatatatatataaaaggtgcgtatttgagttgtagctttgtttataaaagatatgcaatatctgcacatacagctactaaattcagccaatgaagccattatttttgaagtagtacgataacaaagaataacttgagaagttttgttattgttagtagttgtaatggtggttgtggtggtggattaaattgagctaattttcaaatctttagaattgcaatagtttgtctaaaaagtcaagataaatccgatggacacaattacatgcaaacacatacactcagaaatgacaggagcctcttattatggagataatttgtataagtgatctacacagtctagtttaactctactcgtaaaaatttatgaaaaagctgtctggagtacagatacaatttgctgtgcattttttacattaatttgtgatggacttttttttcagaaacctcattcaaagagtttccataaaagaggggaaaaatatgatttggctaaaaggcagtggatttggcttcatggaatcactggttaatggatttagccaggtgttcgaatctaaattgaaagggccaattgtactttatgatctgcagaagtcatattagattagtaacactgaggtttagaaagcaaagtggcatttcatgctgctgtcaagtaagtttctacccctttgccctgggagcttagagatttcagtctagttcagtcctagcccaatatagggttttaaaaaatatgttaatcagtgtatttggaatcataaagtcttctgttaactttctaaaattattctttactgaatcatttgaaccagtgatatcatctcactggacctcttagtttaatctgagaggcgttttttttggatggaaacttctaagactaaaagggtactaaatatatttcatatactaatttaacaatcattgattgaactacatcactcaagattatttaggtactgtatttacatatgatactgatttatatttcagatatttattagccaaacaattcctaaagtcactaggattctaggttctggaaagctatcatagctgagggctatggtttgagaaaaagatgccaatagagggttattaaagatgcctaaacaattcacatcacttcgacatgaattgtaatttgttaaaacaggtcttaaaaagagtttcagaaatccttaaatgcagtcagactgtagaattgaagcacccttattcaaagttgattgcaattacagccacatatgattatttaatgaaatgagatttttttcttaaactagtattagtttcatgatcctgtgaaaagtaaggtattactataattaatttaataaataagtttatgtaattgttattcctaataaagaatttctgtttctattcattttcaaagaaatattgaaaaatatttaagaaaattgattgttgatttcatattttatgtttttgtaaagtccttgtctgaaaaatatatcaaaatagacattatgcatattgcttttaaataataaatggtgttttattatgtaatggataggtttgacatgcatacatttttcaatatgaaataaattattttgcatttaagccattaaaatcaacctattctttggtggcaatttgctatgctgtgttaaagaatgcaaaatgttattttgtatctttaaggaattacttgtagaaaaataaggtaaatggatagtatgcacttttaaatgcattttatttttttctgtttaaaaatgtatttaaaaatttgataagatttttgtcatataatcagttagagaatcatcaggtgaatagtgacatctgtaactgagagccatggaatttgctgtttttttcttttgtgtcgatctggagggaaaaataaatcagtagttcctatacctggtttgacatttcccaccttttcctattgaggcagccaggcgaaagcagtcaggacaactgaaaaggtaaccatccctttgagggcatggttgattttgctcctgattcttactgtgctataggggtcaaggatatctggaaaggcttgacctgtgtttcctgtcaggaaaagtgggtgattttcactttctacgcctgcagatctctggagttacgtgtacattggagtttactcttcactgctttgtcagcatagctgtggctttcttcagcagttgtgaaagaatcctgagatggaaggaattgggtgtaaaaattgcgttattctgtagagcaggagaatgtactgtataattttttacaaatttagattgtgccatatgatttaaaaaatttagattattccattttatttaaggaaattgagtctaacgctgtctgatatgctccaaagaattaacactataatgagtcaaaaaccaactacaactcagagtttatatttttagttttttttttaatctcataaaccgtgaagagtttaatttttattctatttttaggtaattggaaggtaaattcggaagcaataggttagaaagtggagtattttttttctgttgcctgtgtcttttagctaggtaactaattaaccagcttccccttcctctgtttctccctctcatccttccacctttctgtctgtcatttgtattcataaatataatagagagagttcataaacctatagatatattcataaatatatagataattttctcaggtcaagaagttctgtagtaaatccttttcttaactgtaacttttctttgtgactggaggaatagttttttagttttgccatgttcaggctccttgccttggtccttctctgtccttttctatggaagcatcaacgtccacatgagaagaggttatgttcatatacaagaacaatttgttcttggtaataccatataattatgtttcaaaatttgaatattgggaagtattttccagttttcttttcctctcttgccagttgtctcttttggtttgtttcttagatggtgataccatattagtagtttctcaagtaaagatgccacagaagtttccatttccacttttattcctataatgacctctcttgctccaaggtgtagttccatctttcagaacctccatgaatctctggagaggtagcacctgctagaaaattctgaagggattgtacttttcagagtacacttataacaaggctacagggattattagactagatttaaatacttgttgacaatttaaattattaccaaaatttaatgcattttaatgagggaaaatgattaaactgatgggaatgtaatatattgggggattaggaattctgcagtgcttcatggagagtagatcaaacacaacaaaaatattggcattaacgagaattcagtactaaaaagactgttgggaaaaatgtttggaattaaaaccaattcaatttagttcaatcaacatttcttgagtgctttttgtttacagattaactatgataaattttggagagagagataaacctgcatgagtttgtaggttgccaaaaatacttaaaactaataatgttaacaatccagcaatgcattttcaactccatttgagaaattaaattttgttttatttatttcctttaaaaatgccaaagtaacaggaaaatagaatagtataatgaacacccttatggtcttcagacactctaattgttacaatttttctacatttatatccccactccccccagccctgtatgtgtataaactttttttttttttttgtcctggctgaaccatttgaaagtaagttacaggcatcatgacagtcaatgcctaaagactctagcatatgttctcaaaatgaagatgttctcttacataaacacaatgccatatttaaaatccaggaaatttaatatttattttaaaatttatcttaatgtgtagtttctatgtagttaatatgccagtttctgacctacttcaaattgccttttttatggctgatttttttcaattcatgattcagttaagtatttcatatttgttttgttgacataatttttttcttttcttgtaatttgaaactttcattcaccttttttttttactgtactgattttttttttgagaatccagaccagttaccttttagaatattccacattgtagattttcttatttctttaaatgttagattcaagttgaattttgggggcagggatacaatatagttgatgtggtttactttccattgagtgacagcatgctgctttgtctccttatttctgatgctaaagtttagtgattttgttaaaccagaaccctgtattataaatttacaaatttcagtgatacttggggacacagaaattttccaattcactgacaatcttttacaaactgctttatcattaagatgtcaactggaatcatttgttacagatagtacaaagtgttgattttgtgtatcttattccttctgtatttattgttttattctgtaagaaagttttttctttctctagtcccaacttcttgttgttattgttgaatagtgctgtggactcagattccaatatcatttttttaagaaaactttcatctttttaatttctagttgaagaagggtgaaattaagtattcatttacttttgtggcagttcataatttttaggattgaaattatagctaatttattccaacgtttgttctatttttacttgcttatttttcctctgacaagaatttaatgatactttacttttatgcatcttttgtaatgcgtaaataagtattccattttcaggagactttttgagacatatttcagattagattgacagcataaccctattaaagtaagtaaataattatcaagaatatttcttccagacgaatagacagaggtgccagtccagaacccaccacgtgattagctgtgtgaaagcgaaagctatttaatctctcaagacctttgtctcctactttcaaagtgggaaatattagcagtatctatttcaagaggttgtgtatggaacaagtgatgtaatacacacaaagtactagcacatagaaaatggacaataaatatgcataaaaatgagatgatgcttgtaaagcatttaacacactgtctaactcatggtaagatatcaataaatgttagctacaattgttattctaagaattgctttctgggtttgtattttggtaaatgtggctggaaatgatacagaaatcttattgattctctctccaaatatctccaaaatctattctgtcaatttctgtacatcctactgcactattttggtttaagtctgtgtcttatctatcttacagagtgtcagtagcctcctaatttatttgtgtgcatttgatcttgctccccttcattattttttctactcactctccagcgtcattttttaaattgcaaattcaatcatgttatgattttctttaaaatatatcatttcctcccatagtttctaagatctttcttaatatttaatcaaaatcctttttttacttacctttgcttatctttttatgcatcacctaatgacactgaataaatatcctaaatgttttattcccccctgtgattataatatattgtaattttctgcctggattgttatctctttacagaaggttcttctaagcttatcacccttcactattctccccatttccttctgaacaagcccacagtcgtgctggtcagagaggctttcaatatgtacccactttactgtaatgtgccccattagattataggttactacaaaataatagcatttctttatatccttcacatagcaccctgcctaactcacctaatgagtaaatagaagagcaatgattacacatataaatgaagtcatttagataacttctgtaaagcaggaagcaccgattatatgtccttatccaaaatgtagtgaagtaccaacaagtgattttgatgatggtaatattgataataatagggattctcttccagggtgagaaaatgccttttgacttttgaaaagatgtcaacttaaatgtccaagaataggggattaagactattatgaatatccttatggtgaaatgtcattgaaactcttaaattatgtcattaaattatatttgctttcatggaaaaatgttaatgatattagactaaggaagaaagaagtgcacaaagtaatgtgatacatgtttttaggaaaagactggaggaatatacaagataatgttcatgtgggtcatcttttgttggtggactatttggattactctatgttctttatattttcctcctggatcatgaattgctatatgtacatgtgtatgtctctgtgtctatctatctattctatctatctatctatctatctatctatctatctatctatctatctatctatctgtctgtctgtctatctatctaagatggtctggctttatgtcctacaccaaatctcatcttgaattgtaatccaccggtattgggggagggacctcatgcaagttgattagatcatggaggtgattaccccatgctgttcttgtgatagtgagttcttatgagatctgatggttttataaggtgttttccccccttcactctgcaattctctctcctgctgccatgtgaagaaggatatgtctgtttccccttcctccatgatcataagtttactgaggcctccccagctatgcgtaattgtgagtgaattaaccctccttcctgtataaattactcagtttgggctatttcttcatagcagtgtgaaaacagactaaaacagtcagttggtatcaggtagtggggtgctgctataaagataccctaaaatgtggaagtgacttaggaaataggtaacaggcagaggtttgaacaatttggagggctcagaagacaggaagatgtgggaaagttgggaatttcctagagacttattgaatggctttgaccgaaatgccaataatgatgacaatgaagttcaggctgaggtggtctcagatggagatgaggaaattattgggaattggagcaaaggtgacttttgctatgctgtagcaaagagactgctggcattttgctcctgccctagagattggtggaactttgaacttgggagagatgatttagggtatctggcagaagaaatttctaagtaacaaagcatacaagaggaaacagagcatacaagtttggaaaatttgcagcctagtgatgtggtagaaaagaaaaaaaaattttctggggagaaatatgctgcagaaatttgcataagtaataaggagccaaatgttagttgccaagataatggggaaaatgtctccagggtatgtcagagaccttcacagcatcccttgtcatcacaggtccagaggcctaggaggaaaggacagttttgtgggccaggtccaggacccccctactgtgtgcagcctagggacttggtgccctccatcccagcccttccatctgtggctaaaaggggccaaggtacagctcagaccatagctttggaggatgcaagccacaagccttggcaacttccatgtggtgttggtcctgcaggtgcacagacatcaagaattgaggtttgggaacctcctcctaaatttcagatgatgcatggaatcacccagatgtaggtgtggagccctcgtggagaacctctgctagggtagtgcagaagggaaaagtggactggagctcccacacagactccccactggggcattgcctagtggagctgggagaagagggccaccattattcataccccagaatggaatatccatgaacagcttacacgtgcacctggaaaagccacaggcactcattgctagctcatgaaagcagccagaatggggagcccccctcttacatcagcgtgacctgaatgtgagacatagagtcaaaagagatcattttggaactttaaggcttaatgactgccctattggattttggacctgcatggggcttgtagcttcttcattttggccagtttcttccatttggaatgggtttattaacccaatgcctgtacccccattgtatctaaaaagtaactaacttgcatttgattttacaggctcatagtcagaagggacttgccttgtttcagatgagactttggacttggaattttgggttaaagctggaatgagttaagtctttggggaactgttgggaaggcataaatgtgttgtgaaatttgagaaggatgaaatttgggaggtgcccagggtggaatgatgtggcctgactctgtgtccccatccaaatttcatcttgaattgtaatccctatgtgttgggagcagtccccctctgctgcccatgctgttctcatgatagtaaatgagttcttatgagatttggtggttttataaggagtttccttgactccactctgcacttctctctcctgctgccatgtgaagaaggacgtgtttgcgtccccttccaccatgattatgtttcctgagaccttcccagttatgcagaactgtgagtcaattaaacctctttcctttataaatttctcagtcttgtgtatttcttcacagcagtatgaaaatagactaattatctatctatctatctagctatctaatctatccatccatccacacatcaccatctctatgtatatctaatatatttatatataattttacaaagaaaaagcctcatgggagtagaacaagacaaaattacccatcattgtctcattcttcagtctcattaataagtggggtgcaagtacttttttggttgttgttaaataaaaatatgagataccattgtagttaataaatatagggttttttattttcaagaatattccagtataaattaaaaaatgcaatctggaccaatttatttaatatactactataaatgtagaaggaaaacaagttttgcgggagttaaaagtatgaaagcgtttgatttttattattcctttctgactgctagatgacatagaggtggattatttagacacactgtattacataatatgtaaatatctattatatattcatatgcgtacacatatattttttctcttctattaatactagttcttgagctattgctgttactaataaaccattatacatttgcaatcagttacattgttttgtgggaatgaatttcatttatagaacaacatgcaaatgggtagcatgagttctaatagtaaatgtgccattttatgtaaggaagaaattggtatataatagtgtattaatccctaaaaggaaaccaaattaattacatagctaataaaaggaagtgcatacattgctataatcttcttcaatggcatattaaattttgccatatattttatattacacacatatttgtgtttgtagtgcaactagtttttgatggtctgttatttcatattccaaatctctgggtttcttccttctattgaaaatatagtaatatagttttttaccttcatgccattcagtaggtttgttttaagaaattaacactgattttcatgctaaattacaagaaatattttaagaagacaaatcgttcaataacaagttacaatataagtcagaaattaattctaattaaagtgagggaataaatttcaaggagggaacaaataaggtctttcaggagataatatgtgcattgaggtttaatagacaaatgtgcgatcctgtgagggcacttctaggcacagtgagcatgatgaacaaaagtgggtgacatatgaaatcgcagctcttatttgatgatcagatagctagggcttgagtgagaaggattatagtgataaagctaggaaagtagaaaagttgcattaagttctggagggctttctatgttgtaccaaagaatttgtactactctttgtagttatggaacaatggccaagaattcttaaggagggcataatgattaaattttggctatagtaataactttaagggaagttaaagttattactgaatactgaactagatatgagagaggctgaaggcaacaacttcttttggaaaaattttaggcaaagactctgagctaagatcctgttgctgaaaatgggagagaagggagggggatgtgttagggacacattatggaggtagaactagtgtttagtaaaacaatgagatgtattaagggtaacacatgacattaggtttctgagtttattttttaactattctttttaagccaaattcacttcagccaaactaacttggtcaataattttaatatttttgagtgtgcttattttactttcctgatactgattttcttccatctcctcataaaaggtttatatattatatgtcctccaaaaactcatgttggccatgcatggttgctcatatctgtaataccagcactttgcggggctgaggcaggaggatcccttgaagctaggagtttgagatcagcctgggcaacaaagcaagaccttgtctgtacaaaaaattaaccaggcacactgacactcctgtagcctcagctactatgaaagctgaagtgggcagatggcttgagcccaggagttcgaggctacagttagctatgatggtactactgcagtaaactgggtgacaacaagacattgtctataaaaaaagaaaaagaaaaacctcaactattactcctccaggaagccctctctgatttttatgatcaaaactaatatctccttagaagtcccagaatattttatttttacatttttatgacaaataaattattgcctaagatattacattttggtggtgtaatttgatgtaatcctaaatgcaagcccttagaaatacattttgttggtgaagtgcaagagttcagggaccagcgtttactctaccacttaccagctgtgaccttgggcgagctacttaatctcacataactttaagtttcctcacgttaaactgaggaaccatgatagaatctatgcattgagtgacatccaagattattattaacattaaattatacacacacacacacacacacaaaatgagttctgatataagtcattgtacacacacacacacacacacacacacacacgagttccaatataagtcattgtatattttatatatatgtatatgtgtatgtatatatgtatatatatacacacacacacactacagtgtaatgtccttggaacaaaataaatgcttggtaagtgttaattattgggtagcatgagagtttatgtttgaattatttagaatatttaagggagtggggaatggagattttcttttaaatgatgggtccatcaaattaagctctcttaacatcgggctcttaaaacaggataaagacttgttgattgggttcagtggacaaagagacggaagcagtttcaaatactcactttccctaaaatctccttggtcattcagaaagtcaagtagtttttcttagaatgaatgtggctctggatagtggctgtgtgtgatggtagtgataccttttgaaaatgacttggctatgttgggaccttttcatggatatttttaaaaagagtagtggtagaaaaagctggaaggacaagttagattaaatcctggtgggagagtttttcacggacacccacatggagcgagtaggatctcattgtatcgcttaaacagtggtgagggaaaaaacctcgttcagtaaaccggggactgaatggtaaggtggggaaatggctggaataagaatagagaggtgtcatgaagaaagaagagaaatgacaaagcaaacttgttagcagagtgaataaaagtttattcttaaattatttatattgtctatagcaggggtccctaacccccacctgcagacagtagtggtcactggcctgttatgaactgggctccacagcaggatgtgcggggcaggcaggttcattaccacctgcgcttgcgctccttttcctgtcagatcatcatcagcattacattctcataggagtacgaaccttactgtgaactgtccatgtgagggacctaggttacatacttttaatgagattctaactaatacctgatgatctgaggaggaacagtttcatcctgaaaacatcccttctacccagcccccaccctggcacccatttatggaaaaattgtcttccgcaaaaccagtccctggtaccaaaagggttggggaccactcgtctacataataaggactccaccttctttatactgtgagataacaacatttgagaggttagttttaaggaatttttctatccaaagttttctaaacttattggattggtataatgtgtacagttgacttatatcaaattctttttatgtaattcttagtggtatttggagcaatgtttgtgaacacatttggcgaaatgattatctaggcatagaaagctggattaaagtggaagaggaacaagatacaaggctgagatcaaagtgaggaatttcagaatttgtgactggaaatgaaaaatttgactgctgatgatgacttaagtatggctgtgcttgttgacagatggaaatgccatcaatttctctctccaaaagactgagcagaggaattgggatgagaggatcacaggtataagaaaaaaaaaagaaataaaaagaaaaaaatctttgtcacagaattccaggatgtaattgttttttctcctaacttgtcagtttatttgttccaacaaccattgacataaagcttgtaaactttttaatttgtggttaattaaatttgtgactaatttgctgtttattaattatccatttgttataattaatagatacatgtgttaattatgatgccaaaagtagcagcttatttggtctatagaataactcaaaaaatcctagtttttaagggccatattttaagtgaaaaagattttctaaaatataaacctttagtttgtttcagataatgtaataaaacacaatatgatcttttagagggatattgcattagatcatatttgggttccccacaatttcttcagtcctagatttatgaaaatgagataggtatcacttaattatacagtaacttaaaataataaattttattgcttattttcctttcaggtgagaacttattgcactaaagtttctcaatttgtaattgtgttgtcaaggacagatgtgcatggagcactaaaaatagataaattttaaaatggcaaatgtaaattctttgaaataaatatacccgataactgataacattcagaaaaaaataattatgtattgtatctaaagaggtctttattattttcatagaagatatatctgaaaatattcaggaggcattgcttaatggcagctgaaacaagtgaaaagcaaatggaaacaaggcagtcaccgtctgcagagcttttaatagttttggtgaaaaattaaggaccacctgccatgttgaattttatgagtgatgcagaggtacttgccaatacattcatgaataagtgaaaaaacagggtttttaatagtaacacaaaccttcaaatggagttaataaaagacaaggctcttctttactgggtggaaagttatctgctatatagaaaggcctattgaatgaaacatttgtcctcaaattccctttaatctactgtgaggttctgcctgttacctcacttggaataatgtgccaattttgtaaggataaggagaattttatccttttttcattcccttagctatttgctgcagcatttccttgaatttcacagtacctgcctgtttttagcagctctaatttcagactatcactttcctgaactaatgtgtaaaaactgatattctcatctttttgatggagaatattcacgaaatgcaatcccagtgagaatgccacttactaatggatatttctttctccggacatcttaaaaaattctgttcaactctttatacctcttgttctttataaaaatggattaaaatgcctggtaccatggtggaatgcttttattgtcgcatattgcttttgtattatatactgtaagtggttattgttcacatttcatgcctttaacagtttgagttaaactatattttcgtttccccctcccaaagtatttgtcttgtggcagtttagaactggagcgcaggaattatgagagatattattagatttgatgtgtttggtctttactctttgcttttctaagataattgggtactgctcctacagattgaaagggttaaatggattaataatggattttttaaaaatgttgctggagaatgaaatctgttttgtcactgaggcaagaaacccagattcttcatactaaatcagggtgctttagttagtatggaggaatgttaaaaacaaacaaagaaacaaaatcttttcacagttttaaacttgtttttgagcagattgatactgggaaatatattgattctaactcctaaaagcattggtagaggaactgcatggcaaaaaatttcacagaatctctaaatttcagaactttggtgtatgtttaggttattgtttgatgtatgcctgctgtatgtctaggtgtatgtctttagttattatatttagaatgaattttactaatggactcatcactataatttcaagaacgcttttatttccctttattgttattttagtgattatggtgacattcattctgctattattaatagctcttttttcactcttgaaagggtcctggtttgattgtataatcactggccgtataaaccttttggcattctatttccacgtattttatgtttccaaaacaatcacttttctaagtgtattcttgcatattttagctttttaaatataaaaagttattgttacatatcgtatcccaagttaaattgatcttcatgtatctgataattacattccctaaaaaaagttattataatgctctaaagttaagttattaaactgtgactcaaatattcatatttcataatagcaaaatgcccaactataatttttggagccaaatctagagctgaaaatgtaaagcattttatagaattatttgtcaaatttaattaaatggaaagaaaaattatgttttggaggaagaggcaattcaaatttttaatttttctttctacctaccagaattaaccttcaattagagtaagtctgtattaaagcaaatttgatttttatagttcattacatatttatgttctgatcatagtgccaactatcccatgtgtaacataatttttacttgagtaatgctaacgtatttctttttcttgtattacttatgttaatataaatacttgtttataattttattcatttcagccatattcaatatatgtttgtgtttttcatctccatttctatgtggaatggctagtgaataaaatgtatacatttatgaaatgattagaaaattgtaattgacagtaatgaagtaccagattgtacagtacacaccaaataacacaagactttgacagaagtttagaagcagaatccagaatctagaattctaaatcctgaagcaccataatttactagaaacagaaatggattcagaaatgaatgactgggttctaagcctatttttactacctagtcatatttcaaaatatagtaagttacttaatctctctgagcctccacttttgtaatctgtctaatgtgggaactttacttgtcttgcctatctcatatgatgcttgaggaccctacttgcaattgtaaatcaaattgcattttaagttccagtgttttaaaatggaatctgcttgatgtattctggataagtgaaaagtataagagtagagactagggaatatgttaaacatctcttgatttcccttctcaaagattttctcgatgtccagttcccgctaaactaattgatgcatactgcctcagtctgccgtcatcttcttacatgtcatcttgcattaccaccgaagccctcccgttagttttctgcctcttgctaatccatcatggctacagtaatctttccaaatgcaagtcttatcataacactatcttttaaaatcccttcagtagctttcttttcctcttagaaaaaacaacatcttacctccttttcctgtctctcttttcagctctgacctttgcctctcttccacttgtatttggcacttcagccactttgacattgcctcaaggcaccatgatcattgccttagatgtgccatgatctttttcctctctattagttatttgcctatgaattgtctctttccagtctcttgaatatctcttacattttctgcaggtttcagttataccaaagacaccaactgtccatgtttctacagtgatctcctttcataacacctaatgctttattagaatggtttaatttattattggctttctacaaactgagaggtctatgagggcaggaactgtgtctgtttttcttcctacaaggggtctagttcttagcataataagaacataagaagtacccagaatatttcttgaatgaattagcgaatgactgaaacaaatcaggaatgtaggatcctgaatgaggtgaagtatgataacgatttgacacagagttactgttatgagagggtcaaaagaataacaaacaggaattgattacattgatatgagaggtagaagaaagtagaaacttttaagttttctgctgttaaaggaatgacaaatttggagggagattttcttctggttttccttttgaaatttgaaatagggacactgatataagataagggatggtggaaataacaatagttctgtcaacttaaatctatgtagcacattttttttttttagtttttcaaagcttttttcttattttacagaattatttcaaagttaatttccaagcaaatcatctagggaactttgaagaaaacctaatattttaaaggatgaaactaacttttctaatgaaattatggttttttttgtttaaatattttgaaaaaaaaactagcaataaccattatttattttgtttagttaggatgggctctattacaaggacatacctggagcctagaagtaaaactgatacctgtttgtattaaaacagaatttctcaacagtagcactattgacattttgtacaggatcattctttgttatggaaggcatataggatgtttagcagcatgcttgatgtctaccaactagataccagtaacagacctcctccacacccagttatgatcatggaaagtgtctgcagatattggcaaatgtttcctacagggcagaatcaccttcatttgaaaactattgcactggagagttagaaattatattccatagataagaaaatttgtaaagtgttggagccttgtaattatcatgtaaattttttatggatctttgatttcctcatggtggttatatgtaaaatgtaaagcatcaaggtgattactttcagatacttccaggaatgcggaacgctagggatgcaatgctgcttgtctcaggaaacatagacatccgagcaatagagtaggtgatgagaacttaagaaaagaaagacaattaatttatgttttgagggtcttcctcagagatggaaggagaaagcacctgagtctgcccaaatctttaacttgaagcccagggctgaggagtcaaaaagctcttacatttcctcaaatgtggggcttccgttacagggtatgcatttatgcatacaatctactttatttttgttcaaatacattgatacggaagacattaaatgttattttataagggaaggacacgattttccagacaatcagctacatgtatttcagtagttggaagaagcatcttctgcttctgttctcatatatcatgatgatcagttatgttctcaaagaattcatgtcagttatttggtggcagactttcagtgctgaattggtttatgaaaatggaccaggcgtggtgacttatgcctgtaattccagcactttgagaggccaagacaggtgggtcgcctggcaccaggaatttgagaccagcctgagcaatatagcaaggccttgtctctaaaaataatgttaaaaattagctcagtgtggtgactcatgcctgtggtcccagctgctcaggaggctgaggtgggagaacttgagcctcagcaattgaggctacagtgaatagtgatcataccactgcacttctcctgggcgacagagtgagatcctgtctcaaaaaaagaaaaagaaaatgaaaccccacacaaaaaaatgtgtcccctgataattactggtgacagtatagcagtgtgccctctctcttcctctcttgattattttcagactcattaatgatgagatgaccaacccccacctccttctgactatcttctgccatgtccacatggcataaatcttttataatgaatgttctgtggacccactggataggagaaataacaatggaagaaattctaaaatattttccttttgtgatcatgaatgaggaaaatgggagcttttgtttttcttagttgcctttagaagaaaaattgtcagattccttaggttaggtgggaagcagattaacagcaaattgtgtatagagacttacatcactgtttagggtagcaaagaaaaagcatgaactgacttcaaatgtaagttatattttcacagaactctattcttttttcattacttttttgattagtgaattttttatctatactagctgcctattaggagtttgttttttttttttaattcaggcttccaaatcttggagttttttttttgtttgttttttgagtcaaggtctctctgctaggctcactgtaacttctgtgtcccaggcctaagtgatcctcctgcatcagcctctcgagtagctggaactacaggcacatgccatctcactattttttttatttttatttttttttagaaagagagtttcaccatgtttcctgggcttttctcaaactcctgagctcaagccatctgcccaccttggcctcccaaagtgctgggattacaggtgtgagccaccatgcttggcctctctgagtttttatcagtcttgttaagttgtttttgttgtttggttttacatttcaagttacacatattggaacatgagtttggcatactttcttccattatagagtggagggtagagttgtacttctaccaaaataacatgctaaacaaagtaagtttatggagatcaataacagaaggaaaacaggcttattttcaaatgaatattttttaatgatattattttcaaggatccagtatacattgtttccttacttgttgaaattattaaaggaatttctaagttgaaactttcagacatttagttacatggtttatataatgaggcagttaaacagattgcaaaaatgttaaaaactattcagaaatttttgtatgttatggaggaagcaatattatcttttttgaaatgatattcttcactatgttataataattatgatgataatattaactgatatgtgtaaattacttactgtgtgccaaacactcttacattgttctttaatttaatcctcatagtgatcctattaggaaagtgtcactattattcctgtattacagatgaggaaaccaaggcagtttcctattggtgatctaatgatggttctagcacttgaactcaggagttgaactcaaggtgtttggctccatagccagcagtctgagcgactagtctccactgttgtttaattattttcttaaccatccatatgcattcacagatacaagtttcttctattttggcaaataaaattacaatgactataaatatacataaaaccacaacatatttggcagtgtcaaaggttcgctagtaaggcatgacacttaaaaggaagacttaaaatgattaaactgtgaaatataaaggtaatatatttgacacttctacatttagttagaaaaatatgatcttgcaagattttagtgagggtataatgtactcagcatgagacagatagatgatagagagatagaaacatagagtatttgtctatgtatataaattcatatctctattcttgtctgtagtgctaaaatagaggagtgggaagacagatgagggactcaattacctaacccagaggtcagatatggcttcactaaggaggtgacgtgttttagaaatttagcaaatatacctgtaatgactctcttcagggagttagcactacatagtgtactccttcatagaactatctctagatttgacctgaatattttttttaaaagctctggttaaatacctctagtgcgacttcatgttattttgaggctctctgttggttaggaatttaatattctgttacattcttaataattcttctgacatgttatacatttttatttatgtagtgttatgctttatttctctgaaaattaattgatgtatttatgaaacatgaggtatattgtgaaagcctttattcctttatgtactagtatatgtcaaatgagctttgaagtgattttttttttaccttttgtaaaacatgtaacaatatactaatccattagtaaatggcacacttatgttaagcttgtgattattcgaaagagaatacaccagaaaaaaaaaagaagagtgacaaatagagcataaacctttgtcattctacagaaatagctttggagatattggtgaatcatgagagctaaaaatactactaatcttgataccatcatctaagctctctaattaaactgtctcacataatactgtgtgataatcctatatggtaaacaactggcaaaaccatgaaatatcagattccagagaatcatgagtagaagtcaatggcaagagtgagaacctattccatacaattttcacaaatgatattgaatataagaaatgcagtgtaaaagtactaaattacacgcaagtttccctgacctgccttatggaattcaccatttctaagaagtcagggcttctgttcttgactcaagtctttttttcacatgaccaagttattgaacaattactttacacagaacatttagattttaagaaaaggtcaagaattattgctcttggagatgtctgttaactttgtaatttttcccttttgatattgaagcaataaagtagaatttgtgattattttaataaaattaaatataatataaagagaactagtggtttctagctgttaattccaaagatatattactataattattgactatatgtcaaaatacaaatatatcttctgttatataatcatgtatcacaattaaatatttgaacagaaaatgtatgtattttaatccagacaactattttgacaattgttgaagacatatgcactctaaattgtaagagtatataccataattcagaaggaagtactacattttcagaattctccatctccttttagtataattttgtttaaaaaggtagtggaagaagtaatttactaaaaaattaatgaaatcatgatatagatattaaggcaaagccaatgtataaacttaactattatatttttcatgtgaaaagtggaatgtttaaccatattgaatagcacttaggctgttatagctgcaagcacaatgcttttgagttagtcactcaacacatttcatcaacaaacagaaaactatttaaaagtttggacaacctatgccatttgaggccataacttagaaggaaaatttataaagcaaagatgtaatggaaataacaatcaaaaagcaatgcatcttatcttgctaaaaattgttttctctaaattctaactttgtgaaatattttatagcattcaacactaatatatgataagagtaggatttcagtctgggaaaatcaaaaaccttaaaaccttattgattctatgtctagacattatcttttaacatctgtagcatgagaagattcactttctagcctcttatttaaacagctgctaacttaaactgcaaaataatcatgttgaaaaatggcaaaaggaatagtcatactcttataaggttgtaactcccctttctgtaattgctgatatttggcaagtattaccctttgttttgctgtgccataggtagtatgctcattatggtgaaatgaaatgaaagcataaaggaaatgttcaagcatcagatacctcctttatcattggtgttcatccactcacaaatgtttatttaataagttcttatacaatgcttgattattcctaagtaatataaagataaatcattcaccccttagcttttagatattctgtttatttagatgcatgtaaaactagttttcttatcagtcttttgaacatttacccaaaagggtaatttaacttaaatgttgaaaaaaaattgattctaaaaatattgtctgatccattccacctggtatccatctgtgacagtatgtcttcacaatctgtcatctgcttttatcctgtatgttcttaaccacttcatttgggtgcaatctttgaactgattttttcccttccttatttctggtgttctggttagtataaattgacattttcaaatctttagtcaggttttgggatgatgtatactaattaattaggaagatgtaatgtaccatcagctctctatacatattcgtttatagcaccattaatatagaggtagaatcaatcattatattctagtttttcatttcctttgtaagaactttcaatgcatttttatttggaaatgtatacatttactttatcatcatttcctatgagaaaacagtacttcacttctaaatttctaaattctttcagattgaaatatatgcacacataggtgttgagtctaatactttgtagcgcttgtcattacagttgcctctcagtatcaaggggggtgagttacaggatccccttggataccagcatccacagatgcttaagtcccttatataaaatggcatatatagtatttgcatataaactatacacatccttttctatactttaaataatctctagattacttacaatatctaatacagtgtaaattctaggcatgtagttgttatattgtgttgtttttaaaatttgtatttttgtattgttgcattattttttgttatttttttccccaaatatttattatccatggttgggttaatccatggatgcagaaccagtggatacagagagctgactgtgctttttctttttttttttctttttgagacagagtctcactctgtcgcccaggctggagtgcagtggcgcgatctgggctcactgcaagctccgcctcctgggttcacagcattctcctgcctcagcctcctgagtagctgggactacaggctcccgccgccacggctggctaagtttttttttcttttttttttttttgtatttttcgtagagacagggtttcaccatgttagccaggatggtctcgatctcctgacctcgtgatccacctgcctcggcttcccaaagtgctgggattacaggcgtgagccaccgcgccttgccgactgtgctttttctgagttcactctgaatattaaggtactttacagttttgcctagtttataacttgaaaaatgtaaagtagtatatgtacatataaataagttttcacctttagttttgtcgtgcccctccataggtcataaatcaaatgaattagtatgtcttagagacatatgaaatgtaataggaaaccaaatgtacagaagggtgtgtgaatatatatgtgtatttatgctcataataaaagaaaacaaaagatgtaatatcccattgtttttaaatcagtgtttttgcttactctacaattgtttaaatatttaaaagagagccagtaagaaataaattgaaattatttttcataagaatcagtgatatttctgttttccaatagaaatgttaattattagaatttattttaatagtggcctgtctagttccaaattaccaacagaaatgaaagtattgtgtacttactgtatggcaattctcagtaatctaaaactagaatattacttttttgggtttgggtaggtcatgtatttaaagaaagatagtttcttaaataatccagagcaggaaaaaactattattctttaaatttttgccttggaaacaaccctgaaatgatagttttgttataacttataattctcagcttagttgttttccttctcttggaccttttctcccctgtgttcagagaaggtattcaattatatgctcctaaaatgcttttaatttcattcgtatactttttgttgttactgtattaaggatgcttacagaatcatgttaaaatcatctaaagtattagtctaaacatggctgtgcagttgtctccctgtgcagcataacagggagacttaaagactgaaagccagtgaagtgtctctccttacttctgtagccaaggctgcactcccctctactaagaatgtgccacatcagtcctattgctctgatgactatgaaaaatttactaagtggtgtcagtgaattaacctttggtaagtgggatggtgtcaccagatgcataatgctggaggatggataagattccttcattcgtccattcaataaacatagattaacctcctgctatgtgctggacattgtgctaggctttgggaatccatggatacatatattataatccctgaacttgagggtttcacggtgagttagaggacacatgcataaagaaataattatggcagtgtgaatgacatagtggtggtatgttgtattgagtgaaactgttctcctaagtagccttaagagctcagaaaagatggaggaggcaaagcgtttaactgattcatgaagaatggatgttgctcttttaaaaagaatgaaactatatagggttattctttacatatgtagctactttttctgcagagtttgttttaacagacaattaaatgatattctgctactggctacgttgtctttttgcaaaattctatggatgcaaagttagtaggataatggatacaaagagatgtggcaaattatttacttgggtgtggaggtaaaaatcagcaattaattaactggttttctcttatgaaggagtagaaagtatgaaaatacagtcagaattcttactagtttatttctaaaaattctatgtatcttgcaagtgtgtgtgtgtgtgtgtgtgtgtgtgtgtgtgtggcctttatttttcttttcttttctttctttttctttgccagctcttttttttaaaaaagaaaggattgagctcaacaacatttttctaagcatttattctgcttgttattttcttttatttctaagaattaaggattgagtgaatacactcattgtcctgacgcatccatttaatatgtcatgcttcagggtaaactgatttctttatgatctccagaaaattttccactgacataacagaaatgattatttacctccccacatgttcaaactgccttaacctgctttagggttatttgcttcacaagacttagtattgatccacattttataactgactaaataaggaaacagagtcttcaccaaacagctagaacgattgctttaactgacaattttgctttaatcatttttaaaattatcgcagaaaactgatagtgaaaagcccatgtcttggactgctttgcatagaagtatagctctttattttaggaaattaagatgaaattaattatcttctttttagctgtggatttttcaaggcttgcaccacaaatatatagatttaaatatattatgggagaaaaattaattattgacaagccactcacaagatagtccaattttaatccttcgaattggactaaagttgcaatttttattaacttgaagtaacctgaccttatagaatattcttatattgccagatccttcattagcctcattgaaaatcaagccaataactgccacagatagctctccagtttatatataaaattggtcaataatgtgtccctgcacacttcctgcatgtctacctgtgctgagtagttttctcatttcacattgatgaaatgctacagctttggcaggaaaggtgacttcagaatttatagtcacctctgaaataggagataattgggcatgctgtaaaagatacaagttaaggtacaatgtttataatttatataagtaatttactattaaatatcagaaatttaattagcttaagctcataatcaactgattatccataccatttgaagccagtggtcaaaaggataatgtagtgtttagagatcctcattatttgtctttttagctgatatacctttttggtacattgcctgcctgacacagtaatagatacacagtatgcaaataataataatttggtcgaggaatgaatactgggctatatttggttaataactaatttgtatttcttatttgcttacacatttgggaatagggaaagtggttcagaggttgtctggggtagaaactacagtgggatcaaaactttgcttggaaattgacattgtaaaatagtcacagtacttaactaattattgagtgcttagtctatgccaggcagcatactaagttcttcacgtgaactatgcactgtaattcataacaatcttataagatagtcttattattattttctctattttatatatgggaaaactggactcagaacttgagcaaatttgtaaagaccacacagtgaatacgtactaggagagcagccagtcttataatttgtgtgtgtgtgtgttctaacagtcttataattgatataaagaacaagccatcctacctctttaggatcattgaagtgagaccttatatagtgagactgacaatgtctatcattcaaaatatgaattttatcttttgaaaaatgtgttaaaattatgtaacagcaaatgtaatgttacttaaaaaggggaattatcactcatattttttaacatagagcctacactctctgacctttctcagtaggttttcataatgagaatgtataataaaactgatgtgcaaaatttatgatactttagtaaatatgagaacaatttgaaaataaacttggcagtggcataaatgctattgaaaattgtgcctcctgtctgaaatcttccaaacactaattgtggggtaagaactctcctaattgttgcctcttgttcataaagacatgtcctcaaagaagatttttagtagaataaaatggtgctgtgtcacaaataagccagacttttaagttcctacaaataaataatttaatgtttgagtttattaagctaacttcctctaatttaagtatttttagtccatgggaaccccagaataatactgttttgtcacagacttgaattagaactaaaagtactttattttactgcttttcctgtccagctactagatcctgagatttcatagttcattttttttaatctatggggtgaactctcagagtaaacctatgaggacattattgagtgacatccagaagggtttgcatttcattttgaatctttccttttttgcacaagttgattctttttaataatttacatgacttaaaaattctatttctggatacttacctgcatgaaccaaaatgaatgtgcacatcttcggaaacacagacaaggttcagcaacaatggcacggtgaaagcgagaggtaaaccggttggcagacggatctctgacaagaatcagacaccatcaggggtgccgtgtggatgcaggacagcccctgtagaacctgttttttaacactgttgcttgctaaggcatctctgaaagactaagtgggtgtactgtatgtttctatatggtatatttgtaggggcggttaggctgatgatggtagaaacatgcattttttaaagacagcatttcaattaaaacaattggaaggtagtttagcagctagacatttcattactgtgttcttgttataaacaatcatttgcagatagaaatataaataaaaactactatgtctgtagcacgttagagttaacaaggaaataaggaagtagaagcctaatgtgaagtggctttgccccaattgtatgctagtaaatggtggagtgtatttgaacatagatcctttgaattaaaatctgaatctctttcactgtatcatattacctcttcaacacaggctcgtatttataaagtagaatacataacaagacaaaaataatactagaatattctaacttgactttttttttcttttttatcatttggataatgacatcagaattatagtgatcatttgatgaaataaagagtcataactccagacctcaaccagattcttaacatattctaagctgaaaatttaagtaaagatgtgttcacataatgctttgttttatttcattttacattctaaactttagaaacgaaactttttaaagcttcttattttacatgtttttcttttccactatatgttattaataaaacatcaaataattaaataacacaaattaataacaaacacacacgtaaaatgccttgaaatgagtttttcttgttagttttaaaaatccccatgttatcatcgagcacttaagtacctgttatgaaaaactttatattctgcatgctgtcttttctaaactcttgcatgttagttccagggtgatagggatgttgttccacaaaccataatgtactcattacatcatgttgtttttatcctccctgctcgctgttcattctcaacgtgaaaaatcatagaatattagtgacaggaggtctgtattttaggcagacttttgtaattattcccactgaggcatagtcaataggattaaaacacagattctggatctgtccatcccagatgaggtcagttctttgagcagtgggagtactatttctataagctgtgctttcccctttgccttatagaaacatagatattaatatgacacaaatatttgaaagctcctatggaaacagactggctttgcctgaattaagatgaatattcatctgcaataaataaaataacagcattcattagaattcttaactacgtttgtatgtagattttacaacaatgttaaagcccagaaagtttcaattacagaacaatctacttacagttcataattaataaactctttacagctgcataactgtggccagcaacatctgcaaagccttatattttacacacagacatacataattccttcagaaaatgttcagttgtgcttaaaatcacaggtctggaaatggggtaagacctgaggaagctgagtcaagttgtattcctttagctcaagggagagaagtggagagatgggagaaggaaaccagacctcatctggcaaagtaatgtggatgaaaaataaaaatgtttaatatctattcagaaattcaatcacaaatatttctataaaatgtatcaaaaatctcctctaaatataagcttggttttggtaagactgttttttaagtgataaaattattactcctcagataaaagataagctattatttatgaaactccaaaaatacatactaaattaacaaataggttaaaacaataccttgataatagatttctaatagtcttaaaagtaatccataggtaatttctttttttagtttttaatttttgtgagtacacagtagttgtacataggtaatttcttttacctaaatgcaactttataaaatttgatgcatatagagtatatatgttagaaaaataaactaatataagcaaataaaatttactattttttcttaatgtttgcctgtttaagtgttcagatttgaaggtacattactgatgaattttttttttttttttttttgagacggagtttcgctcctgtcgcctaagccccacgctggatggagtgcagtggcaccatctcggctcactgcagccttcacctcccgggttcaagtgattctcctgcttcagccttccgagtagctggggttacaggtgcctgccaccacgcctggctaatgtttgtatttttagtagagacaggatttcgtcatgttggccagggtggtctcaaactcctgacctcaggtgatctacctgccttggcctcccaaagtgctgggattacaggcatgagccaccgtgcccggccctgatggattttataatgagagctttattaagatataattcacatatcatacaattcccccattaaagtgtacaatatatggatttttgttatagtcacagagttgtacaactgtcaccgcaaatcatttttagaacattgtaattaccccaaatataagccttatatctatcaacagtcaaatgccatttttgcttactaccccatcccctgaaaactggtaatctattttctacatctatagatttgcctatttaggatattttatgtaaattgaatcgtacaatatgtagtcttttatgattggattctcttatgtagcatgttttaaagattcatccatgttgttttatgtgtctgtatttaactccttttaattggtggattatattccattgttctaattcattcagtagttgatggacattaggttgtttccactttttggctattacaaataattccactatgaacattaatgtacaggtttttgtgtgcatgtatgttttcatttatcttgagtatatacctaggagtagaatatactacttgggtcatgtagtaacaatgtttattcttttgaggaactggtagtctttttgaaagtggctgcaccattttacattcccacaagcagtgtaggagagttctaattcctccatattttcaccaacacttgttatctttttggttatagccatcctagtagatgtgtggttttgatctgcattttcctaatggctaatgatgttgaacatctttttaagtgctcagtagcctttggcacatcattttttatgtgtttattactcatttgtaaagctttcatggagaaacatcaattcagattccttgcatatttttgattggcttattgatggattttaatttttgcactttttaaaaattattgataatatctaattttacctcctcagtgttataggggagatattttattatcatgtattctttagagactttgatagtccaagaaaatacctggaacctccaggatgttggttctgaacacctatacaatttttttaaaatatagaaatgtctaggccctaataatgatttaattatttggatagagtcaagacattagtgtcctatcaaagccttcctaatgttcagccatggaggatagccaagcaagatatggattatcagtgccttaatgttcaggatggtgtgaagtatgtctgagataaaagttggtgcttaagagttccaaaaaatcagtccattaaggatcaggaaatctttttttggctgtaaaagaactctagaagtaggtggattttctagcaacaagattgtcggaagggggatccttagaaatataatcaggtaagatttctcccaagcatgcaattataggtcataaacctaaaaaactggaccaagtatgggtatctgtgcccattcaggaagaagatacattccatttctacttaattgcttaagttaaagaggcatgggaatgtatggcttttgggtggcctttaggattgttcatttacagttgttataccagtaccctgattggtccactgactgcataatgcaagtatagtctcagtggcctggcatcccattgcttaaacaaaacatctattgaagacaactatggattatgtgattgttaggagaatttaatggagaatcagcatagaaggttttggtatcaactctcttgtatatttaaataatttgatttcagaattttggtgcttttttattcttaaataatttataaatgggaaacctgattgcctttcatgttctttgttaaaaattttaaattaaaaatattatttaaatcaactttgtgggacaatatttaaatagttgagattaaatacaataaactacatttatttcataacagtaatatagcagatcttatgacttaatgtgttgtaatataatttagtagatatattgcagtaaataatactattactctggtatatagaagtttcatgtatctcctagatttcctttttctttggtggttttgcatttaaagaacagactaagcaaaaacttgcttaacatatgaaatctgacaagattacaggttttaactctaggataatgagcttattttattcattaaggccctaaggactaaaagaacagtcaaaagaatcaatcctaggccttcatggtatcatgtaaaaatactgttattaaaataagaggtgaaatattatttttacaaaagtaattaaatatttaaaacaatttttatacatatccctaatttttatcaatatagtgaatgttcagttagaaaagcaaaaacatcaaaagacacaaagttacaatgctatatttcgtaatgtcactaactttatccatagggtacatactatatcaaagggcacatgctatatcaattaaagtttgctttgaattcatgtgctattgaacagattgagaaataaagcagaggaaaaatttgtaaaactgctgttgcacaattcctagaatgttgttgtatactacataattatgtatgaagggaatttaaggtttcagaaggcatttacctctgaagactttttactagtagtttccagaaaaccagctgcatttagagagaggagaaattgcctggatttccatgtagcttttctgggagtagttggtgagctcgtctaactttcctgtatgtatgtatctctcagatatgccactttaccctgctttatctcattgagtatttaactctaagtatttcgtgtagatatcttatcacaatttctaatgttaagagcatctgttactgctttcccaagctttttccacccagtagatcactgttattataagaggtactgcttttgttttttttgcatgttcttggctttactctcaacaccattgctccagcgcttttgtacttacttttaataactctaaattggtagtttcctttgagatcaaatgaaaactggcttgcttcaacttattattttcaatattaactgaactgagacagaatattacttcaaagaaaaaatgttaagacttttatgatcacatttttccggtattgcctttatctatttaatgatagtcatacatatattccataattgtgcaggtatcatcagtgtcaaaattcatagtgaaattgacaatatctgtttaatatctcttcttaaggtatgttgggatattatttcatagctttctaagttaaagtaatagctttcaattagtaaaaatgtataataaaaataataaggatccattgaaaattaagttttagggtagctaaagcccttgagtcccattacgtaagtgtcaaactttggctcttttaacagtaaatgatgatggtagaatagcataaggctgagtgtcagtagtcctgtgttttaaatccagttttatcctagacaaacagaattattggaagaactcaggttacttttgctttaaatctgttttcccatctgttaaaagggtaacaaaattcaacgtaatttgaaagttaagtgataagagtttgaaatttctctgcattagtatcatatagattcttgaaatcatgtaagttgagcaaggaatgcacctcatttgtggaaaaaggggaattagcctttatttagaggcttttatttgcaatgggagaatgagaattctgaggaattccactagtaaacatcattttggaaatgttaaatcgtgttgccattgtccccccataacctccttgccctgtaaaacagtaaacatacacacaatgtcatcaaaaacttgtcagcacacacctcttatttgtctgtatgtctactttggttgtttgttttacttgtccaggccttaatgtctcagacagcgagttgtgagtaaagcattgctttctctgttttatggaatgttgtctctgatctttgaattacaaataatacataaagcaagatcaatgaatattttaaaaaagaagaatttccatcccgagaaatctaagctaaaccctttatcctttctgttaaccatattttttaatgtgacaagatcatatatttagaaacattttaaggttgtatatttttgttatgtttagtaatcaatatcattgttctctctatgccttatatttgcaataattgctattgaaaacaagtgaagatgcattatgcatctttgcttaatgtttttgtaactgctttcctcttgtattaattgagaagccaactaaagacaacatagccaactggcttctgagggcagtagtgggtcataaatttacaatgagatggttgtagccctgtataaatctatctgtctatctctatctatctatctatctatctatctatctatctatctatctctctctctctctctctctctctctctctatcatctattgatcgatggatctatattcacaacataacatacctttaaattgagtctttaaattatataaaatacctatcttgttaatgtaaatctactttcttgatgccccctaaattattttgagctcccaaatatatcaaaattgtgcattaaaattcagcatttgaacagaagttaagggatgactcaactgttttctggaaactatgacatctcagtactttaggattgttcttgctttccatgccccgcagagtgaaaaatgtggttaattttttgcataatacccaagtggagaatattaaatgaactttcagccaataaattaaatgctaaatttttatttatgttaaattttcactaacttttctttacagatatgattttcttttagctaaatatgaaggttactgaaatttaagtagatgtttatttaataaatatgaagaatagattgaatgtcttcaatatataatatattatattaataaaaattattgaaataatgtaaaaataacttgctaaattttcattgaaaataaatataaatatatgaaatgtccagtgatattaaatggtacactgttactggatttaattatagaatctaaatgaataagagcaacttcattaggaggtggcagaaatgctcgctgtccatctctgttcgttgctgagaaaagttgctgtgttagtgtgattgcaccctaaccctctctcggcagaggacaaacagggccataatctacttgccgttgatggctttccccttgtttctggtggtgcagccatctcctattcataggatttcattatttttagtaacaaagaagttcacttagtggaaaccagcctgccttgtaacttaaattggttgaaattctatcttggagtttcctgaaaatttgggaaaatatatttctatcattttcaggtgaaaaattttacatagttatttatttctagtctggtaattaaagttacattaatgtttttcaacatgaaccaaatcaacatgtcaaaagttagtttaaagctatattatattaagaaaacataacttgaagtgttctaatgcagaccaacaaacagttaattatgttgaaatccaagttaaatttgaattatatatcggaattaaatgttctaaggttttggctaaataaattatgcctgtattcagttttctgctccagactttggcgtggtgccaactgcaggtgcaagtttgctgtatcattttgtttgtattattttgttttaagatgaactatcataacatttggctagtgaaataccctaaaatgaatattttatcatcaagagcttgttttacatacatcacatttaatatttgattccttgctaaataatacaatttttttttaaagatcgatttgctctcatgtctcaatttttgctttcttttgcattcccagcctgtggccgtgggttctacaagtcttcctctcaagatcttcagtgctctcgttgtccaactcacagtttttctgataaagaaggctcctccagatgtgaatgtgaagatgggtattacagggctccatctgacccaccatacgttgcatgcacaagtgagttgtattatgaaagtaaaggactttccaatcccttccactcatttgtactgttgtgacatcaatgaaatagatattgaatttgtgatacattcttaattatacttaaatattaaaattattttaaaatattaagataaaattttctttcataagcagataggtttagtaatataaatatatcttacatcaactttggtgttatttccgtgtctgcaaaattaagatgcattttaatatttttcacatgtatctcataagaatcataagtaaaattaaaagttattagggtcagtcaggcagggtggctcatgcctgtaatcccagcactttgggaggccaaggcgggtggatcataatcacctgaggtcaggagttcgagactagcctggccaacatggtgaaaccccgtctctaccaaaaatacaaaaattagctgggagtggtggcgcccacctgtaatcccagctacgcggaagactgaagcaggagaatcacttgaacctgggaggcggaggttgcagtgagccgagattgtgccactacactccagcttggacaataagaatgaaacctcgtctcaaaaaaaaaaaaaaaagttattagggtcttgcatggatattaaatgttattaaaaagtaatggtttctgaattaaaattccattactaaatagagcagacctcactaaatagagcaaatctcacatcttggttcttcaattaatgaatgtttgagagatccaaatccaaagccaatctcagacattgctataaatcattcttgagtacattaaaatgaataaatgtattccctgttatgtggttaaaaggagaactatttttaaactactgcacagctgttttttttaggtgcattaactgtactgttttaattgcttggaagaaaaatagttaaagactgtggcaaaagtacaaagacagttgttatcctgttttcattttgacgtattaaaaggaaaataaataaagcctcttgccaagtgaattcaaggaggcttttatacagcttctctagtaaaggtaatgaaatgtttatgtgaaagaaagcatttcaactcgttttctctttggtaattgagccactagcttaatgccccacacagatccttttgttctttttgtttgtatgtttttttttctatttttgcttatttacttatttattcttggtttcccaagggcctccatctgcaccacagaacctcattttcaacatcaaccaaaccacagtaagtttggaatggagtcctcctgcagacaatgggggaagaaacgatgtgacctacagaatattgtgtaagcggtgcagttgggagcagggcgaatgtgttccctgtgggagtaacattggatacatgccccagcagactggattagaggataactatgtcactgtcatggacctgctagcccacgctaattatacttttgaagttgaagctgtaaatggagtttctgacttaagccgatcccagaggctctttgctgctgtcagtatcaccactggtcaagcaggtatgttttgtgtttatcttcactgaatgaaataatgtgactacctaagtgaggtgtcttacttgaacatttagttagtttctctgcacagagcttgattcttccagcttgttgattatttacagctttaacttttcctgttgcttgttacaccattagtgtactcattaacatcttcagagatctggcaggagaaataaaaggagataaaattggccaggcgcggtggctcacacctgtaatcccagcattttgggaggccgaggcgggcagatcacaaggtcagcagttcaagaccagcctgggcaacaagaaaccccatctctactaaaaatacaagaattagccgggcatggtggtgcacacctgtagtcccagttacttgagaggctgaggcaggagaatcacttgaacctgggaggcagaagttgcagtgagccgagatcgtgccactgcactccagcatgggtgacagactaagactcttgtctccggaaaaaaaaaaacaggagataaaattgtaaacccttaagactgctataaaacaaataactccactgaaagatctagaggaggggagtgaaaatagtggtcaaaatgaagtaaaggatgtattcacacttttacctttttgtttgttatgctcatgatcataaactacatgataattaggaataatgaaagagttggcttcattgtctcacataatgttacccaattttttactacatagactatgatctttgtaatacatgacgagtctgcattttaatatgcatgagggaattttaagttcatcagtagatttgtgatcatattaatttgcatttttatattcgaataaatggcagatttcatgaggatttcagaagaaatggcataaccatgataatagtgcacttgtagcttagcctaaaggtagtttacacttattttcttactggcacttgaaatgccctccttaacttattctttgttgtggttagttatgttttggaaaatacgaattggagactttctaaaccttcagaaaaatcttactgctgaaggaaatctcagaaattaggggctttctcagtcttttcaaaaattcttattgctgaagatagatgctatgtagtaaatgcaacaaagtgctacgttatcaacaatattaaaatcgggcctttactagagtagtgtgttgtgtgaacaatgtaacaagctaataacaaggtcctcttggtctttggctggctgtctaaaagcaaccagtgttatcccaaattcctggacacagactaatctattcttcatttccatgctaattttaaccaactgttacctatttagattatatctacataatgaaaactatgtatatgatctcagacttaccattttttaacaaattagtgggtttttattctaaaggtttcattctgatgcttatttcaaaggctgtttgaatcagatctcctatttataagagcagatatcgggaggtaaaacatagaaatgtaaatctttaataattagacaaaaaataagtgatttagctaattacctggacttacctattttactttggacttacctcttttattagacatatttatcctatttattttaaaatgctgttgtcataagatagttccacttgcgttgttttatatataaatttgttgtcataactttgcagtgagtggatttgaaacgtttttaggtttatgattttgacataagagctatcttttggaagcattaatataaacttggttctactaagttagaatgacattcttttattcctgctaatatcaagaagtgacatttttatttttgaatataaccaggagatgctgaactgataccagaaatagtgtttgtcaaattggccactttggggatgtcttttcatgttcctaaaatgtctattgtttgatttctcaagttaatactatacaggctaaatatattatcaaatttctgtaagtttctggaatcaaatatttcgcagttgttatgtaaaatggctttggatgttgattcccttctggttaagaacaaactaggttggctggagggttttttttttttttttgctttatttgtgggggaggttgatttaaatgtacaataaatatattgtgatgattgtacaacaatcctgtaaatatactaaaaatacttaatcgtatattaaaatgagtacattttatgctatttaaattatacctcgatgaaaagaaaaaatgataaaaagaatacctatacatttattaaataacataaacataaataaaggttaaaaaactaggtttgcagttttgtattaaaatactaattcatgattgcctagtctgactacatctcaaatgctaaaactcatgaatttacagttaactttttctaacagagaaaatttggaatgtgttagtgattattgttcttttgtgtgagtatactcagttccctccattaccatatttttgctcttcctaaaggggggtgatttgagactttgtccgagttcaaaactatccaaggaaccctgtaaaacccttgaaattatcattctccattaaacaaatagcatcatttccaacctagttcatgctgaaatcacttcaacaatgaatttaagtctatatttctggttggttatcttcctcctcagcaatccactgatgcctagcataaaagggtttattaagagaatttcatgtttctgggaaagcttagagagtcaggataacaaataatcagccagtgcttgaaaggtagtgtgtgtactttgtagttccttttctgttaagttttgagtttggagcacaagaccctttaccagtatttgtgtgagtagaagtgtattgaatatcctttgctcacaggaagaatagggccattggtatcaagggccctgagttctagtttctagtctaccactatgaggtatatacattttgggttgatcactaaactcctcatgaaaaaaaaaatggggataaaataatatctaccttcctgtattatcatgttaagtgagatgatgttagaggaaactaaactcatacattgccataaaaatgctaatgcagtgaatagcaaaatgaatgccaattagtcctctttttatgtaactctttgggaacctgtcaaggcaaaatggaccaatttctttatctgcagaagcatgagggaaaataatgtgagtgcagaattggcagttaacgtattataacattggaagagggagaaattaattttgtttggcctgtaaaaaatatgacttatctagttatcaattatcttatgatagaggttcttatgtaaatcttagctttaagatagatttgtattgaaaagcatattttaatattcatatttatatacttttaatatttacttatcatgaacatgccatacacaagctggctgaaccatacatttttgttcttgttgttttgttagtaattatattgacctattaaggctgaagtcacaaagatcaagttacgtacaacggagatattttttaaaatatagaagtagggggaaaacatatgtatttaatttatgacattatgacccttattcttccttatatttaaaagttctctttaaaaaatgccttttttaaccttttatgttaagttcagtggtacatgtgcaggtttgttacataggcaaacttgtgtcatgggaattagttgtatagattatttcatcacccaggtattaagcctactgcccatttgttatttttgctaatcctctccctctggccaccctccaccccacagtaggccccagtgtgtgttgttcccttctgtgtgtccctgtgttctcatcatttagctcccacttataagtaagaacatgtggtatttggttttctcttcctgtgttagtttgctaaggataatgcccacccacttcatccatgtcactgcaaaggacacgatcttgttcttttttgtggctgtgtagtattccatagttttccattcttaagcactatttaagtgctgctttttaatattagtttgtccaactacactaagtacctagtgcatgtcaagcactatgggggatgctaaggataggaaggtaaagaatggttctcttcttaagtatctaacaatagaacactttattataatgttgtagaacaacattgggaacaaaatacaaaactctgaagaatgattcattcagagaacaaatgaaagcccttccataaaagatgttagtcagtctagagtttcagaatggatgtgattttgctagatgtaagagtataaaagtaaatcctattctaggccctgaagaatactaccccttttctgtaatcagaacatggtaattgccactaccttccttcctgagactaagtatcgtagcacagaagtagtatgcagaagtatgaacgttaataaaaacagatcactcaaaaaatgctgtttctttctttaatacttcattcactctgggattatttaagcaattgtaatatgtggtctctcctcaaagggaaataaatgacttagcaattatccttcaaatcaggaactgtgtcatgtttatctgtgtcaccaccatcaaatacagtcttttctgcatactagctgtacaaaaaatgttgtggaattaggccaatgggaaaaccagaaaaattaaatcattatacaagagtgaaaccattaaggcattaatagaaaagacttattatttgatattagatgacataattacatgattttagacaagttacttcacctctttatactagaattttctcctcaagtggtacactatttgactcgtcatattgtaaaaattgagcaaatagcttaattccaggtacatttattagaataaaaaggtgtgttactgtcctgaaacaattataagagcagtaattaaaatattactatttattgaacacttactatgttcctggtactttttgaaatgtaaaatgtgcatgaaaagagtgtcaaagttgagtcaccttttttggcctcatattttccccataggcaactgagagatttgggacataagacctctcagacctccacatatatttataactaaataaataaagtagtaactcagtatagagtacaaacgtatcactatgctacactattcactgtacactattaataggtgagtgatactgtacatatactacagttcttaatgagagtgataactattttaacgctctggaaagcatctggaaggaattaggatgaaaactgaaacctcttgaaagaggttagggatagtttctcaagttgggctccccaggaagcaaatacttatatggagattagcgtgcatgagttttattaggaagaatgtttgggatcaacaccatcagagagaagggaagcaagcaggaccaagcagagcagggctgagctgtgatggggtctcattggaatcatcagccaactccatggggagtgctctacctgtaatgaaccctcaggttgtccctaggtgacagttttatacgtctatgttgtccagacatgggttgcagtttttcctaggagtgagcaaggtgttacttttcagaaaggaaattctaaatgaggcagggaactgaggcctgttttctggcaaatatctcggcagctgggcaaataatttcttcagtgcttttctaaggagaatgtgggcagcccattacaatatccattatagagggttaaattatgcaaaagaataagagtggcagcattcagagtgtgattatggaataatggtatgaactggatgaataaagatttgtgggaaagattactggggaatttttatttttaggaaaagaatcttttctgatagacagcggggaaaccggagtgtttttgaacaggaaagtaacagattgaccctggtttaacttaaacttttgtgtatcttccgcagtacatttcacatattacatatagtcgtttgttaaaaaaaaaaattcctgcctagtgttactgtggaaaaaatgtgcaaaacatacagtttctgaaaatataagaaagcttcaaagaatctgccatcagggtgtggagacatctcaactatcttcaaaggtctctttagagtctctcaaaaagaattatgttttatccccatcatcaattttgttgtgtatggatgaatgatctatatgacactcactcagattatattaaaatttgaactaaatttgtggagttgttaagacaagaactgatatcattttaaaagtaaaattttgagggttcgaatgactttacaaaggtcacacggtaaattatatagtgatgacccaaatgattgcaatcaaatacacttcttacctcaaaattattgtttatgcaatcttaccatagagtgctatctttaaaaatgtagctccataatccattacacgagaaattgcagattggtttaatggtcagtgataagagctgttaagtgaaaaggagacctactaagaagtgttatttcctgagaatattaacaaatgtaatctttgtgggatagcattgctaaatatagcatttgccttctcattactgttttattatctttcttcaagaaactttaaaaatagccttgcatattttaaactgaccgactttcctgtgtttttcaatgcccagatctaatttctcagccaaaataaaggtttgcgtcagtattccctttactttgatttgtaatgtttatataatgtaccagatgaaatataacctgagtcatgtgatataacattatacataagcaaaattatccccaaaaaagacaaaaccaacaatcattttctttatttgtcagaagtagcttcactcacatgaattaatgtgactcaactgtgactgttttctcataaattaacgtagatcatctcttttcaatgatttaatggacacacatcaagttatatgtcttttaataagtaaattaattccatttaaatttgtatatttttatacttgttaggaatatataagattgatttatattttaaaggaacatgatattgagaaaatatattttcttattttagaacatttattggttatataaagtaatattaaacacagcattctccacagggtgaaacaaggcataattgttttatcactaggttaaaaatatataaatgcaaaaaacaggaaccattttgtagagatagtgttattgttattaaaacatacattcatatgtacacctatgccgtctgcagcagagaatcaatcgaataaatttcctttaacagtaaactgttcaaaatatgcatttctgttacatttagacattttataaacctgaggtatccgaaagtgcaggatttagtcattctaattcatgccctgcagggcatgacattttagtaattcatatgctttgcttaaacaaggagtaactttagactgttagtgaaatttatttaagtatttttgtgacaccataaatatgaaaacatatatatatagatacatttacatttttatttagtggctgtaagttattaaaacatacaaaaaggatgatattttagataactattttaataaaattttaattaggtaacatactaccatgttgacattaatactaataaccaggatttatgtagtgcttagtataaaacatgttgattcctttacacgtaaaggcccatatgtttgcacagtatcttcacattccgaatttatcatgtaagtttaagagaaaattacatgtttctgtgatatggtcttatactaagtgtatcatatatttgtaatattcttcacatattagttgtgaaaagtttatctttcctcttaggcttcatgttataagaaaatggcggtacctttgatcatactctctagccccatcaacatattgggcccagggtagatggttagtaaatatttgttggctgagtacataaattctttgtatactgtaatatgcaaagaaaatttcttagactatctaggttgttacagaagacattaatttaattcaaatgatataatgttatttaaattatgcaatgagtacataagttaataatttcaagtatagtcattttgcaatttggtcctaaaactgtaaatatatttaaaatcttaaactgtttacagccataatgtggtatttacacaggaattttaaacaaaagcttaaccttcttataaaatattaaaggtacaaataaaccttaactttgaaaactttcgtaatgcttcatattttgaaagcttgttgaaaatataattaatttatatcttttatataacattgaatatgtagaagcacagagatcaggattggagatgctttctttagtacctaggaacataatatcagcttttcatacattattttaatattttttatagtttggtatatttaggttttaatatttttgtattttttttggtttggtgacagctttaaggctacagcacatcactgtgccatgactcttctcaattaaaacatacataaggaaatacctctaagtaacctgtgttctcatccccacaccctaatcttgccacctcaactccctgatctccagtcccagtatctttctgagttgtcaaaactatccttttctgatatggttaatatttgtaatgaaataggcttatgttgaggttatggtgacaagttgatctgcatactgtttaatggacatgctcttagtagactcttgaaaaaatcctagtatagagtgttttaagttgcgtctcatatttccaatttaatgcttctttatcttttcttaaattatttgatctttgaattgctactttgtaaataatgatgtttacatacttgggaagcaagagttcattttttgcaataacccagttattctactgctgtgatggaattgtgtcccctcaaaattcctatgctgaagccctaacccccaatgtaactgtatactttcctccacacacactgagaaaggccatgtgagcacatagcaagaagatggccatccccaagccagaaagagaggcttcagcagaaactgaaatctgttggaccttgacttgggacttctagccctcagaactgtgagaaaacaaatttcaatttaagcccctcagtctgtggtattttcttatagcaacaaatgcagactaatactcatccctgagataatttaattccatcctgaaaagtctttattttccatatgcatgaggacagctaaggcatgtaaaattttatttatgggacaagaaatgacagtggtagaaattttatgcatttttatgatttttcccctccaaaaaacccttaacttgtttagtgcagtacctttgtaagtagcagaaaatgaccaatagtaatgttttattttcaatgtccaagacaggtttttattttttaacagagccagttaatcatctaataaattttagaaggtgatacattgatggtaacagaacatccaatataaaagttataataaattttgttcccaagttttgaagcttgggtaagtttgtcaaattcttggcaatttcaacctaataatttctacaagattaagaagtcagtaccatttcaggattttcttaggaaaaagtgtttatagctctatattttggagatacaaatttgtaatttgctaaatttaagcatcctcttcaaaaaatatgacttcccattaggatcattatcctggaatagtccataatgatggaattatgtaaagtaattcttattacatgcattgcccttaatagaagatcgtttattttgcaattgcgagtttatgtagtagacattgtaagtaagctgaatattcatctactaaaataatatttgcaaataaatagccactttagagtaaagaagtttgtaagctgaatattcatctactaaaataatatttgcaaataaatagccactttagagtaaagaagtttgttcaagtgatatatagaaaatctgttttaagtaaaatgtgactaactggaccacatgctctttacttttaggggaaaaatacaaaaagcaagttaacaggaggaacttaaataaaatatgcacagtttttcagggcataaccttaggtaaatatatattgaatacagtctctttttctggagatagtaaacaattataaatcataaaaaataacaaatatgttatattttagtaataccctgccaagaatacaaactaacacatttgtaataggtttccaatatacattgactaaagaagtgtttttggttaatccttccttgactgaaaccagttacctgatttgcttggttctatggtacaaacaggttttgttccatgagtcatgaattagtttttatgtagctagctatcgtgcccatttctctaagtgttattgaagcggtagcattgtggagacagacgcagtttcagaaaaatttcatttaagagcaagaaatcaataagctgcatttcagagaatgaaaagccaatggatagtaatttcatacattattcatgtaaagacaaagacacataatatgaattggtaataatgatgacgacagtagtaaaaacatgggcccataaattttaagtacatatttaggttttcccccaatcccaattcctatgcactgccactgtcaatcatatacaccattttcagccctggatcagctaagggacatagccttgaaagctatgaaatgtaggtgaaagataggagattgtctttaaatttggacaagcatttagttgttgttctgttttcactacatgtgttcagagggagtaaatgttgattattttatcccttgcttcgttggtgatgaattgaagcaaatttgatccagacaagcaatctggtggaatgatgcagagccatccaaaaaaacatctgtactaatctaccaatgcagtaaattagagctacaaggaaaaggcattgatccacaagaatcattaacagttttaaccaactgatccaagtaatagggtaaaggagagaacactatcaagatcttgtttttcagatctgtcagttacaactgctaaagcatgattgttacttgtttgaattttaactgtttttatgactttggttccctttgtactagtgtaagcaatgaacaaggatcaattaagaaccctgggaaaaaattacccaaattctctgcacttaatttacaaataggtcaatcacaaagggagagataattgctgcagccttaacaaaattagtcagggacaaggcagagcagatgatgtatgttctgtggcaaaatacatggcagagatgtacatacagtcatgtagctgcttgccttgtttaagacacaaggactacagaggaagatttgtgaaaaacaattagcatagctttaaagcatgcagttcttaattatccatagcgtgttgacatcagataattagtgtcttaatttttaatatttcgtcattaacttcagcatatagaaagatgcagaacgttgtctgagcatagcatccataatggaaattgtatatgatgataaaaacaaaactggttaagccatatcactattgtattattcaaatactgctaatactcttaaactcagcacccttaactctagttacgtcagactataacactgtgaactgatgtatttatgtgtatagacatgtatagacagtaataaacatatgttctttaacctcatacattttatgagtacatatatattcctaagagaatgggcattcgaatggtggtagggcttaaatgttacagctttaggaatcttttgcctatagatggtgagttaatgagtggcctctccggggaagaggagtggaggtataatttaaaagtgtgacaaaaaagttttgagaaaacaaatagttaggatggaagaatctcagaagcacatgacaaagaccaaagaggggtggccaggccagttgaataagggggctgtcacaattaccaaaggaagggaaattttctcattaagttaatcatagaatcaagtgtcacaggaggtcaatagaatgaagacacaagaaagtctactggatttgaaaatttggaaccatgagaaacagtttttactgataacttgaggtagaaactatcataatgatgtttaccatggtcaaaagcaaagcctgacactatggcatacgtagtagagtattcagctcaatgatggctgaattgaattgtaatagattactttttatgctgatttcatacaacatttatcagactggtaaagactttaagacagagaatgagtctgaattatgtttggaaaaaattactgcctttgttcttttctaatacattatcataaccttgttttctccttgttttgacatctcatcctattttctcacatccctgacatcaccaagaacccaaatatagcctcacacaaatttcattgttgagaacctgataatctcagaaataaaggtcataaaaagaaagatgttaattgtacaaagataaactatgcatttataactatctgtcatctaagatagtatcattaatattaaatgctataacatcaaaggactgtttatacacatctaatacagagactgtgttatgctagatagatgatagatgatagatagatagatagacatatatctcttctttctccagtagattttaaattatatgtcccatatcatgtacttgccaatataaaaagtataaccacctaaaaatttggaaattttatttttgctatgtgcagtatttgttaatactgataaatcttttatttttagacacatttcctttatctttgaaaattatataaacaaagaacagaaagccattatcttatttcaacaaacgtcagatattaatataatttgtaagtgacttctggtacacttgctgcattaaacactggtgttatgtttgaaaatacaacagctgacctcctttagactgctgcctgcctactttgatgtttcattattttcttcaatccaaggatgaaatggatgaatggatcttaattatagtgtcctggtgactcttttttcgaccatttttctggacaagcatcagctaatctgacaaatcatgaacagtttactttatagtttggctgggattaagttactaactggaacctgcagggaacgcaaaaagcaatgtctcctgataaaatgcactgggtgtttgctatgcctgttttcaattttaattcataacctttaggaatgaagaactataaacagataattctctgacagatatatttttatacacttaaatttatagcacttcaaacacaaaccctgtatatccaatttacatatctaaaatctacatcatgtgtttgactttgaatttttttatttctgaagttttcactgtgtaaaaagagctgctttgtaaatttttttatgtaacacaattttagaaatatttctttcttagaactaggttaaaacatctgcagttattatttaaattgcatgtaagtgattataaaaatttgattatgttttaatttgaagtatttttatgtgatcctgggacagatagattgttgaaggaatttgagttcaaattttggatgtttttcaagtttaaattaaaaagtataaagttttggaaaagtcaaatgactatttgagggtttgtagtaactgttgtagatcagtattattcaaagttttccaaagaacaaaaagtgttcaacttttatgcttaggttattattatttcttctaatagtaattgatttttttgtgaattccatatgccatctgctggatgacacgattttcttgttcagcatgaagtttgttcttgcagacaatatgtgttttctttacacatatcagtaaagacgtgttcattagttagagtaggcaaatgaataacatgtaaagccatattttctaataactgtcatttaattggatattttgtttcatctttcttctcttagatgcataataaacatatatacgataactcaatatagaaattagatttagtatccttctaggtaactgaaattaccctgccatccttataaaacagtattttttattgttcttacactgtaaataaatgtactggcaataaagaattaacagcacatccaggaggactttatttaataatgacaatgtaaaatacttcttgtgccattctatttatctaatttataactctatttgattactccagcatgcctttatctgtaagaattgcaccctagggactagtcaacttattaattcatcacttgtcattttttatggttgcaatctccattatagtatgagcatagagtgatactctcttctgaaagctgccagccaactggttccagtctaggtgaccttttgtttgtaactatggtcctaatggtttttctattggcttctatttctaatagattacattacaatctacttttttgtcttatggtatcatgatgaggataggacagcaagagtgaattccacacctgcaattacagagttttaaaaagaggaaagacttgcttcaagttaacctgtaggctttttaaaaaatgccttttgatttatctgtcacctgatccatcagcaatgaataattttcatggaaggtgcactttaattacattcccatttgacttgcattatcaagccctatctaggtaattaatctcaccaagtatccaatttcggcctttattgctggcagacagaccttcagaattatgtgtgcttgagtgggtcttgggcctttttcaccaggcaggccctgaaagagatctgaggccttccaaatcttgaaagtatgcctatgaattttttctcttagatattgtgaataaattaaattatatttggcatcacaaatatacttccataatcaaagaaacctatagattattataatcatgaaaatgatattaaaattgagtcacctttcacttctaggtataaccaatctgcatgtcattttgtatgtagaggacctgtgctgaattattaactgtagctaacatttgtatcagtttgctggtgtaagtttgcaaaagctaccatctaaacttcagcatgttggtttagttcaggatttaaggtttatatgaattgaagtgaattggggttaaagatggttagataaaattagaaacatttacaattagccttgtactttaaattcagttatatactctgttttctataactttctttattctgaattaatagatacctcactttttatactttcctatcttttgattttcataatttctatctcttaatttccgaaactgattaatgtcaaaggtcagtgatcctaacaacttagttgacacacacacacacgcacactcaaagtaagtttgaaatataaaatttgccttctgttgtagtcttattttatgatcttgtgcaaaaatgcataaatgttttatgatttgtatatttggaaattatgattactgtatatgtaatattttgtttctctgagaatatttcaagaaaccctgggggttctctgaaaatcaaattaaaatatagagtagatggattggctgtctgtttgaaagtgacctaaatatctgccattattttaagctatagattgtctgatttgcagaagagaaggcagtccaatctttaatagactaaataggttataatgcttacccagcaagaattttggaaaatttggactgatggtactaggagaaagggtgagtacttttccagtttccactgtcattcctatgcaggtgagcccatgaatctctgcctcttgccctgagttctctcacagactactacctgtatcttcacaaggccatagattgtgatggcatttataagtgttccactataaaaaccaactttacacagctaactttgtttttttttctctcaatgtataactttaattggaccttttgatttttacaaaaataattgaagacatataatatggatttctaaaacatttaacatttctttgtaaaaatcacatggaactttttacccaagtattagtttcccttgtcatttagaaataaatcttcaatttttaaaaagtggcttacttgcaattatatatagaaacgttttactacaggttgagtgtcccttatttgtaatgcttgggaccagaagtgtttcagattttgaatttttttttggagttttgtaatatttgtattatacttactgttcccagtctaaaagtacaaaatccaaaatgattgaatgagcatttcctttgagcatcatttcggtgctcaaaattctttttaactttggagcattttggattttaaattttcagatcgggtattctaaacctgtatccataatatttctagaatgaagatgtgataatttaataatgttttcattagatacattcatgataattgtttacaaaccacacagtaggttaactcagaatttaaattggtcaagaagattcattactgaatgatttactattgtgaattctgtagtaaagtttatgtatgcacatacacatatacacacgtatacatacacactcagatatgtatatatcctgtttgaatatatatgaattcatattttacatttttaaagaaattgttttgtttatatagtattgacatacttcctgtaataatcaggcatatatagctaaacaaagagtttgtggcttattaacatctgtccctatgtttatttccctttggaacctaggaatcatgagaatttatatttctcagtaattgttattgttccctgtaacaccattttgaattggaatatggcgaatataattgatctgacttatatagataaagggagagattatttgtacattgtatagtaaataaatagggtccagtttagtatttaggaatgatttgttaaccagaaacattccccaaagttattttacttttgtatattctttagacatatgttttttcaatgtattgacatgccaaaaatatgtattgcctgggctgtttacatagtcaataaatatatcgagcccagtggattatttttctatatcaaaataaaatcagtttctatgtaataatgcatctagagaaaaatagacataaaagacatatcagagaaattggacactggatttagaatcaaaatgtttgaatcccaggttgatcaagttgttttttgaccttgggcaagtaatgcaatctctttatcttattagttaatctcagtattacatgaagcaatatatgaaaaaatgttttataaaataaaaacctcattcagttatgagttagtggtgttgatgtagtagaattgaattctttgctataaatttaactgtggcaaagtgcagttttggaaaaagtaacaaaataatgctgattattatacaagattaatgttgtcttcagtctcacaatatgtaaccctctcaataaccgggactacaaaagaataataaatcgttgactattctttaaacaagtaatgttgacacttttaaataccaatctctaggcaaaattttaccaattaatgagttgtattagatataatcagtttctaaaaatgaactttgaattctgaagacactatctcccaataaattaaaaacttattttattgccagtttttgtattatatgtttttaaaaatgatgctaagtgttcatgtaaaattttattcctgtacactttgagaaattgttatttaataaaatgttggtatcctacggtattatatgtgtgcatatatttatataaaatttaatatttatttaatttaacataaaatttgattatctctctgtacatatagatatagctataaggagagatatataatatagagatatatagagatatgtaatatgtattacaatatataatacatatgattttcttctctatcagactacaggacctcttccatcattgcactcaatttatatcatgttttgaggttagatagtataactttggaagacaattattttaaaggggaaaattgaaaagattctaaagatcaactctctgtagctgttttaagtttttaagatatattctgtatctcacctccattaaacaaataaaagaatgaaaaataaccattttattgtttcgattattatttaatattcaggtataattgagaactttgaggaaattttaaacatttgtgaacatctatttttgaaatttaagcctatttatagccaaactgggcaaaaaagaaacatgatttattggaatactgatttggaaagagagttgaatttcaatggttcagaggtgacataggaatcacaagcagaatatccctctgtaactttgtaggagcttccaaggtacctgaaagtcactctcttatttaatatatttgattggttttaagctattgaatccatacacactaacacatacaccctgcttagactatttcaaactattaaatgtaaaaagcaagaattaggaagctgaagaatgtaaaacacaagaaaagagagagaagagagaagcatgtgatttcctcaagcactctgaatttggatggaattgcatatgaatgacagcagtcccagactttccttaaccgcagaaaattgttttttcttttacatttctactcccagaggctgttggtggggatttgggggcaacatgatgatattcttaggctttctgttcaagacttttgtactgtttgatgagttatctcccttttgttctctccctcccaatgcttcttcttccctccctccttttctttgtctccttccctcttttcctcacctccctccatcctcactccatttcttccttcctgtttgttttggtggtaaggaactatgtacagaggaaaaagcatgctacaatatgaaatcattattccagtgtcacaagagtcatataaacggtgaacaaagagcaagctgttcctgagaattcatttatttgcttccaggatgctgctgctttttccatcctgtgatacttacttctctttctgaggtatatctaacttgagagctccaggtttgagatcagtggtgagaacaacaggcttgtctgtgatactctactgtttgacatagaaaaatattgaaatattttcttttcctgccagctctctatgagagaaatctctcaattatctactgaatatgtttcaacaaatctgagtgagtttcttttaaagtagttgtttgaggccctttgaaaatagattttctttcctttgacacttatacattcttgtaaacaaaatacagcacaatgcccaaactgattttatgtttatacaagtactttttttctaagggtagaattggtcaaaaaactatccacagaaaattaggtctcatttctaatctatattccagagaataaaaatagacttttgttgcagccttgtgcaatcagtgtgtaaagacattcacttactaaaagaacttgtgattctgaccttttggaaatggtgtgcagtcactggaaccttgcttttgatcactggtaatctttgacattattgagcaaccttatccttgtggatctttcttcagtgttctgggtcagtctcccatgggagaaaagtggaactttgaattgcggatttgaaaacacagcagcaatattctcttctgttgtttaaggtattttctgtgaagattctcactgtactgactgtgcattcagccaaacacagtaaaacaaaaccagcagccacttttaattagtcattgatacttcctttttatgtcttttttctaactacttcaaactgccacccctatagagggcaaacaaaaggaataggttggctgataaaagcttctttgtttttccttttttttttttacaaaaataatactttgtaaactatccaatttatattactccactgatccttcaaatttatggtaaaattgttaagttggaagaaggatgccattcaaagcaagaggttactcttggttacttgagcagtggctgctattggaactggtattggggatgaactattcacttctgttcttaaaagggtaaaaggagctgggcagggtggctcatgactgtaatcccagcactttgggaggccaaggcgggcagatcacaaggtcaggagatcaagaccatcctggctaacacagtgaaaccccgtctctactaaaaataaaaaaaatagctaggcgtggtggcacgtgcctgtagtcccagctactcgggaggctgaggcaggagaatcacttgaacccaggaggcagtggttacagtgagccaagatcgtgccactgcactccagcctgggcaacataatgagacttcatctcaaaacaacaacaacaacaaagtgtaaaaggctttgaacagttgtacatttgactgcccactacactttcaaagtgagatacacatgaaatccaagcaatttgtaacatatgagatatgaagagaatctgaaactttcatgtataccttgcatttgcctcgttttctgatgctaaactcattgaagaggttgtgagaaatattttattgggcaaccttaaaatataagttatgtgatgattatatattatttttctttcttgtattaaaatacttttattctagtagtagggtagcagtaggcttgaaagttttagtgctcaatgtactacatgaactattttttaaacactactttaaaaaggcttttaaaggtacatcaattataatgaaacattatccaatatgttttgggtaccaaggatagtacttgtgcctctcttgtaggttatagcaagaaagattcattatatgtctctcatatactggatacatgttcagatctctatccagccatttctggattatatcaagaaatgaattagataatttcactatgtgtgatttgaattttaatgatctctttctaaatagaaaattttccatttgtctatttaaattttcacaaaatacaaagaaaaataatgtaatttattgttactcataccacaataagaagctaataaggattcaaagagtgtagtttccatgtctgtattttaattgttatagatagataggaatgggattaaaaatttaaaaaaaaaatgaaaactgtggatgattattactggttaagttatgggtctaacaggttattcctttttgctcctattttcccactactattctacatctttgctggtggtctcccttctaaaacacaggtgctttttaaaaatataattatttcactttttaaaaagtatttccttatgtccttaatgatactgagaactttaacaaatcctttggaattataatataaataccaatgaaactgtaaaatttgaaatataattactgtgccaggtttggtcagggcaaaacacttacattacaaccctacacggatagtgtatcacatatgttgatgattatgttttacattagatgaaaaatctcattttgttctaaaactaaaaacagaagtagaataatttttataatatttcttgaatatctcccatttttggaagcagaaaaaagtaagactagattgacgtaaaatacattgaaggatacattctggtctgttaacacttaattgaccctctaggaatcaaacttgcgatagttttgtgaggaatatgttattactccaaatgctgagagaagttaaacaaattgccgaaggtgataaagcccatacagttgctgggtgagacaacacctgaggttatatgggtctgtggcctgtcttgttgccttctaggttatttatttcttcctgtccttgattttcacacttgtgttgtcctatttctggggaaaaaaaatcaattctaataaaagtgatgcatactaatactggaaaattttaaaatatgagctacacatcgcaatctttactagttttggattaagtttaaaggtgaaacatgcaaatatgttcatggttatcagagaatgaaatggatttgcatcactcgtttaaccttgatatttgtggatttgagtcagaatagcctagttataatgcatggaaaagccacagggatacagttttctatgcacagtagcagaaatgctaacaccttaatgtgcttctttggagatatttttttctacattatatattaagtttgttctctagtagttggaaagtgttttagattgtaggtattatatatgctggttagagaattatctttagaaatataaaattagtttaagttcctaatagattctggctattagatttttgttggatgccaaatttgcaaatatttactcccattctgtaggttgtctgtttactctcttgatagtttcttttgctgtgcacaggctctttaattacctcccatttgtcaatttttttgttgcagttgcttttggcatcttcatcatgaaatctttgccagggcctatgtctggaatggtatttcttaggttatcttccagtgttttatagttttaggttttacatttaagtctttaatccatattgagtttatttccgtatacggtgtaaggagggggtccagcttcagtcctctgctaatcagttattcgagcaccatttattgaataaatagttcattccccactgtttgtttttgttgactttgtcaaggatcagatgactataggtgtgcagctttatttctgggctctctattctgtctagttttgtaccaataccatgctgctttggttaccatagcattgtaatatagtttgaagtctggtaacatgatgcctagaattgtcctgagtaagtcagctcttttttggttcatatgaattttgaaatggtattatctaattatgtgaacaatttcatcggtattttgataggaataacactgaatctgtaagttgctttgagcaaatggccattttaacaatattgattttttcctatcatttagcatggaatgtttttctatttgcttgtgctatctctcatttctttcagcagtgtttagtaattctcattgtacagatctttcacctgtctagtttgcagtattaaacaatcctattacaaagtgggcaaaggacatgaagagatgctttgaagagaacatacaggtggccagcaaatacataaaaaaatgctcaacatcactaatcattaaagaaatgcaaatcagaattgcaatgagatctcccaacagtcaggatgatatcattaaaaactcaaaaaataacagatgctggtgaggttttggagaaaaacttatacactgctggtgggaatgtaaattagttcagccattgtggaaagcagtgtggtgatttcacaaagaacttaaaacagaactatcatttgatccaacaattccattatgggatatataatgaaaggaatataaattattctgccataaagagacatgcatgcgtatgttcgtcacagcacaatttacagtagcaaagtcatggaatcaacctaaatgactatcagtgttagagactgcatggagaaaatgtggtgcataaatgccatggaatactacatagccttaaaaaagaatgagatcatgttctttgaagcatcatggatggagctggaggccataatcctaaacaaattaatgcaggaaaagaaaaccaaatggtacatgttctcacttacaagtggaagctgaacactgagtacagagagacacaaagaagggaatgacagatatcagggctacttgagggtggagttttggaggagggagaggatcagaaaaaatacctgtcagatactatgcttattacctgggtaatgaaataatctgtacaccaaacaaccatgacccaaaatgtaccaataagacacctgcatatgtacccctgaatctaaaataaaagtttaaaacgatataaatttaacataaaaataaatatgaaattagtttctattattttgatgaatttgagccagcatttcttatgtttaaattaatactctgcacaagttaattgctttaaatctgccatatcacgatgttgatcatatcagtttatttgaaattcaaaaatactctaaatcatattttttacttaattgtattgaaattttaaggcattttctgaaatagctcttgcttttgtcttcagaatttgagatgtattaatccaatgtgcacaataaacaatgtttttataaacttgtttacttttgtcatgcacatatatattaccatatagcacaaaaattaaatttaacattataattgagttcctataaattgcatataaaaatatataagccacttagcaaagagagagatggaatttgtaatataagtatgtatcagataaaagattacaagtatacaaagctcatgttctgtagataactgttcattatttatagtacttactagaaatataatttgcctgagttggggtgaaaagagttatagttaccattattgtacttattttattttattaacatttttatcaaattattgcttttctcaagtttttttgtttattttttgcttgctttattcagttctccttgtcaccttccaccgggtccactgagctccactgtactacacttaatcttagccatgatgctgacaagcaattgagcttcactgtaaatacactttgaaaccaattctgtgagaatatttttaaacaagtgctattactaaaagtcttatcaaaagtcaagtacctgtttcccgtgatatcagtgaacaacaaaaaagtcaagcacctaacaatgtcaggtgtgtagcagttgtatagtatgtatttttctgagaaaatagattaatatattatttctattgaactgaactgtgtgaggcaatgtggcatgttgtctacatttgccttaaagcagagttatataatgaaagcctattaattcagcctttgcttgtggatgctatgaaaagataaaatgacatagtggtttacaatagtagctgaaaaatagaaagtacgtatctttgaagaaataattaattgataaactaaacaaggtataatatggttgaattgctatttgccacacacatacaaattacatggggaagttattggatgagaaagcaacattgcctcaattgtttgtatatttcatgtaaagtaataatttgtccttaggtattcagatgatttccttaactctccatgatcatttctttgaaaaaatgtttatgtgtgtacatgaaataaatttagtatgcattctagacagaatctctgtttctaaataagttataaatcaaaaagtaagactcatgtctaggtttggtttttaaaagctctgaatttttttttttgtatttttctgctaaatatataatctgcatatttcaggaaggcatgtattcaggagttgcagaatttggaaagggattaaaggtaaagaaaactgagaaaagacctttgtgtttagcaagaaagatattattgaagatcttaaaaaacacgattttattatagtggtgtgactatatatgtggaatataaaactagggagacttgtttaggccatctctgtttacttcttttcttaaaatacagtgatatccttcatttttaatattgtaacttatacttttgttgccaaagttataactaaacttttacagatttactgcatttccatgttgctaattttacaatttggcatctgcaatacttttctccaaatagccattagtttatcaaaatgtttgacatatatgcccactcttgactgtgaacctaaacagaccgatcatctaatgaaaagccagttaagaaatgttcaatattgtgggtaggtgtgcatgttctccatacagcaaagtcctaagatcagttatagagtaaggagttaataaatgctttacaccttttgaaatgccttctcagctgatacccaaggtaacataaaaaagagaaaagtaaatattttgcccttggagaaaatgctgttgattggcttggataaataactttcagaaaggaaatcagcatattgaagagctatctgcacccctatgtttactgtagcactattcacaatagcgaagatatgaaatcaacctaagtatcgatcaacaggtcaatagattttttaaatgtggtatatatctacataatggtatactattcagccataaaaaagaaagaaatctggttatttgtagcaatgttgttgagcctggaggacattatgttaagtgaaataagtgaggtacagaaatacaaatactactacatgttctcacttatatgtaagggctaaaatctttaatagaagcagatagtaaaatagtggttactgagaaggttaggggagagaggaagatagaggttggttcacatacacaaacttatagctatataagagaaataagctatggtgttctataacactgtagtgtgatatagttaacaataatttattttatattttcaaatagctagaagagaggattctgaatgttcccagcacaaggaaatgatattaacaaatgtttgaggtaatggatatgctaatcaatctaatttcatcattacacattctatacttatatcaaaatatcactgtgtacctcataaacatgtaaaattattatgtgtcaattaaaaagagtcactttcatcctatgattaccattttgtgtactgtttgaaaacaatttaattgctatgtttgacattgtataacaagaattatttcaaattctttagttatctccttctctcattccactgactgtggcatttttctcaattcctccaaaatatagtttttcttctaactagtgtaaaaagataaacctgcttatactttaggtgagagtttacattgctaataattaattagtattcttgttcagtatcttctgctccaagaatgagtctttgttgtttttgttttttttaatttcacttcagctgatgagtgtaatggaaagaagatgggctgtgaagcaagagacttgttttcactttccagttctgccgcagtctccttgtataaagtagaacatatgtataacaaaagtatttatacaaaatataatttaaaatatttgagacaataagattatttgagaaaatcaatgaagttactaagtttatttagtcagtcatactctataatggatacaatgtattctttaagcaatgtctccttttttaaaaaaagtatacaaagaatagctgtgttggaaaagtatttgaaaaatcaaagatgtcaggattcatacacagttcatggcatagcactcatgttctttattaggtgtgaagtaaaattcttggaacagttcttggcccatatgctgttgctagttagcatgtctaaaaatgataattgtattttcatatttacattaatattgcttataatctggcttatatactaattaacaaaagcttttaaactttctgtttgaaataaataacgattagcaattaaacatttcagttacttctgattttaaaagtatgataaatgtttagtggccagtgtctcattcagaacttgtaggtcatactctgcagttatttatctttggtgtgtattacttatattattacaatgcagatctgaagaaagaggattttcattcagtctgacactaaaatataaaattcttaaaggaaacaaaagttaaaagttattggtaatgaaaaaaataccctacatcactttattcactttagttccctgaagagttagttatttgtgtgtatatgttattgttaaagttatttttaatattaacagatgaatatggatttttataatgcagttttggttaattcattctgcaaaatgtgaccttgacttgctgtttttctcttccctccttaataatgttatctttaaattagaaaatagtacttttcatatttggtctattttattgtataatcaaagtattattttgcccatgtagtcttttaaggagaccatgccattttctattcctctttctccctattatttaagatatgtgcttagagggagcacattgattatgtagggcttctatgagaattcgctaatgagaatatattattacccagattgaatagtgcccctttgatgcattaaaattgccatgactcaggaaccaatgtcctaggagaaatcttggtatccaagataataaagtcaggtaagaaagaccagattacctctattttgggtgaggaaagatgattaaagtatgacttatgatgcactttagaaaagtgtggattccatcatgccaaaacatttcccagctggctaatacttgaaaagtcaccagtgaaatgttttcccttaaaactctcatatattgttgtatcattcaaagatatttattcagcatttcacatgtttcatacattactctagatgctgggaaaagctatagacaaaaaaagaaatctctgtctttaaaaagtttctagtagaagtggagtgcaagtagaacagacagaaatatactaaatgtgtaaaatataaaaaattagatgatgttgttcaaacaaaatacataggaaagccatgaatggagtgtcaagggattacagtttttaaaaatttccaggaaaggctttattggaatgacgtttgaataaaggcctgagtgagatatgaaagcaaagccaaacggaagaagagtgttctggacagagagaacagcctgtgcaggtcccaaggaaagagcatgtttagcatgttcagtgggggagataagtgtatctggtgtgaagagagaaaggaggagagtagaataaatggaagttgggtgttaacagagttgcaaggacacactgtgttagaccttgcaagtcattataaccactggctttagatgaagactgaaagccattggagggatttaaacggaagaatgacatgaatatactttcataaccatctcattaacaatctcgctgctgtgttaagaatagctaagaggggttctcaggagcaagagattagtttaggaggctattgcaataatctagaaggtggctttcactagggtggtagcaatggaatggtagggagtagtgaattctgaatacattttgaatacagagtcaacaagattagcacactgaatgtggaatatgacagaaagacagtggccaagggaagccttgagtattttaaacctatgcaacttttgaaaagatgaaataactagtaactctagacagaaaaatttgtgggagagacaggtttgaagaagtttaggaactcagtttctgtcatgctatgtttaagatgctacagttgcctctagtttatgtgtgatattggggttaattatgtaaatctggagttttcagcatcgacatggaatttaaagtcatgaactaaatgagataaaaggaagtgagtataaatagaataaaaaccagggttgaggtgtgagtgccagggcactggatgatgaagaacaatcaggaaaagtgacagagaatgaatggccattgagataatagaaaaattcaatttgatgctcagaaagcaaagaaagttatttcaaggaggaggcaatgatctgtcccaaatgttgatagctctgcaaggtgaggagtgagaactgaactttggatataatcaattcagtatgagtctagtggccatcagaacatctcatgtgtcttagactgcactgatttatagagtaaaggtggctgatactcagctctgctcggcacatgccacttccaactgggaatattgtgcccaattctagatagcacagattaaccgtcatacaaatgtattttaaagtgatgggaaatatgaggtaactcacaatcatgtaagatggataccagttgaaagaatgggtttggctaagttggagaaaactaagaagatacaacaataaaaatttgcagctttatatcttagaaagttctttcttatattcagttacaatatgtctttctgttgtttctgcccattcattgatgtgcttaataaatattaagcacctgtcatgagtcattctgctcaccgctggatgtgtgttagtatgaaatagacaagattcctctgttcacagaatagattctctgaaagattttagtccaaacacgtcatatgctatgatgggatcccaggatctattcctgtattagcaggaaactcacttgctaaaaacaatgaagaggagagaccttacctttcagtttcagtgaacaaataatttcttagttttaaaacttgcttctacttataattttcagtgaaactggaaatcttcacatagagataattttaggtcactttctagtcagcctttctcctaagtaagttctagttatgccattcattagatatttaacagttaacacaagaaactatcttcgtatattttatataaatagagcattcatttaaaatcactctttaatatgtttaagatgacactgaatgttgtgcagtgttttattgaaattagggttgtgattttacttgtttgttgaatacttattgagtgcttactgtatgccaggtaatttgctgagggctggatattcagtggtgacatgaacatagcctctcatggaacttagactatagggagagacagattttaatctctttcctttttacttcccactattaccacggcataattctttagcgttcttatgagattttcattacatgaatattagactatgaatagaattatctgctatgtaactaatgtttggtgaacacagcaggcagtttataaatctagaattattattcttgactctttgttagatctcattgatggcgaagagaggatgttgtgtcatttttttctcagcaagtgtgggcatcagcactacatctatcttgagccagcagagcaaacagataattatttaatatcctgtgtttgatgataaccatttttcttggcaaatgtttgaattaagcaagttttctttattgaaattttcaagatatgaagtccttctttttagccacttagatatatttagaaacttcaaagtgtgtctagtaaatataaaatattaagtataccagtagattcgtaacagttttttactgcactgcagttaaccttggttaaatgtacacctgttttcaataccaagaaaagtggtggttcattttgttggaatttttaaaatttccttcatttatcttatctattatttttaccttgattctctaggtagatatattttggtaagattagaaaatgtagaaggtgggaaggagtggagtatagttggatgatagatattaaattttactattttaaacaaagcttacaattacagaaaattttagacaattgatcatagaagatatttattttaagtcacttgcgcatcactggtttggcctatattatgtagctaaataagcctggcttttgttttgataaagaggcatatatctttttagaaggacttggtgatgaactcctcacttaaataattttatttattaaaaaagaataagtgagataatgctgaagtttctataatatagaaaacacttaggaccaattgtttctgaattccattgattgtgtcctttgaatttagggttaaaattgagctatagcttattttgtaacaagtgtttccctatatgcatatattattcctggcaattctaaatatttcttcagctggtagaatcttcactcagtctctgtctgtacacccactctctctcattctcctcccatacactctcattttttatactacataaccccagttttagaaaaggtaggttcactggaaaaaaaatgccttttttcaggattgttattaataagtacaaaataaaatagtgagtgaaaaatctatcaataaaaggcttgcacatatcccttctgccctctacaatatgaacctcttttgcttctattcttactatgaatacacagaaacattttactcagcttcctggccaaggccttgatttgtaaaaaattatgaagttctcaatgcttttatgtttgtttgccttggtgataaatagtgaatatttgtctttctctgtatacgtgttgaaggcacccttgattccctcttttcttgatcatgtttctgcagtctcaaagaatggaattcccctacttgctgtagcacacttacacgcatatttttttagagtgtggcaactgatattatttaagaggtaggatacatatgttgagagggtctagtttccttcttccagatttaacttattgtgcacttacatgttgtatgagttctgtgatcccatttttgcctcaaggccaatcctgctagattattgtatttcatgcctttcatctgcccttgggtttacaaaaatctaataacggtttatagatgacttccccaagctagaaaatctagtggcactgatgtttatgaggatcaattttattttcagatagaaacttttttaaattacctgagattttctttgccactcttgtataatcagagctcaattaaaaagattctgatgaatattatgaggatttaattagaggcatattttatgttagttaatatactcatatgttggtaaaggaagttatcccaggacaaacttaatgcagatttttaaaaaatcagtctatccattaacagtaattttgcagtatttttgtaaggaaacacatcaaaagacagtagcaatacttctgccttaggtgaaaaatctcaaaaatatttgttgtgctcaaaagagtctgtctgccccttcatggatggtttaagataacttctggcaacggaaagcagaccactgataatacttggaggtagttttgtattcatgatttaatacatgtgaaatatgtaatggagggtctcctggagttaagattttaatatttcagttgtagataactctctttgaaaacatagctttttatacagatttggtgtgaaaatgtttagttgagcagatggagatccagctggtagaatatatgtttgtcagggtatctggcatttagctacatccaaaaatgatatcaaactgaaagatgctaaagagcagcactgtatgaaagccagtatgatcagttaagggtagagtcctttcatttttgatttcctaaccttgtagaaatacattttaatccagatggaatttttaattttaaaaataaaatctgagaaaatgtaaataaaattgtcaaacatctgcctttccaaaatcttgattctagtaggccaggaaaaacatgctactttgtgtgttaaaacttagtacctaatgaatagtatatatttgtacgtgtacaataaacatgcacatttcccagaactttatattctgtatatttggtatcattattttggtttcttgagctaaactgtaagaagtggtggatggtaatcgagtagaatattaagagaaagaaggaaagaattcgtggaagaatgacaagagtcctaaatgcactcgaaaacgttttaccccattggattccagtatttaagtccccactgaggtggataaaaggccagcttagcaaggaatcatgtgtttactcctaaattttagagcctttacatttaattgattaatacagtctgcttatttgtttctttcataaagagacgaatatgtagaaataaattattttgttaaaatgcttaaatatgtataatcaaaaaattctatgttatgcatttgaagttgtttattttaattgaaagcaattgagcaaaaccaaaaagttttcacatcttttttttgtttcccctttgaataccatattaataaaatcttcattcaaacttttaaattaagtccactgaaaatgcccaacttgattaactgctattctatgtgaccctcaaaaagtgataattgacatattcattcatagtgctagtaaaacacacacacacgtaaagcacagatgggggacagtatgctccctgaatctgtaaaactgcttaccatagtgagtaaaagtatctgtaggtgacttttggaaggcttccctcagggatttatttgaatcactaaatccaaagagaatatttaatccctatttgatacaatgagttcatgaaaatgggtcctaattttgaaggtataatcagagttaaatagtcactagtatgcctctctaattcagtcattgatataacctgagctacgtgcactgctttaaaatattcccttaccaaaaactaaagctgggaagagcatgttccttaggagcatgatttagtaaatccagacttagaaattaattaatgaagagtatgcctctgcaaaactccagtatatttatcagaaaagcacccctctatgaaataataaatcttttggccttcctggggggctttatattttataaaacaagacaaaaaaaggaattgcttgcagtagattttaagcgatacaaaatttccctctaagtttttgttggaatatttcttcctaaattttaaaaagaatagtaattaatgctatattttttcttcaaattccatcttaaactttacttcttttatctcactttcctacagtgtaaattatatagtatactttacagatatataattttaaaattacatacagtgtaaattttatgcatctgtatatatgtgtatacatacatgtttgcgtgtttataaaatatgtgcgtgtatgcatctgtacagtgtgaaagcctgtgtgcttagcttatgacatattgagccttgtattgttttttacattcattattcattcattaattcaatgaatcttcacagtgctctataacgtaagtagtattaatgtcctcattataaatatgaagaaattaatgtataaagagtttgaataacccaaggtcgtacagtggcagtaatcaaaccccaaattgtgctcttaatcaaaatgccttatggctttttctaattttctaacatttctaaaagccaacattaatctcaaaaagagatagtttggacatttacctgagtaactgaccagttagtttaacaaattcctgtaaaactgatcaatgaatgttgatgcagtgtggagttgtgtggaccacagggacctggagagggaatatctcctttataaggagtaatcacttccctgttcttgctgaagatgcgtaagtgcccagtggggtcagaaatgtcaattccagaagtctagtcagaaatctaaatttgtcagtgaaatttcagatattataatttttgtcttgtaattaaacttaataaacaaacaccaccttaattgtgtctaacaaaacaaatatagagagaagaaataagaagagcactaattagtgagctcagtcatatccagacattggagattgagttccaaggataaacagactctgagacagagatacatatgcaggaattttattggggaatgctcctgggatcaatgactcacctattgtgattgatatatacataatcaacaaataatatattactgttgcctactgtttgattcttctattctcaaaatatcttctcaaagttgatattaggtgcttgttacaatgcaaatactgagaaccacactcaggaagttttgattctgtagacaaacttggtggagaccagttatatacatttttataagtatgcaggtaattctaatgattttaatgcatatgccacatattgagatgtactgatttaaaagagacatatataaatactaattcatatattttctcaagggtatgaattgtatattgtagatctttttataagccctcctcataacacgtgataagtagattgaatttactgctattttatttagcaattattacatgatacaaaatatacacaaactatcttgctaactatataacattttataagtgaaattatatttcaatgaatcaaaattatttttgaaaatttctgacttggtaagctcctacaatcccatatttcagcattttaatgctgcctcaggacttggctaattgtgttgggccatcttgtctctaaagcattaaatactagcaaagctgtgtaagctttaaatataattttccaaattatattttcccatgaatgcttatgaaatttcatgttatcaaaattgcaataaatttctttattatgaaatatacttcccttagctttaattgcacctctgacctgtgtctaatagcatcttttaaaaccatgaaagagaatactaagcattatacttctacagaacttgttttttctagctacattcttaagtaaatttagtaaatatgaaagggaattgtttttctcccaagtgaagtaaaattgcactacaaatcattttctgctaatgattgtattcttttaaaatagcaaagcatatttggtctctaatcactttgcctatcattgtaatgtaatgttaattttaaagagttctgttttggaatgaaaaactaatatactgaatctttattcgaaatgtacttatatattaaaatgctttgctaagcttttgttaaatctgcagaatattccaacatgctgaaacttcttaatattaaaatatgacatttattaaagcacttctgagtaaaataaaaccaggcatgaaaatataatatcagatacaatttctacagtttcacaaggaggttagctaatcaatgaaatggatcagtgatttctcctccttcaatgagcagcccattaatactagcacaaaatacatgctagacagttcaccactgagtcacatctttaattatctatcatactttcttattataatattttatccaatttatccctaaatatctagtaaatctgtactagtaagagggagcctcagcatagaatatttttcagcttaccacagaaattgaaaagatatataaaatcaacttttattgctgtatagatattatttttcatgtgaatttataattgtcagttatcaattattaaataaagggtataatatttgattatgaatatatgtaatctttcaggaaatcttattgaatctaccttccaaatatttgtaaaacatgtgtatatggaatatgaccactttcttcacttccacagctatgtagcccccagcatttcctatctggattactgcaaaacttcctagtaggtcttcgttgttctatacttgactctacatccagttctcaatcacagcagttacatcctttttaaagcatagaccattttgttcctctgctcagaaagctgctgtgagtccacatctcactctgagcaagagtagaagtctgccaggctttatgtgatctgctgcctatcccacctcctcagcgtctgtggtctcagctcttaccactaaccccctcattcatgtattccaggcatgctagtctctttactaatccttaaaacacaccagaagtgttcctgtctttgggcctttgttctagctgttcctgctcccttaaaattatcttctcctggatatctgtttggctaccaaactcatctctatcaaatcattgttcaaaccctgcatgctcaatgacagtgtgcaaacaaccttacttaatataacaacttgtaacttcttaacatttttgaccccctaaccctactctttctagagtattttgcaacttccacaccataaagtttccttagttgttaaatttattgtccatctttttggggaaaatatatgttttactaggatagagatatttcttttccttgatattacttcctaaacgcttataagagtgatgtgaacatgtgaggcccttaataaatatttgttaagtagaattgaattgaattctagtttgtgacattaggaggaagataaattattgaatgcatatcatttttatttaagaattgaaatctaaatttaagtgacaacaatggttcagaggttgaaatgccagaaaaattcattgtatttttcagaaaacaccactgtttttcttttcctttcagccacagcaatagtttcctgattctagaatttgaggtaactttaaaattgagaaaacaatttttaagaaggaaaagctgacaaatgattgctgccttcttttaaatctttgttattttttcataaaaactacatgaagttctaataatgagtctcattatggtatcattgccaaaatggtcatgccatagacaacaaagcaaaaacaaacaaacaaaaaacaaaatgacatagtacttttatgtctactgtttattaaaagcagttgtctttaaaaactaagcagaaaatataattttaagattaaggtcattttttaaattaaatatatttacctttgttaaaatgcataatttattgcattacctgtctttttctcatttctcatgaaaactgcatcaagaaattgttcttatctgccaacctgcacttagatacaatgaattagggaacttgttggcttcagaatgcgtggttccaagtagcttctttctgtgcatatctttcactttctcaccaagcagatggcagcatagtggcaagttatggagacatgcaggccaatttattctgccatgcactaaaaactgtgctagaatttgtgggcaaaataaaagcaagagaaggaaactaacactttttgagagccatattatataccaagctctgtgttagtgttttcatatacactattttattcaagaaatccttgaattagcaagagagatatgttaacacataggagtacagtatgtcttataagtacattttttctttttagaagggtaatgccataattggattagtcatttgaactttatgcagtataatatttctatcaaaaagaaatggtgggactttccagatacagtaaatgattatgaagaaggtattgaggtgagaatgaaagttatgattactggatggctgacctgaaggaggatgaagagttccaattcatatgtaacctcattagataagctgctttatctctctctagttaatgactctccaaggggttcataagccagctgtgatggcagcaggagccagcttcacatattgtaggtgctagacacaaccaaggatttctgcctttataacagctgaaggggttggaggtgggttggtttgatatggagggaggatacaacttaactatgttttaattcaggcaaaatgggctctgctcaagcagttaatatctgaacttgttgtgattatgtgtaattctgtgaccaagtttaaatgcagcttaagactaaatctttatatgccaaggcctcattaaaaagaaaattaataattaattcctttgctaatgttaaaattgaatgacctgaaaaatgtatctgagaattaaccatggctataattcatatgtaaaaataccaaggccatcaaaaaactgggtcctatagaagtgtgttcccccaatttagtacctttacttgttgaagaactgttttttctcagctagtttctactgccttttataccatgcattcctaggactggctcccacctgttatgtatgggaaatgtgaattcattttcacattagcttatttaagacataattaaaatagtaaatctttaaaatccctatagtaaattccaaagccagaaagttgtgggatttctgcaagaatattttacatctacctaggcaaacataccacttacacactagagaataaagccctcaagagcatctgcctgtaagtttgcttgcatcctagaagaaagaaagaatgaggagagaagagagaaaatccaaaatgttgagcatgttattatatgtttaggaaagagcagccagggagaaatgaccctcataagcgcagcaggtagttttactaaatgtacaaactgaaattactatgttccatcttaggactatagtttagttttcctcttgtcaaggctaattattattttccaactggcttctaaatgttttcaatatttgtttgtattgctatctcacttgtatagttagaagccaagcatatagggaatgtattcagagaatctaataatgcatactattcatttacgtaatgcagaaactcagtatcaataggaaattcttgaaaatatataatccttctgaaatataatcagacatagtaaacaattttgctttaagtttacttagtcatttttactagttaatatagaaagtaatttctttgcacaattgatattttatatgtaaataatttattgcatatcagataagcagtttgtatctgataggtagatactcagaagagtatatattgctttaaaagtatagatgttttcacagaaatagtgttacacactatctagaaattctataattgcagtatgtaatataatacaagcaatgttagaacagtagctttcaaagtctctgaaaacatatgtaacctcacagggaaaactcctaaatattttcaggttgattctacaagtaaattctgatgttataagctaattgacatattcagttcaataaaatgaaaatcttaaaatgatacaattttaaacactgttaggaagttagaaagggggtgttattgcaattattcttaaacataaataatctcctacatatgcattgttaaatatgaaggtttttagaaatcactccttcctgccttaccagttatggtttgagggagtaaagtaggctcattttaaggatctgttagcttcactgttattattataactacagcagtgcaggcccttcctatgttagcacagctatttcatttgctttctttccaataatatgttctcattgtaccctcttatcactttcaaaaacataggagcttagctgagccatttctttgacttagaggaactttagtttctacaacaggaacaatgaaatcaacttttttccatctatatagtttagggtgcatattccagggggtctagtcctacaactaggttcttaaaatagaacataaactgtggattcctaaagagaggatcaaacactgagagtgaattattagtacttttagcataagtaaaataacacactgtgagaagattagtttcataggccatgaaattgataagacaaaacacagtacttcttaggtaaaaagttgaacaagaaaagatcagcagagagtgaatctgttgattttagaattcagtgatgagcactttgaaaaatatgcagcagaagccaaatcacttattcatctacaagagtaacactaatgttacagagatttttcaaatacaaaaaaatagacttgaccattggtttccataaccagagataacagctgaaatcagagcaagctgttatatgaagggggatgaagtttctgtcatttagattgttacatattaagtattttcttttgaaatttgtcatagatttgcatgatttaggacctttgaagacaaagacagaccacgcaactgctgcatattcttataattatactctttattctatggtttaatttgaatctttgagatctttgacacatggcttacaagaaattaccctagtttttgttaagtgtgaatacctaagtggtacatattttaatcagagatttaaacccaatgaaagcatctaatattctggtttatcagattttgataatatatatttacttactaatcacttaatacattttatttaagaaaattatattgtcggccaggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaagaaaattatattgtcagtcttaatgttaattttcaagtttttaatatataaatatcatagtgacttaacatttttaaagtttgcaagcatcattaaaatatttattcaataactataatatctaataaaattcatagttcaattccagacaattatcagttaaatctaagttcagttttcttgagtaaacatttgatttttttatattcccacaaaattggttgtattcttcaaataacacctactcatatggctttcatgtttggtcatcgttgtaggtcctgtctgtaaggtggtcttgttgctcttcgttgaactaagagctctgcaaatggtcagtagatgtatgcttcacttaaggattgtgaggcaagttaaaacagatatggaggttggacctgtcagtgaaagggtcagcttttttgcagttaaatatgtttatgctactttgttaaatactcatccaagcctgagattcttcatctctgcagttgtaatcacaatagtaataaggatgattactatgctagttaaataatacataaatgattaatgttagacaatataataagagctgtggtaatgggtgtattatatagggtttttgccatataacagttcttagaagaaaaaaagcagtttagccaaactgaaacttcttgacatttattttctaatgtaattttgagacagctattgttaagtagaactaataccttataaaaacaaggcaattgaaataaatgaatgaagagaaggataaggaagttaatgaaacagaaaaaaaaacaggagaaaagactgtggactgtaagacatagaagaattgaaaacgagaagaaagatgaaatgagtgaaattataaaatataccacaggagtagaaaagataaaggaggagaaagaagagaaacatcgtctctaaactcattattcctaatgaatttgctaccatcttacatctgtctaccagttagtactaggccatggtactgttgccccagatttttctccttcctagcctaagaccaccttccttagtctggtcctatttcttaatcatcacctcattacagggtaaagaaacttctgcttgagtctttatattgcttgttccatatcttttaagaaaacttaagcttaatgattaatacttacttatttttatttttttaaatcagaaatcatatgaaaaaatgccttgggtctaatttaacaatcttaattttttatttagtaattgttttgaaaatagaatgtattttattctgcttagttatccatatttaattttgtttgtatcttttttataccaaataaggatattttgctatatgaatgagattcttttaaaacatatattgtttctggctataaaagcagttaagtgtttcctgaagaaaatgggaaatccagatatgcaaaatagaaagacaagaaagaaaataatcaccagctattaaaattttcccaacttttcatctatagtatatatttcatcttatatgctactttttcctcaataccacatagcatcattttctcatgaaatgaaatctttttgaaaacattaccaccagtgtttttataatattaatatctgaaggatatttagatagtctccaactctctaccactacagacatacctggttttattctgttttgcagatatcgcattttttacgaattgaaggctgtagcagtcctgcattgagctagtctatcagcatcagttttccaacagcatgtgcttacgttgtgtctctgtgtcacaatttatttcattttttttattattattataattttcatagtgatctgtgatcagaaatctttgatgttactactgtaattgtctgggagcaccataagccatgcctgtagaagactataagatagcaaacttaattgataaatgctgtgtgtgttccaactgctccaccaactatttccctatctcactccctctccttgggctttcctattccttgagacagaataatattaaaattaagccatttaataactctaaagtgcttctaagtgttcaagtgcaagaaagagctgcaggtctctcactttaaatcaaaagctagaaataattaaactcagtgaggaaggcatgtggaaagctgagataggccgaaagctagacctcttgcaccataccattagccaagttgtgaattcaaaggaaaagttcttgaaagaaatgaaaagtgctacttcagtgaatacacgaatgataagagagtgaaacagccttattgctgatatggagaaagttttagtggtctaagatcaaaccagccataacattttcttagtccaaaatataatcaagagcaaaggcataggtctcttcaagttaatgagggctaagagagatgaggaatctcagaaggcaagttagatgctagcaagggtaggttcgtgagacttaaaaaaaaaaggagccatctccataacatgaaagtgcaagatgaagcaagtgttgatatagaaactacagctagctatctaaaaggtctagctaagataattgatgaaggtgaccactctaaagaacaaattttcagtgtagatgaaacagccttatattggaaaatgatgccatctagaacttggtatctggaaaggagaagtcaatgtctggattcagagattcagaggagaggctgactctctttttaagggctaaatgcacctggtgaattggagttggagatactgctcatttaacatccagaaatcttagggcccttaaattatgttaaatttactctgtctgtgttctattagtgtatcaatgaagccttgataacagcacatatgtttacagcatggcttactgaatgttttaagccctctgttgagacttactgcttaggggaggaaatgccttttaatatattactgctgattggcaatgcacctggttacccaagagctccaatggagatacaggagattaatattattgtcatgcctgctaaaatgatatttattctgcagcccatagattaaagagtaatttcacctttcaagtcttttttaataaatacatttcctaagactatagctgcaatagatagtgattcctttgatagatctgggcaaggtaaattgaaaacttttctggaaaggattcaccattccgtatgccattaaggacgttcatgattcatgggaggaggtcaaattttcaacatcaataggagttaggagaagttgattccaacccttgtggatgatggtgaggggttcaagacttcagttgaagaagtaactgcagatgtggtgaaaattgcaagagaactagaattagaagtagatgctgaagatatgactgaattgccacaatctcaagataaaactgcaatggatgaggagctgcttcttatggttgggcaaagaaagtggtttcttgagaagaaatattgtcttcatggagactctttgaatattgttgaaatgacaaagaaggacttaaaatattacttacataaacttagctgataaagcagtggcaaggtttgagaaggttgactttaattttgaaagaacttctgctgtgggtaaattgttatcaaacagcatcacaggccaggctcatgcctgtaatcccagcactttgggagcctgaggctgttggatcatgtcagccaggagttcaagaccaacctgagtaacatcgtgagatgttacaatctctgtaaaaaaaaaaaaaaaaaaaaaaaaaaatagctgggcatgatgcacatgcctgtagtcccaaccacttgggagactgatgtgggaggatcacttgaacccaggaggtcaaggttgcagtgagctgtgatcacaccactgtagcaagacactcaaaaaacaaaacaaaaaaaaatacagcatcacgtgccagagagacatgtttcacaaaaggaagtgtcaattgatgcagcaaacatcactgttgttttaagaaattatgacagccaccccaaccttcagctgctacctgatcatccagtagccatcaacatcaaggcaaaccccctcatcagcaaaaatattatgactcgctgaaggttcagaggattagcagtttttagtaatgaagtattttttaatgaagattttagatataatgctgttgccacttaatggactacagtataatgttaatgtaaacgtaactttttttttttttttgagacggagtctcgctgtgtcataggctggaatgcagtggtgtgatctctgctcactgcaacctccatcccccgggttcaagcaattttctgcctcagcctcccaagtagctgggattacaggcgcccgccaccacgcccggctaacttctgtatttttaatagagacgcaatttcaccatcttggccaggctggtcttgaactccagacctcatcatccacgcaacttggactcccaaagtgctaggattacaggcgtgagccaccgcacccagcctttgttttgttttttaagttttgtgaaactataaagtgaaacattgtgtaaaaacattgatgtcatctattgggggatttttccattgcttatttttatttaattttcagtgcgtatcacaatataactgaaaaatcacttgttgggggtggccgtacaactttctccattgaagtcataaccaaagtttctatgaacttgactcatgtcataggccaagtaatttattccaaaaccttttagcaccatgaaaattaagttaatttaaataattcatttttattgaagactgttcaaaaacatacctctttttagtcttcattcttttaaaatgtacttgctagatgcctgataaagcaattaaactgtcaagaaattaaggactgtgaaccaaatctaaaatgactaaagtgattaaaatccacctcttaaaaattaattctccatgcttctgatctcactttctttatttgccattttaaaaagtcaaaattaaaaaatgttattttctgatattagagcattaacagaatacttaacgatattgttcatttaattgtgcaactactcatggcctttaacatcagaagttatgttaatgcttttacttgctagtctctgtgaatattcattttgttcttcacatatgttgatcttaagtatagaatgttttatgataaaatattttataatggtatatttgaatgggtatgaatttattttcttatataattatcttgaattatataggatcacagtttatgaaattcaaaaaatagatttatttcaatagcatatgtaataaagatattttaattagccttattgggcaacagatactttttgcaatgtttaattaaaaatgaaaatgtctttataagtcattattttatatcaagttgagctttttaattatgattataagtgctgaaaaaaaaattgtgcccaaaaatattttagaacttggatgactacaataatttcttcatatcagcatttcatatggtaaaatatatgtatagaacattttgaaagtagccttcataacatgaagaatttcagaaataaagtcttatttatatgctgcttttaaaagaaaagacatctctgaaatgtatttgttaaaagatgtttgaggctgggtgcggtggctcacgcctgtaatcccagccctttgggaggctaaggcgggcagatcacctgaagtcaggagtttgagaccagccccacaaacatggtgaaaccctgtctctactaaatacaaaacaaatagctgggcatggtgacacatgcctgtaatcccagctactcaggaggctgaggaaggagaatcacttgaacccgggaggtggaggttgcagtgagcggagatcatgccattgcactccagcctgggcgacagagcaagactctgtagtttaaaaaaaaaaaaaaagtttgaattatttgtaagtaattgtcaaactagttggggcttttaaaatctacacataggtagtcagctagctatcttaactatatagcttaacacctatgtgcagaggttagagccctaatctaaaagccattaggaatgatgcctttaaaaatgtggtatttatataggactgggaaatgttgaacctacatttctctgctgtggattcacttagtatgttagtatattcctaactagctattaactcttaactatatagttgaatacctatgtgtagattttaaaagtcccaactagtttgacaattatttataaataattcaaacatcttttaacaaataaatttcaaatatatcttttctttgaaaataaacacgtaagtaagatgttgtttcctttctgtgtacatctcagaaagggatatactaacatattaagtgaatcttacagcagagaaatttaggtccaacatttcccagtcctacatacacaccacatgtttaaagatatcattcctaatggcttttagatcaaactctaaaaaaagtaaataaataaagtagtgcttctaattgtaacagcaaaaaataataagatatattttcctttggtatattgtaatctattctacagtagccagagcaggtgttgaaaagcctgtgtactccaatcatcaaaccacagagaaaaaatcctagtatcccgagcaagaggggatgctgacagttagagcctgagacagtttgaattatcatgtaagcatgtcactcgagtgattaaacctcaaaagattaaaaatggtcagcatctcatgagatacaaagaatatgctttctgtttggacagtgccagttttcggtgactgattattgttagctttttctgcacactagcatttctcccagcctacaccctgcaccaagagcacagcaactcaggatcatattctctctttattctgatagtgatgacatctgaacaaaagtgcacaaatccatattcatcgggaaaaagtcttgatatttgagaactaagtagatattgtttactactttcactatttttgagtaaccatagaagttactctcattattactaaatcttcctggtttctcccaagctcaacgtatggatgagtagtagtactatcctcaaaatgaagaggacagtacatgtttatccactcattagggaattaaaacataagcataatgattggtctgtatgaatatgtaatatatgtgcatacatatcttaccatatttattttttccactgtctactaactacttaatctgaatgtcataagatttaatctgtattagtcagcctaaggggagtgcaaataaacttggctcaaaattgcatgctttacagtgtaaaacttagaaattattttttagttttcattgaatagattcaatccttagaatctgtctattttgggaagaaaaaagtgggattacatccttctttttattttccacaatacctattctttaaaggattgtggaaatggtttagcccagagtaagctagaaatcactgcatagggcttattcaatgtgttatcagtgtcagaacaacttttacctaaatacattcaaagctttcttatctttcatttatttctgttaaatgatgtggacagtgtcttttaactagaattttgtatttatgtttgctatcatggtgaatttttttttctttttggtaccacatattgtcacattggttgattttctaaaaaaatacagaatatctaacatttggttgatgcaataattggtatcattatttaaatattctttataaagagatgcagtttagatgggtttgataatttatagactgaatttatttttattagcagttatgtttaagtcctgtattcaaatattataattatacttcttttatgcaatagtattatattatgatttaatggagatatgagcaattctaaatgtgtcaatcccctatgatattttctgttaaaattaattataattgctactaaaatgtagaatttatttgatccatcttcataaagagagtttttttctccttctagagggaattgatttatttcacatgatgaccaaaactaagcattcttacaataggtcataattcggttcaaattgtagcatagtgaaaataaaactgagggatgattgtctaatgctttggaaagttaatttgattatttttataggagatgtattatttacacatttcatgataaatattgatttgaactgcacatgggatttagtttagaaatcaggaaaagtgaaagcaactgacttaaactgaacattttattaaacattggaatttgttttacattaaaatgtatatttagttcagtataacatagtttacatgaaatatgacctagctttatttaggtctttgttttactctgagtcctttggttttgtcatttttaagtccatcatactgtgccatgcacacacatttgtgggattggctagttcaaaagaaattatttgctttaattaatccatttggatatttaagaaatatattcctaaaactttttagtactttgtgcaaacatgattcttggcaaattccctgaggacatttttttatattttcaccccaacagaagctaacattattgtacccttatcatattaagtgagataaaatgtaaacttctcaatacattctctggcctatcagcaaaataaaaagtcattcaactgggatttcgggagactttataaaagcagagaaaaattgtaggccacttacaaaattctgcagtcaaattatattttaaaaaatccatctagagttagagacatgtttggactaatttagttcaagtaagtatgattcttgcataaatagtgattttcacactgcccttttttatgtaaaaatattaacaagtatttctgctttttagaccaaaataaattatattccgatattttattatgatatccattgtatagactgatttattttaaagccaggagtttctaggtaagtactgaatatctcttaatgagaataatagtgactatataaaatactattatatctgtgtgaccatgcaggttatatgacaacaaagaagaaacttaaattttttttattttcttctgacagataagtttgcaaaggtggctctagtagaggtattgacaatagcaaacaaaaaaatctattcccgtaggtaatgaaataaattaattacttatggttttcatttactaggtagtttagtctgtattattttcacagtaacctcaatatgtctagtaagtctaaataaacattaaattttattgaagaatgaaaaagaaagccacactcagagtcactagttgttggtaaatacatactttaattgtatgtattttgcttctttggttaccaggaaatatttctttctcacacaggctctttaggttggaattgcctgagtggcttttaatgtttatagaggaaatgtaggaggaatgatttcttttaaaaaatgatttataacccctatagggattcataatattattaagaaattttaattcactgaattctggatagcagaactgcttcagcctcttactttttttttttggacttttactttcataatttctcctttcactaataccatcttttacttttattttggtcttttactgttcaccctgcttaatcaaatctttccccatcctataaggtctaactcatgctttccttccatgaacactttcagttgtgcattgattctacatacatatattttgtaccaggaagtaatagggaagctatagaaatagttgtggacaaaaaaaaacacataaaaattgctaatataaaagcttataaagcttacattctagtgaggtggggcagacaacaaaataaattaataatctacattgtattttagaaggtgataaacaggaatggaagtagaaatggggtggtgaggcaggggttgattgacaattttaagtaacagtaagagggtgatatttcataatgtagaagaggaaaggaagcaaaccatgtacatatctaaggaaagaatcttccaaacagaacaccatctgtgagccatgaggctgaggcatgtcttttgagttctggtaatggtaaggaaaccaatgttgaaaaagcaagagaaagagagtaggcagtgaattcatgtaaatactctcaggagttgggctattgtactgaggcaagtgagaagccactggagaatttcagcagaggagtgacataatctaactctgggttgaaagaattctcctcctataaaacaatggccttcattaaggcaatcatttttatctaatttcccggactgacttcttactttcctaacctgattatatgctccttttagtcaaggacatgagatataatcaatctttttatattccctacagcatctagaataaagtaggtggtatagtggcactcagtagagaattattgatttggtttgggaggctggagcagaacagataaaataagcattgctgccagcattggcagctccagaaatcttttctgcacaactccgttagtttaccttgtaaatacaaacagtccaatagaagctgccttcctgtcttcaatctagaactgagaataaatcacaaataatcaagttcatctgtattgtctttcaaaatctgagcaagtgtacacttgctcagtgtatactacaagtatatacttgctcaatgtatactacaagtatatacttgtagtataattactatactacaagtatagtaattattcatgacagccaatccattctagaatgcctactattcctttacaatttgttttagcagatcctgtgatttagtcagagaaatgtccaatgtcctcttcgtttgagtgcagtgaaggctgtctttaacaacagatgcaaaagcacctttctcctattcatttctcagacatttatgtcttgcagcatgtgagaagcatattaagtgctagtcaggtaatagaagaaaggtttccacagataatacctgacaattcaatcaaagaaaaatcggggaaaaattcatggagaaaggtggcttatagacgataggtggagttccttggacattcacagaataaacagcattgccttgatttccttttcaatacttcagaaatataacttcacctatcattttatagcatcataaatcacctatctaccgatgaaattacatttaagacctcaagtaaaagcttaattaatttaattttaaaacgcagagcagatactatgctgatccatatgattgtgtgtatgcctttgtcttaatttatttccatgttgtttcttagaaatgaatgtatggtaagatgtactccttaaggtaatatgtatgctagatctaaaaatgcagccatcaacaaacattcccatctctacatccagcttgattttttttctctttagcacttcttactattaacagagcatatattttatttatttgccttattttctatctacccccttcccacccctattagaatgtaagcttcttagactcttctggaacgagactgaaacaggcaaacacagaagtaaggagataggttagcaagctatgagaaggtacagtgctgtcttttaatgtagtgagaagtgcttaacactggctgtattttgaatattgagccagcaggatttggtgtaatagacagaggagtgttcagtataacttcacattctctggtctgagcaaatgtaaagatgaagtttccactgagacagcactaattgtgagcaaagtaggatcacgggcaaacatcagcagttaggtttttcatgtgctcagtgtgaggcaactgttgtatgcctacacagtacatggccttgtgattcctgatccattcttcttgattcccttgctctatgtgtatggcaggtctttacccctgcaggtagtgtttcccaggctaccttatcagctaacttttgacagcatgtggcccctattaagaactggctagagcttggaaggcataagaaggcaaaaaggcgagtatttctcccttttttctgtgctttaagtgtggtttccatcggcaactatttctcttccatgactccaggtccctccatgctgttccagtttgtcctcatttattcctgtccagtaactctgccttctccttttccctctccagtgaaaggatagcaaaaacatcttctcttgcctgaggcttgtcagctcttctaacatctgtataaacaacttcataaattaaattatctctgtttcaaatatatgttgctgttcttgcatccagatttatataatttacaagtagagataaaaggtagagcagtctacatctcagagaattatatgcgccaatgcagttgaagaattctaacagtccaggtaccagagggagtgaggtgagaatgataggaagtaatagagagtggcaccctggaaattgttaagtataaaaagagtaatgatgaggtctaggctatgccatgggaggggacggttgaagtatttggagacatgaacactgaagaacgagaggtcaaagaacccaggagtcatagttcagtaagaattatttacctggaatttgatattcataaatattatgacaggagtagtatcagtaaaaatgtcagtgagctagggactaaaatcttcaaggagtgagaaagactgacctggagtctgaatagcaacagcttggagggacagaagtcacataatcagttgacataagcattatagctatgggattttatatggaagtgaagaagtagttaagactttcaaggttatagaagagaagagcaaggagaattacacactttccggcccagtgacggtaagggtggaagaacaaccaaccctacttaagagggcttccagagaagctatgtgctctcagaagtaagcaagattctgtgaggatgttagaacaagaaaggatagggaacgttgaagaagatggtgaagattttgctgatgactaaggatagagtaaggcatgtggttatactgttatgggtgcagatttgtgtggagatgataattcagatgtcgagcaatgacttgggagtactgggtagttgtggtaactgatgtatcaaggacaaaagacatggagggattattctagattgtctttgagaaagatcacattcactatgctgtaagtatagggagcaagggagaggcaagggttttcccaggattacatagaactttggctcctctgtcatcacttttggtgatgtggagatgacagacagttgctattattgggagctagtgataatgttgacatttttactagagtatatgatttgaagtggtttctatttgtctgtaaaaaaatcgctattaaatttattatataaacatttataaagtatttaacaactttgttttgaatggatttatacagattttacccttcaaatgttgtctacgtttcccaaattgtaagatcagttttttacagcagaaaatatattttaaatttcttgtatatttcaaattagctagaagagaactgtcatgtttccaacacaaaaatattttaagtaatagatatctatctcaattactcttatttgatcattacacattttgtacttgtatcaaagtattacatgtaccctcaaaatatgtacaaatatgagatatcaattttaaaaaaaagaaacttaaaagaaaatacattttagagcagagtagataatatatttactgtggccagatatttaaattctgagggtcacttcatcacctgtatgagagatacagtcatatgctacataatgacattttggtcaaggacagacgacatacacaacagctggcccataagattataataccatatgtttactctgccttttctgtgtttacatatgtttagatacacaaatacttacctttgtgttacaattgcctacagtattcagtacagtaacatactatgcaggtttgtagcctagaagtggtaggcctcatagcctaggtgtgtagtaggctgtactatctcagtttgtgtaagtacactcgatgtttgcataatgatgaaataaccgaatgatgcattattcagaatgtattcccatcgttaaggaatgcatgactgtatatttgtttcatgcaacagaacaaattaagagacttttaaaaacaaattaaacaatattccccttatgttatctaacatatctaaataaatctgaaatatttattgaatgcattattaaaatatgaaggtcaattgggagaattttcatagttatttgggttatagctttaaaaattacagattaagtgttagcaaaatttgactaaacatcgaggactgtttattattgtattcatgtataattctttttaaaaaattatacatgtccagaaattcataaaattataaaaaattgtaagaaaataaaaattgtcctaaatcttactgcatgtatttcttacatttctccaggtgtgttctgtatggctctttactatgcctgtatttttacatatgtagttaattatttttgataaaatttagatcatactgaatatgttgtctcattttcattcaacaaagtcatcagcatgttgccacaaatgtttctagctattatctgaatgcatgatttcaactatcactgaatcctgttctatgattgtagtactattattttaatcatgtatatttaagcagttgttactggtgcttctcacgtgagaaacaatctgtgtttaaatcactatacctatctttttttaaaaaaactttcagttcagggatacatgcgcaggtttgttatgtagataaactcgtgtgtgacaggggtttgttgtacagattatttcatcacccagatactaagcctactacccagtagttatttattctgttcctcttcctcttcccaccatccatcttcaagtaggctccagagtcttctgttcccctatttgtgtccatgagttcccatcctttagctcccacttacaagtgagaacatgtagtattcacttttctgttcctctgctactttgctaaggataaagtcctccagctccatccaagttcctgcaaaagacgtgatctcattcttttttacggctgcatagtattccatggtgtatatgtaccacgttttctttatccagtctttcattgatgggcatttaagttgattccatatctttgctattgtgaatagtgctgcagtgggcatttgtctttatggtagaaagatttatattcctctgggtacctacccagtaatgagattgttgtgtcgaatggtagttctgtttttagctctttgaggaatcaccacactgctttccacaatggttgaactaatttatactcctaccaacagtgtataaatgttctcttttttctgcaaccttgccagcatcttttattttctgtctttttaaataatagctaaactgactggtatgagatggtatctcattgtagttttcatttgcatttctctaatgatcagtgatattgagctttttttctttcttcttttttttttctttattttattttattttattttatttttttgagacggagtctcgctctgtcgcccaggctagagtgcagtggcgcgatctcggctcactgcaagctccgcctcccgggttcacgccattctcctgcctcagcttcctgagtagctgggactacaggcgcccgccaccacgcccggctaattttttgtatttttagtagagatgaggtttcactgtgttagccaggatggtctcgatctcctgacctcttgatccgcccgcctcggcctcccaaagtgctgggattacaggcttgagccaccgcgcccggctgagctttttttcataagcttgttggccatatgtatgtcttttgaaaaacgtctgttcatttcctgtgcccactttttaatgtttttttctcttgtaaatttgtttaagttccttatgaatgctggatattccactaataaagcagaaaagagagaagatccaaataaacacagttagaaatcactatacctgtctttgattattttgataatcaattttcagaaatagacttatttaggtagaaagtattggaattttattgtggatagccaaactgacctccagaaatatttaactaccaagagcccttatcaaaactgagcattgtcttttggttttcaatctttgccaatgtgataggcaaaataatttctcatttaaaaagggattactacttggtttaaggcttagtatttttcatatccttattggcagtgtatgtagtgtgtatcagtgtctctttaggcctctttactgatttaaaaattaggatgctctactattcatcaaatatggctgtgaactcttttgcatatatcagttcatatatgtatatataatataaacatgatttgttgccatttaattttatatatgctactctgcatttttatgagtctatcttttgcttaatggtttatggctctgatatgatgtttgaaagccttatccataacaaagttaggaaaatatttatttctgtgttcatcttttgttaaatggcttaaattttatgttaaaatttactttatcaagattatggtttgtttacaatgtgaaggtatttctgactgtcggctcccactaatctattcagtaacgttgatacctttattattaaacgcatccttcccacattattttgaaagactaatatttttttccaaggccaggtagagactaaagcctgtttctagactttctggtcttatttaattctttattatttattttgtggctaatatggcattgttttacttatcatagatatctgtttcacagatattgatataccaaacatgtctttgaaagaatctctgaaatgatacttatttaaagctaaagtttgctgcactgagggctacttttgtttctacccaaactaaggataattccgtctctaatcaatgggcaattacatataaaatattataatggaaataagggctaactcaggtattttggagagagatatatgctgaagtagaaacttcagtggcttgaaaagcaattagctcaagcctttgtagtatgtcttggtgcagacttggagatatagtgtatatggacctcaattactgagttcctgtttttagtaaatagctgccctgtaggtcactaagtgctattgctgacaaggttgtgtatgagaaagcttttattttaataaccagtggcaactggcacttacaaagaaccttccatttctcaaaattcttctttggtttagaacggctatacagaattgcaggcacctcagggatagtagaactaaaccaattataaacaaaggaataaatgagacatcaaagaaaaggagtttttaagtagagacagaacaccaaaacttattcttatgaaatgtggtttggtgtctttatgactatattgaccaaaagaactttggtttaaaaatatgctttacttgagatccaaacacaatatcctgcagataagtaaattcattttcctcagaaagaaaaataagctatgcctagttcatgtagagtctacactgtagttgtcagctttaatgttacaagtttggtgatcttgggaaagttacttaaattattttaacctgtatcctatctgtaaaataatgaaaatgccttctgtgaagacagttttgaggattaaattaggtaattatatagagtgcctttctcagtctgcagtatgcagttgagaaatgaatggtgaccaatgaaaaagcatgattatatttttatttttaagtaaattatattttatatatttaagttatacaacatgatgttgtgggatacatttagataataaaatgattactatagtgaagcaaattaacatagccatcatttcatatagtgacctgtttgtttggttttgtgacaaaaccaggtaaaatctactcatttagcaggaatccaaacacagtataattttgttaactattctcatgttgtatattagaattctatgaagttgccaatgtgataggcaaaataatttctcatttaaaaagtaattactacttggtttaaggtttagtgtttttcatatccttaatggcaatgtatgtaagtatgtatcagtgtctgctgctttctagcctctgacctgcatcatgccattttctcctcacccccttcttatccctggtaaccattattttattctctatctctgtttatttgactttttcttagattccacgtgtaagcaagattatgcaatatttttctttatgtacctggcttatttctcctagcgtaatatcctctaggttcatctatgtggtggcaaatggcagtatctccttgttttgtttaatgctgaataatattctgtgtgtgtgtgtgtattatatatatacatatatatatttatatattttatatatatatgctatgaatagtttatccagtcaccaacagatagttaggttatttccttgacttgactattgtaaataatgtttcaataataagggagtacaaatatttttagaaggtggtaatttcattccctttgggtatagtcccagaagagggattgctgggtcatatggtatatctgatttttagctctctaggaactccatattgttttccataatggctgcagcgatctgtgttcccaccaaagtgaaacaaatgttcctctgaggaacattaaatctataaggggctatgtaatatataaggttttatatagaaaaccacaaaacattttcaaatggcattaagaagacctcaaaatatagaaaggcataaaatatttattgctcgaaagtattaatattttaattatatataaagccttaaattaatttattaattaaatatgaatatgatataacttccagtaggaagtggtatgtttgtgtgtgtctgctgaattaaatggaagatcaaaaatggctaagaatagctaaaattatttgaggatgaagttatggggatgtattataaagccatgaaattcagaaaatgcattgtcagcagaaagataagtggcataaataggacagaaatatcaaacaatggaaatatatataacagaggtgacaaaaatagatagtagtatacatgatagataaaatcagttccatagagtaaagacaattatgtagggaaaataaataaacactttcaaagaaaatatagactatcttaatgacctttgattagagaaggaattccagaaagccctgtctataaagaaaatcttgataaaattgactataaaaataaaaatataagacacacagtggaagaaaacgtcatatatatttgtcatatgtatttaagtataattagataaagaaatatctattatatatttatttaaaaagaaaaccacaaaaccgtaagacagagacaagcaatctaatcacaatgtgtgaaactgaaggaaaaagaatgtctactaaatacacaaaattacagaaactaccaaaatggagagcaatgaaaaattacttaagacataattaagaagtgtaaaatattaactaaaaatatagcagcatattaaaggtcatcccaaacacacaaaaaatggaaaatttcataaacggctggttgaactgcagatatgtaaatctgattacaagtaatgtagcaatatttatcaaactgaaaattatctcactactgaaattctagtgtacacattcacacaaagttcaaaatggttgatctctctctctctccccattctccctccttttgttcctctctcccttcctcctttcctcgttctctttatctctttctctctctcccttttcatcttcctcccttcccccctcagtttcaaaaagtaaacacactgtatgatttggaaatttttcttagaaaaagtcaattcaaaacttttcaatattaatctttgagaagaccattaaacaagccaatctggttttaatataactattacatatttcagataaattcagtaaaatatatacaagcaaagaaaaagtactgattttattctactttctataaccctccaacattgtgacttatcaatgccatatgtgaatctatatctattaatgtatgcattgaaaaagttggatttaagctgagcatgtaaaaataaacagatatattagttaattttgagagctggcatgttataattaatacaactgtagctttatatgattatacatgttatatattctttgaaataaaacaacatttaactaccaatttatgacattgttctatttgttaaaaagaaaaactagacatatggactatttttttcttcttaaaaaaatgtgttaaggaacattccccttaataaaaatcagggtagttacccatcaaaaaatatatttctccagtaaatattcatcttcaggtttagtatatcagtagttatatataaattcagctttttgaaacatcacaatagacattttaaccgtaatagtcatgggacttaaatttagactaccttgtcacatcatccctgatacactgcccatttaagggcaagaagaatccttattacatgaaaaagaatttattttagtatattctattcagagtccgtagttaaaacccaggctatgttgtcatcttcacattcaaaatcatagtgtattaagactttttccatagctaacatccttgaggttgacatcttcttgtgactgagtagatagcagcaagaaattcaattacagcaagccagctttgtcattgcacctgtctgcttgcacgggaaatgatttgtaaattgggctttatctttcccgtcccataaatctcctgtccataattgacacttgtcagcatagatgaatagcgggagaaagaaaacagaaagtaaatgagtagcccacctgggaaaaatgatgtcttgttgcctttgggagtcatttacaaacagcagtacctgcgggccagtttttatccataagcacgttgcaaacattttactattgaaaaatacaatgccagggctgaatcataacaaagacaagacaaaggaaccataattaacatataacatttttccagagaacataaacatgtcttccaaggaaattgaaagcttttctttactgtttgtgatgctcacttattgctgctgcacatttgtaagtatcgagttagcatctgacctgtcaaaatgcattcatgaagcaagcattttggttgtcttgggagttgatattgtcacttgttacacaactcaacatgagttcaaagttgtttgataccagtgtcgacagattggttttaaaaagacgtgagaatgacgatattttctttcaaatgtcaaagaaaaacaggattccataatgatgatcttgggagcaagcactacccataaaaacatgacagataaaccttcatatctaatttttctaaatgtcttatatgacttcacatctctttatgaagcttatctcatattgcaaaatatttttactttaaaaccaaaggaaaatatttcagaattcattaataattcttaatactaaatacctaaatattctgaaacataattcttaaattatcactaaaatttgattgttttaaattttaaaaatacctaaataagattaaatgatagattgaatattttgcaaactaaattatgaataacaaaaaattatatatatatatatgggtttacatagtcttttctatgtattacctgatttttaataatctaattcttaaatgtgtatgattttgtcaatatttttaaaaaatctttaacttaatattagaaaaaagaatttatcatttcttttcaattgtacaaggcctcaaactatttctcatctctatcatttactagcatcttctaacttaaaagaataacatctttcttaccctctttgtgcccacagatcagcatgaatttaaagagtttataccttctccaaaatgagtgcaaacaattagaaatggagcacttggcaggagcgcagatttatcttgaatacctctctctatcactatcttccagtcttatcacctgtagttcaatgggttgtttgcctttctctctagtattcatagaagttgtaagcattatattatatttacactacaaaatgaaaagttgtctgatgatgttgttacttctctgtaggttattgttagtgtaaagtaacttatttatttatacctactttcatatgctgagcttgtaaaaacagttgggaatttcttggatattgatctaaagcaatagatattaatagcctaatacagtagtactccataaccttttatctgggtcagctttgtcatgtggcaacttaactgaataccgcccccccaaaaaaaaacacaacttttcaatacaaataagaatgctgcatttctgcctgtctcttcctaaatcatcaggtttcccataaataatattgtttttctaaatggtatcagcagtttagacagagatatttaaaatactagggtaaaattaaaatattaggtagcattgaaagtagagatgtgaatacttttgtatttatgactgcatttaccaagtcatgttccctattgatatgcaaaataaaaataagtattaaaaaataaaagtaataagttgggggcaaggggagggagagcatttagcaacttggacaaaatgacttaactaataagtgacagagctgggattgtgccttttcttgcatgacttcaaatcttgtgaaggagtgtggggagtgtcttcagtaatacactttctgtttactgtagttaactatatatgcttatgagacagtacccaatcatatgttattgtttaattccaaatatgagaagtaaaatttatgttgatttgaaaatattttttctaactttggaatataatggaattatattccatgtatgttacataccttgaatattttgatgtgtgtgtggctaaagttcttttgcaccttatctgaggagtaatgtacagttttgcaaatgaatcattgggaagcaactgacaaataattcttgtttttgtacacataacctggtaatctggttccagaaaagtattttttttttttttttttttgagacggagtctcgctctgtcgcccaggctggagtgcagtggcgggatctcggctcactgccagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccagaaaagtattttttatctgttgtttagtgatggaagtttaatcaattttgcagcttttgtcaaatattttatttgcctgtgtgattagacgcttaatgataattctctttggtctttgactaaaaaaacaaaaaccgtaaaagccttagaattctgttaaattcaaaagttcttattttaaaacattgcataaggaacattgcattcaaaataaaattttagtaagtacaaactgtagagagtattccttttatttctcattgatatgtagtactttataaacaaaatatgttacacaattgcttttgcttgccatccaagacagtttaggacagaaatcagggatgtatccataagggggttttcagagacacgcactactgaacaaattttattactatcaaaatataaaatttactcattttaaagaaaaattcggatttcttggtcagtgatttgcaaatagtaagtgaacatctacagagtagtatttgcaacataaactactgggatctatttcaatgttgtattcattgtttgcagctgtattttttgtttgctttatgatgatgatgatgaaatgcagaatccagtttatattaactattagatagaattccctttaaagagtcatttgtgtgacttttgctgggccacaaatcttaaaatgctaggacactgggcattcgtaagagcctcgctgttatgtttagtgagaagtcctgtaatggaaggtactcataccctgtgttgcttcacatctcagcaagcaaacattactgccaaaccttggttatagtttgtatataatctaatggtttaagcaaaagagatctaaaactgaataattaacctaaagctaaaattaaaggagagagagaggaaagaaaggagaaattacttctattccagaggaagattttagataactgaaagttatcagacttctagggactaattccagtctctctgaattagacctggcaaattgctaagagttgaagaaatttccaatgccattttgtatgtattacctatcatttgaatggagagctgaaaccttatcaatcttgtacaattattatatatagaattcatttttagagaatatgagccaatacagtttccatgacagcattatattaaatgagaaatatttccaagaaggtacaagtcatttgttacataatacttttctgtagttatcatattatggaattcactagtcagagaattaccaaaatatgtttgttcatattttatatgtcatattttatattactatatatagtcaaaattgcttttgactataaatatgaagaactttttatacaaaaatcattacatatgtgtatatttatgcacatatacatatatgacaagtttaaaaggaaactcttggcttagatactataaagaactataagcattttattacatggaaaattacaataaatattaagaagatgcatgttgtgtataaaatagagtgtatatcagtttagacaaaaattgttctttaataatttgttcatattttgcttttccatccaaaacggttttaaggcaaagggaatatataaactaaaatccttcattgtgatgaccatttaaatgaaaattcagggaattgacactatcattttgatgggctttgttttattagtaagtgtgttatatgtaaccaatgattttatatgtcctacttaatctccaaattcctgtttaggcatgcagacaaaatgtaatgagagaacttggttgcatttggaatatttgtttaaaataaggtaaaccttaagattacttttaacaaaattattctacatactttcttatttttttatttttttatttttttgagatggagtcttgcactgtcacccaggctccagtgcagtggcgcgatcttggcccaatgcaagccccacctcccaggttcacgccattctcctgcctcagtctcccaagtagctgggactacaggtgctcgccaccactcccagctaatttttttttttgtatttttagtagagacgggatttcaccatgttagccaggatctacatacttttaaaagctatctgtttataaactatgaattaatagttgtaattcattgttatcaaaatttcttagtgatatattaaaaattatcaaaaaaattattgctgactttcaagttgttattctaactatacatggtatcactaatttgcttctctgtcatttgagagttaatgatgtttccctcttagagaattgcaatatacattgcaagcactagttaaaaatataaagtgatcttgaggtgtgtgtacaattttacaaagttttataagatattttagtacttgagcaaataaataacctagaacttatatggggggaaaaaaagcttcctatccaagagggaaattttagataattgatagttgttattcattcatttaaacagaatttaatatatgtctaaagttgcatgctgtgataaataatgggaacatattggttagcaaaaccaaatgtggcctccccatcactttatggtacttgcagtctagtggggaaaacaaatagtcatcaaatgatcatacaaacgcatgccaattttcagctgtaaagtgttataaaaagatatttgctaattccactagaacacataagagatggattttactcagagaagttaggaaagtcactttaagaaaagaacagtcagaatgatatctcaacttggtgtgaaaagcagctgggcagagccaagcaacagaaaagagtataaggtgcacaaaatgagggaagatttatgcatggtgaggctggaaaaatacatggggctcagacagtaagtcatggtaatgattttgtttcttattctaaaagtcatgcaaaattaagtattttaaacagtttttattaagtataatttgcatatgataaaattcacccagttcaaatgtataattcagtgattttaataaatgtactgagctgtgcaagcatcaccacaatccagtattagaacatttccataaccccataagatcccttctgcccatttacatgtattcccattctcacccctagacctaggcaaccacgaaactgctttgtgtctaaaattgtctgttctagacatgtcatataagcaggatcatacaatgtcgtctggcttctttcacctagcctaattttttgaggtacttctatgttgtactgtacagcctatccatccatttgtattgagcacttctatttctttgtatgtattctaccttatttgtttgctagtttatgaacctttatgttgtttccacttttgggctatatgaataatattgctgtgaacattcacatttaaatatttgtgtggacctgtgttttcatttcttgcgggtagataactaagagtggaattactaggtcatatggtaactttatatttaactctttaaaaaaaactgcttttacatagtggctgcaccactttgcatttctaccaacaacgtataaagaattctattttcaaattcttgccaacacatgttattatctagattttttaaaattatagtcattctagttgggtgtcaagtgatatcttactgtaggtttaatctgtattttcctaataactaataatgatgaacatcttttcatatggccttgaagaaatttgactcttgcttgaggagaaggggtttgcaaaggaaacaaagtggtagctaaataaggagaacacatggacacacagagggaacaacacatactggggcatttcggaggttggagggtggaaggagggagaggatcaggaaaaataactaatgggtactaggcttaatatcttggtgatgaaataatctgtacaacaaacccccatgacacgagtttacctatataacatacctgcacaggtacccttgaactaaaaataaaagttaaaaaaaaaaaaagaatcaaccagacaggagaaaaactagaagagaatgtgccacaaaagccaaggagaaaaggacagagagattaaaaatattaatgctactgagagtccaagaaaagtagggattgagaaaagcacttcagtgtgagtaaccttatcaataactcatttaatggaatgaggtggaccgaagccagactaaagaaggttgaaacatgaaaggagttgagaaatggagaaaaagaatatggacaatttttttcatatttggctatacagtgaagaaaagagattccccagcaggtggaaagagttataggcttgagaaacaattttattttcatgggagagtttacacaaaatctttcaggaagaatccaatagataggaagacactggcttatataaaagagtgaaggtaatttgtagtgtcacaccattattcgtttatttagcatatactaagtgccaaaaatatgcatggtggagtattccttgttagtactgtgaatcaatttgagactttttcaaataaatatttctcaattataaaacagagaaattaaatgttattgaaagtcttttaaaaagtactatattcatgctagttaacatattatatatgccatctagtaaatgacttctgtcactggaaatatgtttaaatcaccggatgtgactgtttcagacgcaacctttgccctgttcagggtctccacagctgtctggtcctggagggaaaagcttcacctgaaaactcccagatacaagcaaaaaatatttttctcacctgctaccttttaaacctgacaaatgaaggtttaatgctatcatatatagtcttccaagccccagtttaaaaacattatttttatccatgatctggtgccttcacttaggaaatctgaatcaattcctttggtttcttctgttctatattcagagaagaaattaactggggagcagggagaatcaagttaagtgtgtgatctccctctcctctgctattgggatgatgaaggtgacagacactgctagttttctccctaatatcttctttcttcttatttaccatattttttagtgcagcagtacagccagattacattttaaaaatccatttcccagcctagggaataagatgcaaacagaagatttccatagcttactggaaactttggctttcctaattcaggtgctgagcattcgcattgcttattccttctccatgccgcaatatagatgtcataggtgtggtagcagcaacagccaagagggaaaggccatgagaatcatctgtatagccttgaacaactgaataaaacatagatgcccatctgtagaatacatttgtgtgggggtgtgtgtgtagggtgtgtgtgtgtgtgtgtgtaaggaaaaacaacaacaatcaaattactagttttttgagttttcttacttgaagccaaacagactgtaactcagagaaaggcaaactttttctgaaaagggccaggtaataaatatttcacatcctgcaggccatgttttctgtgttagaattccccagcactcacattttggcacagaagcagccagagggaatatgtaaaaaagggtgccgctgtgttccaatgaaaccttatttacaaaaacaagtggctagccagatatggcccatgggccacagaccccagctctaactgaaaaaagatgaaagtcagtacatcatctactttatatttatatcctagttagtttttgagttcgttatttcttgctggctggagattatttaggaataaagccggaacttcatatgtggcaagagaaggagacaggcagacaacaagcaaaagtttctgtccttggctaagagatatcagaatatggggagaattcagggagatcttcattcctgtaattgaagcaactgcatcagtagaaatagcaaacacattttattctttgtcttggtttttctcttttgcatagttaataatattaaaacagaattgttttcgatttcttatctgtgcaaatttacaatagtttaagaacattctgggtcaaatacatgtttgttggctggcctagcaatctgctatttctgatattacttctgtgttaactccaaattacaaacaatgaaattacaaattaacttttggagccaaacttattcataaaatggtaactctcactctgtataactattcattataagccagatcttcccagtgcagtgattcttgggtattaattagctgcgttaattttctcttggtactaaaatattatatagtaaattaatgctgctttgtaaaacaacaactttaaaatagaagttgcaaagctaatcaaaatgtatttagcagaaaatattaaacttaagtgctcagtttgtaacagattcttgcaataaagtggtaaatcttgactaatattgagaacttattaagcaatatgaatttcttaagtttatgcacttttgagatacaatgtattcagagtacctggagcaattgaaatgataagttttttaactgtacttttttttaattatactttaagttctgggatacatgtgcagaatgtgcaggtttgttacataggtatacacacgccatggtggtttgctgcacccatcaacccatcatctacattacgtatttctcctaatgctatccctcccctagccccccaccccccaacaggccctggtgtgtgatgttcccctccctgtgtccatgtgttctcattgttcaactcccacttacgagtgagaacatgaggtgtttgggtttctgttcttgtgttagttttctgagaatgatggtttccagtgtcatccatgtccctgcaaaggacatgaacctatccttttttatggcttcatagtattccattgtgtatatttagcacattttctttatccagtctgtcattgatgttgattggcatttgggttggttccatgactttgctactgtggacagtgccacaataaacatatgtgtgcatatatctttataaatgaggtagtattaatgagtctcaagccacattcattttccttccttttcacttccttctccccctgctgctgctgatctttcttattcttttctttctcctttctttcctgtttcttttcttcttccccttgtaggataatccactttacagatcatcactctgaggaacaccagaatgatgattttgaaaaaaaaaaataaatgagcaaagccactaacgaggaagaattctgcaaaaactaacattgttaaatcatgtttaagaaagtcaatttatgtttgatatatatgggttttaggcctggaaaacatacagtcaaaaaatatagcaggaaaaaaggagagaaataaaataaaaagatagaataaaatagaaacaactatggtactgatagcagccaaaatataatgaaattgatcattctcttcaaccattattgagaactttgggatggagtaaattaatggtataatatggaactatcaagcatttttgctgtatgaattatgttttgtattttatcagcttaaatgaatatcactttaagaataggcataccttcaattatattttatgtaatatagtgatttccaaaactttaaattgtatttatagtaattagtagatgcatattatatatctttattttccttgatccatatgcacataaacatgtgaagcaaaggttctgtgaaactatattactgtgtccggaattggggggttcttggtctcactgacttcaagaatgaagccgcggaccctcgtggtgagtgttacagtttttaaaggtggcgtgtccagagtttgtttcttctgatattcggatgtgtttggagtttcttccttctggtgggctcctggtctcgctggcttcgggagtgaagctgcagaccttcgcggtgagtgttacagctcttaaggcagtgcgtctggagttgttcgttccttctggtgggttcgtggtcttgctggcttcaggagtgaagctgcagaccttcgcattgattgttacagctcataaaggcaatgtggacccaaaagagtgagcagcagcaagatttatcacaaagagtgaaaaagcttccacagtgtggaaggggacctgagaggattgccactgctggctcgggcagcctgcttttattctcttatctggccccacccacatcctgctgattggtctgttttacagagagctgattggtctgttttgacagggtgctgattggtgtgtttacaatccctgagctagacacaaaagttctccatgtccccactagattagctagatacagagtgtcaattggtgtatttacaaaccctgagctagacacagagtgctgattggtgtatttacaaaccttgagctagatacagagtgccgattggtgcattcacaatcccttagctagacataaaggttctccaagtccccactagactcaggagcccagctggcttcacccaatggatcccgcaccggggccgcaggtggagctgcctgccagtcccgcgccctgctcctgcactcctcagcccttgggtggtcgatgggactaggcacggtggagaagggggcagcgctcctcggggaggctctggccatgcaggaacccatggggagggggacggaggaggctcaggcatggcagggtgcaggtcctgagccctgccctgcagggaggcagctaaggccgggggagaaatcgaccacagcagctgctggcccaggtgctaagcccctcactgctcggggctggcaggtcccgcggctctgagtgaggggcccgccgagcccacgcccaccgggaactcgcgctggcccgcaagcgctgtgcgcagccccagctcctgcctgcccctctccctccacacctccccgcaagctgaaggagccggctccagccttggccagcccaaaaaggggctcccacagtgcagccgcaggtcgaagggctcctcaagtgtggccagagtaggcgccaaggccgaggaggcgccaagagtgagtgagggctgcgagggctgccagcatgctgtcacctctcattactatctgcagtgaactcaatttttattctaatttattttttaaaacttcggttgtaatccattcattgtgttcacaataatgaaaaatgctggtgtgatggaaaagtatttgggaaattataaacagtgtagtcacctattaagcactcagtgttccgtaatggaagttttatttaaatggataaataggatttattatgaatgtgtatgattaacagaatgtgtaatatctgccttaaagacaaatctcatattccctttttcttcagtttccttctcatggaccctgttcttaataaacaaattatatattgtttaaatacatgatttactgtttcttaaaagtaaaccaaatctatgaatttccagagtattattatgtacatgacaacgttataaacattgtgcacatactttggaagaggaactaataagcttacttaagcacatagtgacatatatatgtaaaattgtatatattacataaaattatttgtacattttatgaaatatataatatataaatttaccttatctaaatgaaggattatactgatgtgcatgttgtaaggaaatacagttattgtacatcaaatttaaaatataatttacctgtgtaatacagaaatccatattgtaaagaatttaaatatagctatggaaatttaaagatacccatagtatgacatttagactatgttatcatgtcaaaaattgtcaactggcattataatatttttgagattggaatactattatttctctctttatttaaaaaaaagttctgaggtcaaagaaaatgtgcacaactgaaaatgttactctgatgacctgcaagggaggtcattaactaatgtatgtgtgtgtttgtgtgtgtgcgtagacatgtatacacatattctacttaaaggtttattgttaaaggagtctggttgtaggccatagctgtcccatacttcctgataaatcatttctatgattattttgtcattaaagcaaagccacagttatatagttgaccttgtgaagtaccctttggctatgaattcatggaaaattaaagatggagccagtttactgactgtaaaagtacgaaagtagtttaaaacaaatcattcaaagtattagtttcctcaccaatcaaaatagaagttacttcatccgtgtatttctctttctcaatatattttataacattttgaaaagagtgtgtgttgttggtcttcgtctcattttggtagtcatttcattttcttacaatgatgtatcccttctaagtgacttaacattgatgatgtacttttctagctagctcatgcatataaaacagtataaattatacaaatggattatttactgaaatagctattttataaaaattatcaatgtgatttcaaaaatctaacattgccagcatttattatggagagtgctggtatcccaccttagaatagcaatttatgttcctgcaaaagatttaaaggaattattctcaaactcagctgtccgtcagctttatctatggagtttttgaaaaatacgaaggcctgaatctgatcttagaatcagagtattctggaaggtgtcccaggtatcagtaattttaatacaaacaaagtcataatagaataataatactttttttttggaattcttaccacatgctaggaatgattttaaatatttaacatttatttatatatttaatttccataacaattctatttatgatgtaagtattctgattatccttattttaaagctgagaaaactgagacacagagaggttcaattttctgctcaaggtcacacagcaaataagccacggactagctttctggcccatgctcttcattcctatactctactgcttctctaagttttctacctttaaggagcatcagaatagctgaggagatagacaggtataacataattgaatgacacattgtgtagccactcaactatcaacagaaaatgaaatctgtattagttgaagcagaggaagaatgattcaaggagttgttggttattggtggaggccactagacagaaaaatgtgtgcccaatcttgaaactgagtttgttattatctaattgatataaagttatcacttgcagattatagatatgatgccaacagtcttgataagctgtttaagtgcatggctatataccaaccaaatgctgaattacaaatggggttgacaacaggaaaatattctgtgtgttttgctctttactgtctcccaggaatatgttggcacttgatttatatttcatctatgttaggatatttagttttgcatttagattgtttgtgagcattcatgttctaacttgttttctggatttaaatctcctggaaggtagtaactgagacatcatcatctttgcaattcatacaactctttatactataatcagtcatgagaaattatatgttgaaggtatgaacgaaaggagttttcatcagaaatcagtaaaaatgttatagtaatcataccttttgggcattttagtgttacagtgaagggtatttaagactaatgctagcgtacttttaaaagtcagtgctactcaaaatgccagcatatgacagataagtagctagcaccagaaagaaaatgatcaaggaagctgcaaagaaaaagaaatgcttctttcatcaagaaatcttactaagaaaaaaacgtcagctgagctacaaaaaagtgcttactgatgtagttgatgtacatctgacacaagttcctctcacacaccaacaacttgcagctgtgttttgagtagccagcctgcactttgagtggcactgctctagaatattttaaataataataaccaaataaattgctcattttcttttctaaagcaaaacctctaaaggagttttaacaattgccacattttgcctattcagtccatgtaactttgcctacctcttttcacctgtgggcactagaccactttgaaatattttactcttcttataggattaattaattagataccagtttgccagcagtttcattggatcataattagtaagaaaaagaggtgggaaaggaccatgcttattgataagtgtctggtcaaataaatcatggtgcatatgtataatggaatacaacagagctgataaaagagtgatgcagatctatatgtgttaaatgatatgttataaaatacagcataaatcaaaaaatatcattcatgtaaaacatgcacatatttgtgtttacctagacaatttctggaaggataccaaataaattgctaagagtggttgcttcagggaaaagtaccttagttacatggggacaggttgggagggagtgtcagttttcacgctttagtatttttgaattttgtcgcatatacacacattttccatttaaaaaatctctgctcagcttaatctcttctagtatctgcagcttctgagactgctactgcctactgagcagatccctatgggtcttttgatccttatattctcaaaacctaatgtcctggcacatcatggattctcagtaaatattaaatgagtgaatgactgcttagctttcctcttgctagtttctgctctcaggaagtgtcagagcctagaattttgcagtatattgaaaaaaagttgggaattagggctttaaaacgtgaattaaataaaaaatatgactctgagatgatgctacttaatttttaaggctcagcttcttcacacacacacacacaacaacaacaaaaaaaaacagcaagaaaagcagtatttacctcatagggttttagaagggaagaaatccatctgtctatctatctaatgttgcaaattctaaggaactataaaaatccacaatgccttgcatatagtaaatgccaaacaaatacttgttgaatagaactaaaccagtaaaaagatagtattacttgttgattgaaaagatagataatgtgtgtcttactatcaggaactccttaaccattctgaattgtcatgttaggtcattattgagttattcttttgtaagactggtatgaataggacagccagtttggggaatttgcctaatttatacctactgtgttcaaaattttatctttttcacattaagagaaattctattaaaataaaaatttatgaggtgttacacattaacctttcaacagttgacattttagtcagtactttagcagagattaggaggagtcctagtatgtgtttagcaacaatgaccaacagtagctcttctccacaaactgatgccccttaaagccttttacttatagatttttctgagaagtgctaactcctataataattaattaaatgtccaaacaattggtttccaattacctggtgataaaaaagaagaaaactttattctcagaaagatgtattgtcagatcatttttacaatcgctgccttaaagaacagaatgattcttggttgatcaaattgtgaagtggtgacttttgtagttcttattaggtattttattactctactgaagatatattgatttaactcacatgtatacctgactggggccactatgcaggatgcttttattttcctactttttcagctcaacatcatatttttttccagaactttcaaaccttatttcttagtcaaattgtctttttagtaactgtttcttgaatttatttagaaattcattctgttatatatcttactatattgtatattttacattttgaaaatcattatcctaattggtatgttaagtagatagcaatgcaaataacataatttaattttgaaaaaacatcatttctcttccaccgattttttcaaatacttattatagaatgaaaatttatgttggttttaactacagatcatgcttctctccagccaaagataatttgacagacgtctatcacaaaagaatagctcataattgctacaggttcaattacccttagttcctgtacttatttttttagctaaaattgcatatgtatcattcttaatattattagccaccctgtttttccaaagccaagaaattgaaatgttgtgaaattatgtgtttagcattttttatgtatatctacatactctagaaatagaattgctgtgttacatgatacactgcactgcatgtataattatggccaagtatttcattatttaagcaaatttgtatgtatttttatgtgtttttcctatagtacaaagatgaacacctgtggggaagagtgagaaagctaaaagttgtatattttaaaatactaagctcatagtaacacacgcatttgttatttcaaggattgctaaaaatgaatttcttgctgataacgtacaataggaaaagcgttccatgaaagagcatcattctactattagcaggttttcccttgactgtattccagagatatctttatttttcctttttgtatttacctaatggatatctaacaaatttcagtggatttaaaaacttgatatatttgctgaaagatcattttatgcttgttgacccatcttacctcattgtactgttgaaaaatacaggtatatttttccatccattctttgtttaaattcagttagaaacatgtaaatgtagaaaaaatgaatggtataaataaatgactttttaaatccaaagtgaaattcattatcttggttaagttcttttctgtgaaacattgtgttttgggtcttaatcaaggtcaatattccttgattccatgctatttcaacatacaatttaatatcacgttatttaaatatgcaatcactagcctgttttcataatttcataaaaatttcagtaggtctgctttttttactacatgtattcattttctattgctgccataacagattaccacaaacagtgaacaatttaaaacactcatttattatctcacagttctgtgggtcacaagtctgggcacagcaaggttcaactaccagcctcacaggctgaaatcaagttatcggctggtcttggctcttacttgaaaactctggggaagatccacttccaagctcattcctgttgttggaagaattcaaattctttgctctgataggactgaattattgatttctgtactggtcaatcagggccagtctgatcctaaaagctgcccttgtatctttgcatgtttctctgaggtcccctccaacaatggcaagttggttcctcccacagttgaaatttctctgacttctacagcatctctgtttgctcttaagggctcgtatgactagatagtgcccactgggaagaatccaggataatctctttattttaacgtctgtaaccttaattatatttacagtactcttttggccatggaatttacatatttacatgtttcagagattagggtatagacatcttcgtggggtcactctgcctactttgctgtgctttaaaattgtctttttccctacttcatgctaagaaattttcctttacaaatagttaagcttaacctgttggcagggggtagagggaggcagtacatagaccttatgaataaattccattctgtaatttaaatacgtgttttgtaattgaattttagttggaaattgattaagatcaaagatcacatatgagtgcttgaagctcaaaatctgtaaaaatgctgattggttcaggtctgtacataaacccaccattcttgttactgattatttttcaatttaaagccttatactaacaaacccattccacaaatttacttttgtgcctgtcattagacttttgctttactctttcatcaaatttatcaattttgtttttatgctgttgagatttaccactttgaactctggaaacaaattttgaatttcctaaggtcttctgtcattgtcatttgtgaagattccaaatatgattaataatttgcttcatggcttagtctgttttatattttatttatttgttatatcttatatccctgataagacttgaagatctttaagggcaaaggaagttccatctgttttttcagttgaatttaatttttatttttgaatacttctagaaactctagtgaaaatgaatctgttaattatttgttagaaaacctactaaaaatttatgttcaaaaagctctgttatatacagtatttgttttctcctacatctttcaattcggaactttattgttgttggttactatttattatcttcacataattccaattacaacatgtctaatttcattttgataattatgaaaattataatttaaatgttataacaccaaattggttcttgaagcatttaattcatttgtatattcatttgtatattgtcacttgtatatttcatttgtataattcatttgtatactgttattttcttttcagaaatgaactttagattgtagttaattgaatattttggtgtaagagtgagcacatttttagtgagattgttacaataacgttaatttagtaaatcaaatatattgaccatagaaatcattgtgttttaagattaacataccttatgccactttaattttactttaacatataactttatctgaaaataattaccttgttagaatataactaggctagagatgtttttgtttataagctgtatatcctgtgagttgtgtatcctttatacctaagatactgaagctcagggaaaatataatcacgtttcctgtaccaaatgttgtatttgaaggacattagacagagagagatttttcctatcatgcagtttatccattctcaagggccatgtgctagtgcttccgtttctgaccctcttaaaatgtgtgacttgatatagtatcagcaagggatacaagaaaaaaagaaagaaatatagaagaattcaggagtatattcacttacagatatggatcctgtgcaaaagggaaaatacgttgcagcatatttcactgtcagcactgtgatatgagtttcaaaatattatatatttgaagtatttttagcagcttttctttttcagttcccaattgctataattttattggtaaaaattattttccaggatggaaataatgaatgtaattttagtgtataacttgcaaaaatcatctcattttatatttagatcttgtttcaatgtatcagaaactaaatagggtagatttataacccaaatcttttccataacctgaagaattcagagtctcctgcctcttttatcataccaagcaaagtgatagttagggatagaaaccaagcaacatgtcttagtgtttgacttatactgaaaatcacagtaggctattggtgttatttgaaagaaacctagagatttacacatacgagctctctaacctatttctagctaacttattttcaaatggcacacataaatggtaaactctgatcagagaccagcaactcctgggtaactcagtatgttaaccattgcagtattctcacctgtgctgcagtctattgtttttactagttaaaatgtaaattttttggaatgattttgttaagtaagttatgctactagagattatttgtcaagtagagtctcatgtcacaattagttggagttggattcctaaggccatggcctaaggaagcagcctcttgaacgttgcagtctactgagttatgctaagcaggttctgggtacagagatgtgtcactttagagataagttattgtttactgtatatgttcaggtttcaaaagttgtgacaaaaataagatttcttactagaaattagcttcattgaaaatatatcagaaatgcatttagactgtaaacacagtttgttgagtacttcagctacatctccttcaagggaaagttgtcccacttaaactgccctcgttacgcttttgttagtaatctgggaggaaatgagagtcatgtatcttccatgtccttccttcaaaatcgccaagccagaaagaagtgaaaaatgtggtttttagacattgatacaagaaaatattaagtagaagaaacaaaataaagccaaagggataaacatcggaaggttgcttaaacggcttggtcccatataattgcttttctgtcagcaggattattaacagtttcagacatctgaaaattaaattaatagcctgaaaatattttacagaatgagatagagcatggtacatgaaacataatgaccccactgaaattcagccaagccagtgcagctactcatttagacagagtagacaactagttaatcatcactgagcaaattagacgagcaaattagtttgctacattccacagacttagctaccaaaaagagtatatgtcactaattagaatgaaagaactctaagcatattattatctatatagaaagagaaagcaagattgtagctttgaattgctcctttcaaagcttgaagcctaggttacgtaggtataaattacacatgcaagagtccatgtgtatgtatgtgtgttcatgcacataatttaagtagcaggcagcctttgcattttcttgcatcttgacctaataaagtctaaaaatgttttccaaagttgtttggaattctttgggagtatacacacaccaagtgaaacatggaaacatttttaaaaatatgattcctttaattgaagatcaaagtagccatttcatacactttttcttgcatcatattaaattattttttcttttaaaaagtgtattgctgttgcatgtgaaataaatatttggacttagtttatcactggagattaatctgaaatcatattttctagccttaattagcattcatttgcttaattgtcattctcagccccatcatttccatttttcactaacttgaacaatgctatcttctgctgtttgcactttaatttaaatttctattaaggtttatgaacagtaataaggtcctgtttgaatattcattagcttctgaattgtgagctatgaaaaggtgctttcttttaccttaatgaaactggcacagcatgggactgatcagttgtgacatttgatttgaggcatccagtgaattttctcattgtttattgacacatcttgtccaaacagctccctcgcaagtgagtggagtaatgaaggagagagtactgcagcggagtgtcgagctttcctggcaggaaccagagcatcccaatggagtcatcacagaatatgaaatcaagtattacgagaaagtaagtgctaagagcaactgaaatgtacaatgtgctgtgtgtctcatgtcatcctactgtattgtagactaaagttggtcattatgccaacaatttggagctacttcaaacttcgtagttaattttagccatttataataaccatctctgtgaatctctggcttatcattataaatgtgatttctgtgtattaagtttctgtgttacacaaatgaaagtatcccatttgtagcatatatatttatttatttattcaatttctgatattgtagtaattagatgtaggatattttagtaccacagaaaccacacagcccaatgcattttgaaaaatattttctttagtatgtctgtttgggaccttaatggtttgtttaatttatgtggtttcagtgatgataatgacctcaaataatttaataatttgaaataataagaatattttgtataataaatatgtagttcttcagacttacaaatcagatgatgttatttcactcctttaaattcctcctgaaatttattttatatatgttttaataatcatgtatgggacttatttacacctctccttccaggaaaaatattatggctttttagcacccaagtgctgcctttttaatccacctataatgactaaattttagtaactagcgatacatctgagtatatgagtatatttatttctgtttcatttggaaagagagagaaaatgtttatgtgagccatgttcacagatcgtgatttaaaaccccacctcacagacagactcagtgcaaggtttgaaacgtggaaaccattgctattaccaacagtaacagtaataagtgttactatttttggcttacctgagttacctgaagtgctataatacacataaccattttaactgtttagacaatagaattagaaaataggagcttaaagctttgagaaaactttggggatgaatggacatgattaaataaattgaaatgtatatagtacattggcaatagatacctttgtttttttaaagaaaaattagtttaaaatatgattttgttttaatgttcagattaagtttaaaatatttttgcttgttacttacattatgaattcatgacttcatggctaaggttgcattttatatgcttcatttatcgtcccaacaaatgtgttttagaggggattattgtttttaatgctggttttggtatatctgttttcccatgagagctatcagttatattctctgcttaaattgcatccaatttcaaaagcaatgaaacacataggtggtaagagtaaagtttcttacaatataaatctgaaatattttgcaaatattttctctagaataaatatgttcaaatcattttttggccttacagaaatctacattcactaaatttgcatattaggcaactaaaagacaataataatattgtattgtattatattgtaatgtatatgcacgcatgcgtgatgtttgtgtcacctgagttatgcctaggtctttcgtttgagataaatacatgtaatacaaactatcatttttataaatgattataatgaggacaatcacagatcagtttgagtgaatcaagcttaagtatatatttatttacacttttgcaaatctcactgtgaaggcaaatcaaacaacttgattgacattttaagatttcaatgaagaatttcattgccagataaagttgaacacatgtatttattatacaccaaataagaactctctaatattgtatattatgaagtataatttttacaacttttattcataaatagcttgtgagaatcatatcaaggaagatttaaatttttatttatttaaatattgttttgatggagtttttatatgcttgagtttttacatttattcccttcttaatcttactatatatgcacataaaatatgtttgataatgataggataaaaattgttaataagcatataattgattttagtaaatttgcattagcttttatatctgaaatatgaacaaaatgaaataaatcatgtttaaaatattttcaaaccataaatcatatatatttaaactttaatatttataattttactttaaaaatatttcattaaactgttttgcagaagtggtttattctgtgagaaattcagggttgttttaaaaaaattggtatgtcagtatagtagtagtgttatctgaatttcttgatttaataactttctggatttttagcatctggctttttttcttgctgaataactttcagaaaaaacttaagagaactacattatgatttgatgacctctactaaactgtagattgtacaggtgtacccactgtttgaccaataggatattttattatattatggctaaatagttcttgtcacatattacttctgcgaaagctaaaaacaccataaatgttttaactaaattatttcgccctaaatatatataacaaaggcatgtgtttcacattttcattttatattaccttagaagtgatttaactttataatattccacaaagtacaatgtagcctctataaaaacaatggagcaaattgaattaaattgaaacagttggctgtcaaattgtctggttgcaatcacaattaaatatttcctctaaatattgtttctaggatcaaagggaacggacctactcaacagtaaaaaccaagtctacttcagcctccattaataatctgaaaccaggaacagtgtatgttttccagattcgggcttttactgctgctggttatggaaattacagtcccagacttgatgttgctacactagaggaagctacaggtaaaatgtttgaaggtaattatgcctttggtttggattcctactctcaataactctagcatatattaatatttttttcaatattgaggtgatcatttgcaccatcataatttttacatttacaaataaatatatatgtacatataaatgtactttgtaaaagttcataataatttaacatttgctgttttgtttagcaattttagaaccttgtgatttaaattagtttctttaacgcatacaagatttattttttgaaaaaggtgaaattagaaacagaagcaggactgattcaatttgtgtattgacacaagatgtgtttgtcgacctcgaaacaatcttattctaagtgtgtccatcaaagcagctacttcacagaaacccacaaatgaagccagaatgtgtagtgaggtggacaagagaaagatggtatctaagaacctgtattaatttaagtgaattgccctttagcaatgatttcaaaaattagagttcaggaaggtcttagaacttgtttttatttttgtttttgacatttttcatttttgttatggaatatttcatgcatactaaggaatctatttaaagtagatatgaaatataagggagataattaaatgaatatccctatgaccactcatcttaaaaatagaatataaccagtatctttgaagcccctttatcattttatgttttacaatgcaacaagattatagtaaaaatgcatgtgtatatatagtgtataagaagtaagcagatatatcttgggatggatgtccccatttgctgtcagagtccaagttcagaacaccctgaataccactgctgttgctcctcaacagagctgatgtctcagtacatgtttctatattttggagttttgattcctcctgatgttactgctcaggcacatggtttacccaggtgttatctcttctccttgccaatccagccttcctccaaaattctaatcaaaattaagttggaaaatattatatgacttttctcaattaaaaatatttaaacaaattaaattaatattttgattaaagaattattttggctttaaaggaagaattgtatagatcttcaaaaggtggagtaaattgataaatatcctttgcattaactaatgtttgtaaagtttgctagcagtattattcttccacatattttgttacactttaaaataaatctgtaactcttatagccacaaataataaaaacgtatgctgaaatcattttgacatataaatcattcacatagagttgtaaacataaaggcatcagtttaaaaatttactacataatttgatgtggtaaacttaataccattattcatgattattctttttaaatagattatataagatcaagaatcagcatatcaaagtttagtgtcccccaaaacattaaagcattttaagttaagatttcaacatttaaacatttgagtggttagtgttaaaatgtgctctagtaattttcaactcagatctatatcataatatcaccctgtaaattcagatataataagatacttcaaattatgtttttcatcttttaataaatagtttaaacttaaaatgtcagttatctcacatttacccaaccattccttattatttaaaaacacttttagatttcaaaagtttcaagatgaatttatgccttttcctgactttgtaaattgagaatattaaaccaaactatcatttaatgtgtgctgagattcatagatatcatttttattatttaaaaaagaagtaaccaagactcagagattaaagtagtggaacctgaaagatcacatgaaatgtatgttaagaatggatttttgcattagaatttagtgatttttactatcaatatattctctcctactggaatgtcaagttgatgaaagaagaatccatatgtctttttcttactgttgtcttgccagtgcctactatggtttcaggcacagaaggcactcagtaaactagcaataaatgaatacttcacactgatcaacatagagtgaattattaatatcaatcagtatcagtagagagctgcctggtttcaaatctctctgctctgccatgtccggttataggagtttggatgagctgggtctctgtaccctaatttctagtatagtagtactcaattcacaaaacattctgaggtttaagttaaatatacaaaatgtcaaggagagcccctatcatggaaagtcttaagtgtcagctgttattaaacacagcctttctcaaaattttccatcccaggagcccttttactattaaaaaatgttggggatatcaaaaaatgttttatattggttatatcaattaatattcaccaaattagaaattaaaatggaaactttaaaaacacaagaacacacaaacattttattagccatcagagtcatagtattatcatgtcatataccttctgaaaatcttaactgcattcataagcaagtgagagtaaaaaagtcaaataacatcttcatattatatgaaaatgactttgaacttgcagactctatgaaaagttcttgaggactctcagagttttccagactactctttgtgaaccagtgagtcagcataaggtactatgctaagaattaaggaggcacagaaacacacagttcatgatctttattaaaagttcagtgaaagacagggacaggtacacagattctggccacacaattaagcagtggtggaatgcatggtccagtgatatcaccatgtcagggagcagtgacttgctgtgccagaaagcaggtcagaaggtaagatgcagcctaaaagaagtcacttgagcactgtttgtaaagagaaatttgacagtctcttccattgcacatacatcctaaaatccccttctgtgcagtatcctatctactgtttcgagtttttaaaccatgacattctgtttatagccttagcaaattacttttaatatgtattgccctgaaatagatgaaaatattaaccataatgtcaactatggaaagattaaagtacgaccctgacaatatacaaaaatgtataaataaatatgcacaaattctgattcatcattcacctgagttcatttttctcattagagttctctttctgaagctaagggaaaaactgagcctaagacaagcagagaattaggcccatgggacacatcggttgaatggaaagaatttcataacatatgtacataattttttcttcctcatgactggaactactccattctttttctttcttaaaatgtacattaaaaaacagactaaaaacaaaaaataagcaaatttttaaaagacttgaagtcatcttttctctgttgtgtgataataggctgtaattcagaaattagtatttgaaagttgttttcttcttctgtttttttaacctttttaagttccctcagggagcaattcagcaggtgataaattagagaatgtgtataatcttctttgttcagaaagtatctattagaccagagcgatttttcctgtttttcaacacaggagctatctcttgttagcataggtatacaaaattaagagataagttgtcaaaaggagacagacaaactagagaaaggccaatctgaaaaaaactttatacttcctattgtggcaagatatgttttgccttcatatgaattacttctctagagatctagtcccttgccatcaacaagaaggaatggtatttcccatcctgccttaaattaaagattgcagctcttgattgtttcagagatagcaaattatattagtttgacattatgtattttatgatatttgcaactggatcatttattggaatattcattttcattgtttcatatgtccttgatgattttataaagtctgtattgctactgaaaatatgaaactctgggaaaatatgacaattgtgaatcatcatataaataaaacttcactagtttggaaaaatggaagtgataagtgcaaaaattctatatcagaaggtgttttaaaagacatgcaaacatgtacttcttcccaaagagactgtcagaaaagttcagccaggtttgccttaatgagcatagaagaattatttagtattgtataggaagggtttgcagttaggtaatgatagtgttttttaaagcacttgcagaaagtttgctttttctaaaataggctagctactttgtaatcttaaaatatgaaatgtgtttactcatacttcatgaaaattaacacagacaatgtggctcatctttttcctgaattatagtggactataaatttatgatgtttatgattacatgatgctttccattttaattgatgatatgagagataaagcatttaatgtgtgttaaggtacttcaaaaatacatgaggtatgtattttggttctgatttcacataccaaaaaacaagacacaaagggatcaaaatcaaatgccttgctgaggaacaatagggatttaatagcacatgcagatcagatgtgtctatctcttgatttataactaagctttcaacaactaagcaggaatataatcattcaataaggcatttatacgttcttttgtagctgataaatggaaaatatgtgaaagtattgtccttacaagttctttaaaaggcagaaataaacatttatttaaatttactttgttacaatataatgcagttatttaaaattataaagaattaaatagaaaagataactctaattttatttaacctttcaagttcttgcatggtgtcaagtatttctgagcctatttcctctgtttacagctacagctgtctccagtgaacagaatcctgttattatcattgctgtggttgctgtagctgggaccatcattttggtgttcatggtctttggcttcatcattgggagaaggtagaacacaaagttgttctaatctctaacataaaatgtattgttttttaagaattatgtcagcctattacttagtgtaataaaattttaaatagtaaatgcaaacattctttgatataaaacattaaaggtcaataatgtgtcattccttcaagatcaaaatggaatatgagtttgatcactgcctttcatttaaagagaatgagtattgcagtttttattgggtgaatatttttgcttattttcagagttaagttttcataataaatatagaatatacctggggaaatgtttactcttttagctattaaatgtttgtggacaccatttaaaaagtttttcttttccagaaagaaatataagtaaacattcacctgtgactatttgtgactcatgaatatttttgtaaattgaaccttgtggattcaaatcatactgaattttgtgtattcaatctaaatgtattttttaaaatgttccttttacattttctcacacaaaaagtttgttttctttgcaattttaatcgtgaatcgctatattattactaaatggattcataactatgaacagtaaatttaactctagtaagttgttgagtaactaaggtacattgtactgaatattaaatatataaagtaaaatgactgagattgtcacaaatttgctttcttcaaggcactgtggttatagcaaagctgaccaagaaggcgatgaagagctttactttcattgtaagtgtttggcttttctttattatgatgtacccctattaacagaaaaatctggttattagcattggcattaacaaagtcctcatgcatcatgcttgaaattataccatgagctcaaaatgttgctttaaagcatttgaatcagatgtttagaattaaaatcatgtgatgtgaatttgaaaaaataaaatatgttcagaaatgtcatataattgcaggatattcagctgcttttacatcacaatgtttcattttgcaaactttgcccaagtgtttcttaccatcctaataataatacattaaaggttgcatgtgccccttctctagctaaggaatgtcatgtcaggttacaaagataggcccttttttaatccaatgagtgatgctaccacaaaaggctaaattaaggagcctctttctcttcagctactataaattacctatcattgatagatatttcataggacataaatagtataataataagattcatacttctgatgttttcctatggatttgagttagcttattcttaaaagttcattttagaaatcatatttagaagaaagcttagggacccaaataaaatagatgcctatctgcattaatcttattcttgttgcaatgaaacaagatggcatgtgaaaatgagagcactgagagtaactgttattactttatgtaggcaaaatcaaaacctaacaaccaaattacttcagttatgatagttgatgatgttcttacctttacctattttccccatttttaatccttaagaatattaaaaaccaattttattattattttgtagtacccataatctttggcaaatgttctcatgtgtagataaatttcccatgacataagatgtaagaattgtatcttttgttgtgttatttattagattcttatgtcaatatctgtgaagatactgtcctatacccatcctaaagtcataagaatatcaaagcctccatcaagaatttctaatacattttagattttctttgtgatactttttttttaataaaaaagctcaaatgacaatgtgtggtttaaatacacaaattgtaaatgctcttatcattcctaaattttctcaatgtgtttgtatttttgaaccaacagttacctttagttttcaaaacagaagtgcttttatgtaacacaaatccaaattgaataagaaattctcttgaatctcaacctctgatgataggaagggcatgtggggtagtacaatttactacaaattgaagttaaatgtatgcccggaagtggctttattataaagtttaatattcaaggcctcttactttcacaggccttttttaggccctgggagtgctgtagcaaatttatgtatataatcatgtattctttcccctaaaaaaagtatcccaaactgtatatggggtaagcctcaaaaaacttaatatacccctgaatatgactgaatatgtgtgtttctataccccacttgggattatttgatatgcccccaatgtcagaacttccttttgctaatctggcattaattttcctgcgacaagcctcagtgaagagagaaccataggtagtttatagctagaggaaatagagaaaaaagtggaggttacctttttttgtttctatttaataacatgtgagaatatttttaacacttccccagacaggaaggagcagatcaaaacttgaatgcctaaattttatttctagtgtagaatgtatatagaagagtaatataagactgtagttcctgaaatccctggtcctgcccatatgtgaacaatttaatggcacaattatttaatattaccataatcagtatgtcacttttcttttatttattgagcatatttgaaatatcccccagtgatcacatacaccagtttatttacttttaacttgcaggttaatgcagaaggtcagttgaaacatggcttatccaaaatttgttgtatagccttatgcttaattgtcatcagtcagttttaatatttttatgccattcacttttttcacatttcacatccagtttgtaattagaaaatatatagttgcatgccttacttgctaatatagacaagataaacttgctgtatataaagttttcatcattagagaaaactagcaatggtggttttaagatattgaaatttcatgagaaatcaaaataatattttaaaatacaaaagttcatactcaagttgggataaaccagaatattcagaaataatgtcagtattttccttattttaaaacattcatttttaaatgaataatgaaaaaagtgcacttaacatatcctatcctggtaaattcttaatattttgagtcaccctttttccaaggatatgttttcttgtcatttgattaaaaccaggtattttatttgattttatgattacttaatatagaaagtataatactgtggtaaccagctgtttacaagttgctgtctttttattcctctatttagtacatggacaattttcccaggtgctagaacaccagattgaatttttacagaaacttgaaagcaaccatttaactagcttttagagcactgaatttaatagaatgtccagtcatttgtatcaggcaccctcaacttttcatggccccaagtgctacatttaaagatataaacacaatggaggaatttagtgaagcaattcgaatttacattttgtttcctcctaccatttcttctaacaatgtcttcaaatccaagctgggcagtatttcatgtttttatgccaaaaaaagctctggtctgtcaaaatgttttatgacagcttgaataaagaaccatcagagaccgtttgagatgcagaaggttacctccaatctagctcccttatcaaaacaaaattttaaaaaaatgaaagaaagagagaataaaaagggagaagatggctcattctccatctgcctgccaatctaggaggttaacctattgttttcttcccttctctctttttctcttccccttttccctatactccttcttctctcttttctccttctatcccctctctcttttcttctcgtgttgttttttttttcatcttcagctttagtaacaaatgagcatctgtcagttttataaactgcaacaataattgtttaagacaatcaattttggataaacaatcaactacagcagaataaatcaagatttttaaatcccattttcctttatacattttgcttctttttgttatgtgtttacttttaaaatatagttttaatgtgatgacataagcacagttaggctgcagtgtaatatataaagaaatatattgttctccaaatagtaagatttgatgaaaagattgttcagtggctttgttaaaacaataaagtttttttgaggatatagtgtaatttttattgcattaatataaccaaatatatgcctatctatcttatctttgtcttttaccaaatagatttggaatacattattgtaattgaattttatttaaagttgacatagtattatctgttacctgcatgcttctgggtgcattttaagaagattttaacttttaagattattctatgttgtttgcattttgactaccttttgtgaggcatattggctacctcctcagcagttaagatcttccagagccttataattgaaagttcatataaaccattcctctttcaaatcgctgtcatacttggttaacagatcccaggaatattgtaaattttctaactttactctgcattttgtatatctggcctctattgcccttgaaggtgaagatgaaactgtctttagaagatatctctttgattctgtgatagaagtccctcacatcttgtattaattttatgtatatatcaacggtggttggtctttaaaaaaataaatcaaaagaataagtaagatgtctaaatgtttttaatattgctgtcagtgtagtaggctacctgtaaatgaaatgtcttcttttcccagtgtattaatttgattgattgactgactggtagatttacaaatgtgtttccaagtccattacaaaccttaatatggcttgaactatgccatgatagcagtgaatttaattaaacctccagtctgataggcatgtcagaaattttggtgaatgtcttttgttgatttactggaaaagcaattcagttagtaacctatgagctggatcctatgttacctatagaagcttgcagataatacctatacgccagcagactgaagtagtctgttaaaactgctgtgaatcaggtgatgtggaagcaagttcactgttccaaggagcactctgcataatgaaattcctgggctgactgcacaataagtgctttgcttcatcacagtcatgctttcttacatcattacagttaaatttccaggcaccaaaacctacattgaccctgaaacctatgaggacccaaatagagctgtccatcaattcgccaaggagctagatgcctcctgtattaaaattgagcgtgtgattggtgcaggtaaggctattgtagcttcctcgttcagctgttccatttagccaagatcgaaagtcatacatcataatgacaggcaaataattatccctcaagtatagaacttttgcatttacctgaactgttggaagcagtgaggctgtacttgtttatgaaatcttatgaaaaaatgtgaaaaactagcatgtggcacaaagaatccatatatttttggttttctgttggatttttaagatattgttctactacaagctactttataatagctctggcctgtcatttaagaaatgaatttgtatttttaaaaggtcagaaatttccagaattttgctgcacatttccttttacttgatttactgtcttcttacaaaactttcatttttatcttttctcttgtatttgtaggtattagccattgtactttaaattcatgtagaaaattaatgtgtatgaattaaagggaatattttctatatgtatgtatttttatactaattatacatttctgattctaattcctttaaatccagtagacatagtgcatataaattccagattttaaatatttaataaatattttcttctcaaaattaaaaggaatagcaatgtttagaatttgctgatgtgtcctcatgctttagtaggtagtctaggtaatatactaatataatatatataaaaaaatttttaaatatataatatataatagcataattcaaatctaaatgttgaccctgagtgttggttaattcaattgaaaaatagtagcctgtttaacagtttaggaaagcgtaacttctatgaaagagctctgaactgtatcttcaagttttaatttcatttatgccattattttcataaacaacttttgtgtctaggaaatagactcccctatatatgggaatgtattcaatgtaactcacagggctttaccaagtatttttgaaaatattttaaaatgctttcaaataatttactaaaagttaaagaaaaataattcaacgcatttactcttaaaagaaaattacaatatttagaaactaaaatatgcctgcttgttctgttacttcaggagaattcggtgaagtctgcagtggccgtttgaaacttccagggaaaagagatgttgcagtagccataaaaaccctgaaagttggttacacagaaaaacaaaggagagactttttgtgtgaagcaagcatcatggggcagtttgaccacccgaatgttgtccatttggaaggggttgttacaagaggtagatattggttatatctttattttatcaaaaagactgagtgtcagaaattagtattattatgtacacaataaaacaaattatgaaatatgttgcacagtctaaatgaatgtgttttcttggtatgtaactaatcaaaaaattcttcctttatgttatcacctcaagggaaaagaaagcagaaaaaaaatgaatgcaagattagagttgaagaataactctgatagatggaatgactgataaatgtttttatttctcttcaagagacataataattatgcaatatagtctttacattttacataaagtgtaattttctctgagttttactcacaaagcaggagtcagaagaacacagtgacttttatttatatggtttaattttatgaatcatgaccatcttccaagcagacatataatgactttttgagcttagcagcaacaataaaagaaatgctcatacttctcacactcactctttcaaaagaacaccatgtattttattgggggatgagaaaggaaatgaccctccagctcaggttacgactcctgaaactttttttttttaattttagggaaaccagtcatgatagtaatagagttcatggaaaatggagccctagatgcatttctcagggtaagtaccaaagtgatccacttattctaaatatactatgcttgctaccaatataattttatgaactttttttgcaatgtaaaatgagagccttgtaaaatagtaagaggttagaagattgtctttgaaaatcagattaataatcagagttcaagactagattaaactagaatattttgagcattgaagtaatacaatgtggtcaagaagttatttccattaatattattacctgaggtatggaggatgcccgaagccctgtaatttgaattcatgttataaaacagtatatacaattgtaaatgaaatatagagataatatggaaaagactaaaaggtgagataaccattctgtgttgacactatgatcacaactctgctctgtagaaccatttctattttattgttaggtgaacaccaagcataaaatgtatgactattaacattatttttcaaattaatggtatgtggtttatttgtaaatgacatataaatccagaatatataaacatagatatttttattctcagaggctttttaactaagaatattaacatgtgaacatttttccaaatggcaaagaaaaaataatctaaagaaaaagagaacatgcaaagttatttaatatgatctagaatcatatttaactcaggcgtataaacagtcataggatttagagaaacttttattgctgcatcatcatgataaaagtatcaactagaaaattaatcaactcagactagcatacttcatccagcatgtttatattcagctggagtaattttttggttaaaatgggttggaagtggccagtctggttgcaaacagttctcaatcccatttgctagtacatctgtcctagagaatccttgttacaagtaatgctcctatcagtagcaaaactaagaaaaaatgaaatggaaacaaagtggccactacaattactttctacattttagtttctcttcattttgcctcaaatatttcccccgttgctcttttttagcatttagaggaaaataaaccttattatatgtatattaatttctttatatacttttatattatttagactttttggcatgtggggaaaacacttagctattgggggtaattttttagatactctatttccaaacttaaaaattagcatatacttttggacttgtgcaaactcaaactgttattagttcattttaaaatatcaaattagtataaataactaaatgattaccaaaattatcttatttggctgtcagctaaataagcatgttatttttttccacaggtatccatattatataaaaaattaacaattcctattatacaatagcaaattgctagcacgcagatatttttcatggtgatttttgtcccttttaaagtatgcagttaactgggcttttatttttgtcttcctgcagaaacatgatgggcaatttacagtcattcagttagtaggaatgctgagaggaattgctgctggaatgagatatttggctgatatgggatatgttcacagggaccttgcagctcgcaatattcttgtcaacagcaatctcgtttgtaaagtgtcagattttggcctgtcccgagttatagaggatgatccagaagctgtctatacaactactgtaagaaaaagtcatttactgcacttcttcatattcttaagatttttctaccacgaaagcaggacctaataatgtaaaactaaacaggagaaatgaagcaaattgagctaagcattttgaggttgctttttttgttttttgttttttgtttttctggaagaatcattgtttgtacaatatatatatagactaagaaggaaagtgttgataacatgactgccctatattgggagagtcatagaatatagttacgtacaaaaacatctagctactagcactcatatttgtagaaaactgtaatcacattttaaataaagatttaaaggaatattaactatgctaatccttataacttttgtaagattagaaaaaaagaaaatatgtgagaatgtatttaaattatccatattttatttcattttcatagtaactttgcctagtttgtctttgttgtggctgttgttgttgttgttgttgttgagatggagttttgttcttgttgtccaggctggagtgcaatggcacaatcttggctcactgcagcttccgcctcccgggttcaagcaatgctcctgcctcagccttccgagtagctaggataacaggcgcccaccaccacgcacggataattttttttgtatttttagtagagacgggtttacaccatgtttgccaggctgatcttgaactcctggcctcaggtgatccacccacttcggcctcccaaagtgctgggattacagatgtgagccacagcacccagcctgtcattgtttgttcaatatactcttgccctaacaccacacaaatctcaatcagttgagttgccttgtaaacttgaaatgatgaaacttgtaatggtattctaaaaatcagataaataactttaaatacgcatagagattcaagatgggtagacctgatgctgctgaactaccaaccaaaaatgcacatatgtatttatggtattgccataaataatatatcagttattatacatatttaaaatgttcatttctttttataacagggtggaaaaattccagtaaggtggacagcacccgaagccatccagtaccggaaattcacatcagccagtgatgtatggagctatggaatagtcatgtgggaagttatgtcttatggagaaagaccttattgggacatgtcaaatcaagatgtaggtgttacattcatttaaacaaaaaggattgaatacattaatagccagtattactggaacatgtaggtaaaggctcattaagaacacttttaaataattataaaaatacagttttccacaattactaccacactaattaccataaattagtggttctactaattttattattttagctttcattttgaataatcactttctctttttataatataaattctatggacacaaaatagaagcttactaatgatatttcctccttaataaagataatgtttccacacttgcacagctggagtgggagcatcacatgagtaaaagaatcatttgtgaagaggagggaaggaagtttggttgtgctttgttttgtctttgaagcttatctttttcttttagtgttctaagaaaattctttaaattatctactgttgattggtttaagttttagtttcatgggacaatctagattttatgatcaatattagtaaatgtttcatagtgatattttagaatgtaatcacaataagaatatctttggaaattccttttaaaagtatatttattaaatgtacataccctgttgccatgaggacatgctaaaacataaaacatactgttttccgttgagaaaagaaactgatggtagtccatgtgagcgtgtatacatctcacaccaagagaccacttataaaacaatatagcaaaagtgcaaaaaaaaagttgcttttattaggttgagtttgttaaaatggccattttgtaggccaagagcacttatagttcaacctattgaaatatgagtgaaaattagataaatgtagagccagtatgaaatctaggaagatatccaggattgtactaaaaatctggtggataccttggttcagagctgatgagccaattctctaaggaagcacactggaaagttgagaagttaaggtttagaggtgtatgaagaccgatcaaatggactcacttttctataacagagatgtagtacacttgtggtaattagaaatgaagatgtaggtttggacaaattgatgaaggagttttcagaggagtctggaaatgatactaatgcaaattcttggagtgtggagtcaaaaaaataagtagtgtttaaggaaaatctacattgggtcttaaaacttacagtagtgatttttagacaactacaattagactgttttatatgttgttgataaggttatttttgatacttgccctacaaattttttcattaactgagaagtccacagtctgaaaagaggaaggttataaatcagttatatctattgatattttgaattggatgatgacataaaactttttcatttgctttttgttttgtttttgtttttcaaagataaaagtctaaatgatgagtctgtttggcagaggcaaagttgttaatatttgacaggtctcagtgtcaaagatttcatggactgtcaaaatttggacaaacaaatccttagggcagagaaagagaaatatttacattccctagacactccatggagtttcatttcttttgacaccttccttctgtattggattcaaacataaagggactgacaggactgacaaattcagagttcacttaacttccaaaaacaaataatggaaatggttaagaagaaaaaaattaatatctccaattttaaattttaaaatgtgttaagtattgttttttgtttttcttaaaaatgaacattatgaatatagccttactataccaaggattaatattttattagtcaaatgacataattatgtctattgtgcagtttagttttaacctaaaatatttggcacattctttaatttttttatttagaaggtctaaaataattaataaatttggtcacaggtttgtttagcagtgagagattacctagataggtcagtttgtacagtgaaattgatattcatattcttcttattagataatattcattattttataattatgtcagtagagtgctatttgaacaattatatgtttaattttcaatatgcaaatggagaaaaattagataatttaggataatgatttccattctgggataaaattttctagataaaagcttttttctaggaatctgtggtaggagttcatggagagacttagatctatgaacccctgtgaacccctgatacatgtggaaactgctgtgtatgtgtgaatatattattttttttctgggaaggttgccttcctcagattttcagatgtattcattgtcttttaattagcctagatggatttatcaagtgaaccaattaactctacattattaaaatttagttgctaggaatttgtcagggattttagaaagccctcaaattttaaatgcctcagattttaaaagattttttacaagacacaagaaaacaagatgtacagtgatggttacatttctaagcaagtccacacagttccaggctgaatgctggataaggtgaggtttttgtaacctgaagagacacaaaagggtggtgtagaagaagctaatgagtgagaaagttctggactatctgaacagtttgtgtaactctggacaaggcaatgaacaagaaaaacctagggaaaactaatatacctatacatgaccagactcatactcaaataggttatccattagttaacccttgaatgggcactcatttgtatttttatgtgtctattattttcttaagttttaactacaatggaaacagtcggattcagttagttgcaattaaaaccaagaggttgagctttccaaataaatttccaactttcgttcttctaaaaaatctgcaaacatttagctctttccattaatgacttttcaaagaaaaatcttcatgtatgtaaatgtagtcaaatataagaaatattgtggaaattgaaaatatccttttggttttcacagcagccatcttttaactgaattttatatcttgattcatccaaatcaactttttaccctcaaattatgaaattttgaagttttttactatatagattttttttcttctagcagtatttttcttacattagtattttaatgtattgtaatataagaaaaaatactactagcataaaaagaataaaatctatatagtaaattagtatcctaatagttaacataagaaaaaagtatttttaaaaaaataacgtaagaaagtatttttttcttatataaaactaggccagtaaattgttaattttcctagtaggtagatattaggatgttaaaaaatttaagcttttttaaagatatgagacataaagataattccttaaagccatataagaaaagtcatttaagggcttggaaaatataatatattcataagtaaatgtattctcagctaaattgtgagacctcattttccttttaaaagtcatcactgatttatgactttatattttttcatgttaatatagaagcaaaattatgatgttgttttatgtaaaactttgccaaaatctcataagtgaagtccaacatatttaattgcataaaatgtgggtcatgttattgtgaggttaatgaaatagaaaatgagtattgagcagaggacagaagccaatcatgtcatatgccattttgagttattacaggctcgttaatggggtcttactgtgttcctttttctcttaattacaatggtcatactgtaataatatggaaacacttctcagtaagtaacttttgtttttatttctaagtattgctttacagcatttgccaaagaagtggtccctgttgtgtcccagagatcttttttaaaattacatttacccaaatcacttctggttcctctgggaactatttagatatagaattggttatgaatgaattttattagaatactaaggcaaatacaaggagtttctagtaatttcacaagaatatgtttcagatgaattcagtgaaccaattacataatcctctaagaagtggagggccagctatcttacctctgtgcattgtttttccaagaatatctaactatatgaagaatgtacctattttttcattggaaaaataatgccattcttaacagcacaggctctggtctgtggcctacgtcaaattctgtcttttctactaacagctacctgatactgactggccctctcttttttttcctgtgcgccacacattctttatctctagaatcagtataataatgatacttaaacctaataaggtttttgtaagaatcaaataagataattcaagtttaaaaccatgccaatcatataataagcacttaataaatattaacaatgattattagttgcatatttaacaagaaaattgttttactgctaggctaataaatgaaaactgcagaacctcaaagttcagtttttgcctcaattagctcctattggctggttttgtttcaaagggtgtatcttggattatgccaaactgctctataaggtcgaagagttcccagcaagtaccttaagtgttcatgtccatagggatgtgactattaatgagattattaaagtcccaatatctcttattttaaatgttatatcttgttgttattcctttaaaaatgtataaaacattatatctttgaatatagctaggagtttcactttgaagtgagatcagtgttgtttctctacaataacaaaaggaatcattaaatttctgtaatgcagtaggacaactacagaggttcattaacttatttttctaataatcatttaatggtcctatgttcagtgctacaaaaacttaagaatatattgtgttgaaagctaaagaatcaataattttaagtgttattctgaaagcttgaagtgctattgaaaagtattatgtcaagagggcatgataagatttagatttacattttaaaacattatttggagggaaagaaaaaaggaaagatcactcgacttacattgttcctttcaggacacctgaagataagctataagcagggaaataggttaggaggtggtgggaaataatgaggactgaattaatgttatgagcattagaatgcagtcatgtcaaatcagaaatagactgtatgtgtttaaatagaagcagcctcaaagacaaaaagccgctcattttccaatgaaaaaaatacccccaattgcttattgtgtggtcattttgaatatataaaatttcagaagttattagtttatttattcccagcttgatctgctatttaaatcacttaacccaactttctaaaagtaaattacttttacttttattcacattttttaacatagcatttttgaatccaagtacagtgctattactggaatgttttgcaaaaccactgaaattcttagcatttaaaatgttttttaaaaaatataatttctcctgtacttatatatttgtgatccttgcagagttaccatttgtatgtatttgtttgatgtatagcttttaaaagggatattttagaggaatatttacagtgatatgcaacatttgtaattacgggatcataaaaggaaatttttaagttctgtcatatgacctccattgcatttagtaccaacactgattaaggtcacttaaggccaaggtgttttctccataattgttgttcaaaataaaatacttaaagaaacacctcagtgtgaaactttgtaaagacttaactatgagataatcactccatcacttcagggatatgtatatatagagagagatatataaatgtagatatagatatggaaaaatactttttctagtatttgagcatatattgtatttgggaagtagaaaatcatcagaaagtggtgactaattgtgtatataagaggatgtgaggcaggaggatcaggatgtgaggccctggagttcaaggctgcagtgagctgtgatcgtgccactgcactcctggatgacagagcctggatacagagcaagactccgttttttgttgttgttgtttgtttgtttgtttgtttgtttttaaaaagagagagagggagaatgaaagaacctgggacagttttcagctttctgactgggactggatgtgccgttagttgaaatagtaaaggattgggaagagaggtgataaattcaattttaaatatatacaggggaggtacctatggacaattcagatgaaaagtttaataaactgatagaaatacaacctagtgattaggagagagtttggtcttaaattttatacttatataaattttcaaaaattactataactaagtccatctatttactttttaaactttagagttagagatttttcttaaagaaaaaagtatacttttttcccttatacaaaagaattttttttcaaatattgttgatgccaagtactgtactcattacatcctatcctacaaccttttatattttaaggtgctatttttgaatgtcagcatgcatcttaaggatgtgtttccctaaaaatattaagaccatcaacatttcttaaagccagctttttgtttgcctacttttggccttattttctttgaaaattcaaagattttttttttcctcagagggtcattttttgttacatttctaccattatatcagtcagtgtcaaaggatttgttcttccccctcgaatgctgttttagtgttctccgatcccttcttatttctgctgtttgtcttcttgttctcttccctttgctgctcagatttggaacattttcaggtttttaagatctatttttgcctttcatataaataaaaaacccaagtctgaatgataatttttctgattgctacatacaaatgtttataggggcctatttttcactaacattcaaagcttcatataaacagttttttaggctattggatataatattagatatgcctattaggcagtggtatgctattagatatattaggctattagatataatattagatatgcctattagataggcagtggtatgctgataaaaaaataataataaaaaccagctctctgggaaagccctgatttgtaccctttccctatttcctgctgtaacccttcccccacgctgatttcaatctgccagtgtaaggtaagggaacttggagtagggaagggatgcagtcgccactcataaaccagtacaacctcgctcctgtcttacaactactgtcttataacactaacaataagcttcatattatttaaaagactcatgtgcttggtaatattttctgtcatagtacattcatattattttgctaccctgtttaaaagtgaatcattttggctcattctgggtaactcaaattccttttacaacttgcagaattattaaatgtatgggcacatatggatactcacaaagatatacaagtaagatagttccataacatgttcccttttgaaagcctctgggatgatgttaaaactatttccatctattgtaccctggatgaacttaattgctgttccctattgctgaattaactaggaaatgtcatcatatcctgcacttcacgcactccttaataacatgcttaatattcatggaaattttgggaaaaaagtaagtcttttgtgaagcattgtgcctcattcttctctggataaatcattttgcctaccgggaaatttggtttattataattgaacctaaatcagtaatatttgtaatgtccttttggctattaggttataaaagcaatagaagaaggttatcgtttaccagcacccatggactgcccagctggccttcaccagctaatgttggattgttggcaaaaggagcgtgctgaaaggccaaaatttgaacagatagttggaattctagacaaaatgattcgaaacccaaatagtctgaaaactcccctgggaacttgtagtaggtaagaaatgcctaagggaatggaatctgggagaaattacaatagtaacataaaccatttatctcctccaccccaccacaatggcaaattgacttttgtgttgacgtataaactcatattaaatgtattgcatttactgaagtttatttttttcttttcagttaggcttaccttaattagtgtttgaaaagaatctattagttattgcattttttaaacttacaagtatcactagctgcttttataaaagaaactttataaactggatttttgtgataagatagcagcagttcatattttcagaccaatattattattattacatgggtttttattactgttgtccttgttttttgttatatgcatagtatctatttaactgttttgcttcaagtcatttaataaatgattcaatgatgttaaagtttataagagaaattcaggctaggtgcggtggctcacgcttgtaatcccagcactttgggaggccgaggtaggtggatctcgaggtcaggagttcgagaccagcctggccaacacagtgaaaccccatctctactaaaaatacaaaaattagctgggcgtggtggcgggcgcctgtaatctcagctacttgggaggctgaggcaggagaattgcttgaacccggtaggcagaggtggcagtgagctgagatcacgccactgcactccagcctgggcgacagagcgagactccgtctccaaaaaaaaaagaaaagaaaaaaaaattcaatacatgattaaagaggtgtactcattaaaaagagtccattcatcctttgcatttggcttgcttgattgtaatgcatgttaatagttattcagcctcagacgccaggtaagattgatgctctggtttacattggtagtaagttaggcacctgtggaggtgttctaactccccaggcattcacaagaatgccatcagcaaaggagatgcacaatatctctacagcaccctcgtggcctgaacaggttagaacacagccatatgtgcatcatttactcccaattacttttggaaaagcaaatgaacaattatttactgattccaaatattgttggctgtacttttaaaaacatatggaagacaaaactgggtggtcatcatatctaaataaaatgtaaatttaggagtttgtagttactggcctcctggatgctttaggtttttattagcatatcgatgtattttttattatgtacaccaattaaaacatctaattttgttctttataccttaattttatatgggccaaaacattctttctttggtatttcaggataatgttcgcttttctgtttcatttttatctaggccaataagccctcttctggatcaaaacactcctgatttcactaccttttgttcagttggagaatggctacaagctattaagatggaaagatataaagataatttcacggcagctggctacaattcccttgaatcagtagccaggatgactattgagtaagcttaaactcttaaaattgtatttaaggatttattaggtacaatctacactttatacattaggttatcttctttatattaaaagaatttgaatcccaaaatcaagataaaaaaaatacttctttaacaagttcttactgcgtaccaggcattatactaaatagacctttaaacatattacctttttaaccttcacaacaataattgtatgaagtctatagtttcatacctatgttgttgccaacaaggctaaagttcagaaaatttaaatatttcccctaagccaagttaactagtaagtaataactaatttggctccatagctggtgttctaaacaccatccagtgaggcttcctctgtagttaacttctgtattatttagattcctattcactggggaaactttctccattgcaaaggaggatttctttcaccatgtttgtgttgaacttaaataatttcaaaactttatactcaatgctgaaatgcattagaacgtccaatatgattatttctgaagagatcaaaagaagcttaattcagttaaccatagcttaaaagtaagagttcaacttactttttggaagatgtatgatcaattcttttttttttaacctgaaaaaaatgacctgataaagcaacttttgaaatttctatgaacttgaagttaaaagaactcacttttcctgtctggctccatcactaattatgggttcctggacaatctaaaaatctctgaacctcagttgacttggctgcagcatgactttcatgggtgacatagttcctctcagtcaatgtgcttgaaaatggaaaacaataatcaaggttccatttgtgggatcctatattgtactgtcatcgtttttccaatgagatgaagaccagcaatcaaatattattttctggtatatgccaggaaatgtcacgtacatgggtttaagtgtgtgcatgctattttgttcagttttcttccagtcactatgtgggcatttttacacttgggtccccaaagcaatctgtacccctgaaaacccatgtttctcagtcactgccatgaaaaactacggtgctatagttttgcaatattttagctgcttgtaaagacatcagctcattgtatctggctattaagaaaggcaaaacacagatccaattcttaattcaaatttaagctattaaatttagatgtacattttaaaagatagtttttataacatataatgaaatgattgaactcactgaaataagtagataaccaataatatgctcagaattaccacacgttaattgaatccagtataaaaacttacatggtcattgatgagttccaatttttctactagatcccacaaactgttttcattatcctttatcaagctttttccagttagaaatttctaaatccctattaggttcaagaatacaacatttcaaataacatttcctaacctttccttaagttaataatagttttaagactttaataatttcttatgtaaaatttcaaatcactttaaaagtgaattgagagtaaattgagaacctgagcagttaggtttttacaaaggagaatgttgatgtaggttttacaattctgatctgctgcaggggtgtgatcataatacccaagaacactaagataagatctatttggctaagataacgtatttaattaaacagttgatgacagtttagtgccacatttattctttgtaaggtacctaataaaaagtgcatttgtctttttcagggatgtgatgagtttagggatcacactggttggtcatcaaaagaaaatcatgagcagcattcagactatgagagcacaaatgctacatttacatggaactggcattcaagtgtgatatgcatttctcccttttaagggagattacagactgcaagagaacagtactggccttcagtatatgcatagaatgctgctagaagacaagtgatgtcctgggtccttccaacagtgaagagaagatttaagaagcacctatagacttgaactcctaagtgccaccagaatatataaaaagggaatttaggatccaccatcggtggccaggaaaatagcagtgacaataaacaaagtactacctgaaaaacatccaaacaccttgagctctctaacctcctttttgtcttatagactttttaaaatgtacataaagaatttaagaaagaatatatttgtcaaataaaatcatgatcttattgttaaaattaatgaaatattttccttaaatatgtgatttcagactattcctttttaaaatcatttgtgtttattcttcataaggactttgttttagaaagctgtttatagctttggacctttttagtgttaaatctgtaacattactacactgggtacctttgaaagaatctcaaatttcaaaagaaatagcatgattgaagatacatctctgttagaacattggtatcctttttgtgccattttattctgtttaatcagtgctgttttgatattgtttgctaattggcaggtagtcaagaaaatgcaagttgccaagagctctgatattttttaaaaagaatttttttgtaaagatcagacaacacactatcttttcaatgaaaaaagcaataatgatccatacatactataaggcacttttaacagattgtttatagagtgattttactagaaagaatttaataaactcgaagtttaggtttatgagtatataaacaaatgaggcacttcatctgaagaatgttggtgaaggcaagtctctgaaagcagaactatccagtgttatctaaaaattaatctgagcacatcaagattttttcattctcgtgacattaggaaatttaggataaatagttgacatatattttatatcctcttctgttgaatgcagtccaaacatgaaaggaaataattgttttatattataactctgaagcatgataaaggggcagttcacaattttcaccatttaaacacaaatttgctgcacagaatatcaccattgcagttcaaaacaaaacaaaacaaaaagtcttttgtttgtgaacactgatgcaagaaacttgttaaatgaaaggactctttaccctagaaggaagaggtgaaggatctggcttgtttttaaagctttatttattaaaccatattatttgattactgtgttagaatttcataagcaataattaaatgtgtctttatagatattgcaggaatgtatacatattgtgattaatgctttcaaaacttatgaaaatcatgaactaccccagaattgaactgttgtacttccaaagagaattgggctgtttataatgattttaatagagaaagatcccagggatcggtcataattggtcttgtttgataatgtgggcatccacaaacaaacaaacaaataacagaaacaaaatctgtaaatgttcctttgtaaaacttgtaaattttatttatactgtcttgttttgtacacacatttctctgtagtgggctctgaatacattgaaaatgcactatatttttctattttacttgcagagcatcacaaaagaacaggtattttcagtgctacataatgtgttttcccacatttaggaccaaagacggctatagaaaaactcaaatggattgcttcccaaacccctccccaccctttttttttggttttaaatcactgtacagtgttatttgatattttaatttattttttgattgactagaaaaatcattttaatttcactaaaatgttttttgtccctaaggaaaagtaatctgtaaaaataattttaattagcataatacagtcacctagacacttccatttgtaatctttgtaatagactgtaaatatatttttggaactataacacaatgtgcttgagggttatttttcagtgtctgcagtgtgtacaagtgtttatactaagtccagcactttacaattctaatcagtagcattggcctttgtgagaatgagtgaaagagtttgagtgagtgttcttaattccttttggattctagactcactaataatgaagttcttttcttgttcatagcttaaggtgcttattttttctattaaaattaaattaacaaaagccattctagaaatagaagacatagtatggtacatgcaaacggtgtctttcctgcttttttctagcactagatttatagttgagtagtctttcttgagtagaagggcagaataaaagtttttttgagtttttttcaaaaataactttttccttcagcaatatacctcatctgccttaaattttttacagctctttacagggaaaggggagaagggatgggaaagacacacagcacaataggaagtgtatgattacatcactatctcgtttgtaagtttcttttcctaatcaacattatgatttcgaaatacatgtatgtgaaacaaatattaagagaaaaagaattaacattgtaatgctgattgtaatactctcttccagaaagagatgagatggtataacgataagaatgtacaacttgcaccttgaaatctttttttttaaataaattagtgctcaggggaggaaaagtagagaaagtgaacgtcaaaaatagaattccaaaattataaaaatgcaaaaggaaatggcctccttgctttaatagagccaccttttttagaacactgtcctcacacttgacctgtgttttgcattcagtactgaaataaaagtaacttgttctacatttgaatctaacattttctcagcaattgatctggtccttgtttactagaactggtggtttatgcttgtcagagcactattagttgaatcatattgtatacttatgtaatctacattagctagtactgtttaggactatattttaattgctcttcttatccgtgtttttaagacaattaaaatggtgtgattcacctctcttttttatttaggtaatgctgatattctcccttttgtttcttgagtagcctagaactatgctactcactgatgtgcatgttcaaataaattactgatgtgtatttttttgctatatgtggagaaatcatggggaactcggggcgagatgtgcttttcgttggttgaatttgtccctccttgcctaagaaatactacaggggtcatccttttataaggacaaactgcttttgaacagtgtcttcaatgtatcaagcacaaataactctttcttcaacat

SEQ ID NO: 15773 - DNA, 76264 bp, Human
  misc_feature (1)...(76264): n = A,T,C or G
atgtaatcaattcactttgaaatgcatctagcaaaatggtagatggatgtaaatatggatggagagatgagatgcacatatgtatattatgataaagcaagtatagtaaaatgttaaaggtagaatcctggtggtgggcatataggtgttcaccataaattctttcaacttttctctatatttgacatttttgtaacaaaattttggggggaaaaatcaagcaggagaactgcatcatggctgtggtaattaattagtcctttgtcaagattccagtcctaaactgaaggtacaggaaacatatcttacactccagggaaagggaggactgacaaaagctattcatttgtacagaatatctaagtatttattgagttcccacctggcagcaagatcaaggtgttaaaaggaaatcggatatagacctgcagagttatagcacaaggtaagaagtgaccatccttgtttggaaatgcaaggggaatgacaggtgaaaatgactgtcccactgattatatcagcttctactgggtatcagtgcaccacgcatcatttcacatgccctgatttctcacttggacaaccaactgggtgatggcatccttaagtgacataggaaaataacataggaatatatttgtggtgggtgacaacttttgaatttgctgtggtatcttgaagtttaggtgtttgtctaagtagagatgaccaataggtccagaattcaggaaaaatcttgagtatttggagattaggagtcatcattataaaaatagtatgagaaacagagaccttgggtaagagcatgcaaagagagagtgtacagtgaaaagaaattatcgtttctttcatttttttatccactcatcaaactgtcactgcgtgtcactagaactacgaataaaaagtgacagaatgtttcccaggagtttgtaacttcttgatggtcaaatccaatgatctatttgcaatcccaaatgtgtttaacataattccacagttaggctttatgtcaaacggactatataaaattcaacagttagtttaaaactaaaacttgtgctggtagtacaacatgagcaatactgaccatcttggggacagaatgatctagtttgtgaggaccataattgctttaaactctcagcgtgttttctcatgtcctgaaaatggtgacaaaaatattcgattttcaaggcgactgttgatgattcatttaccaatctaaagcactagtgccccgcactcgtaatccataacttgagatgaacacaccaaattataaatatcttattcacctaatccgtggaaagtttgtaacaccaaaatattaacttctgttcttgatcactcagcctccatagttattcatgttgcatgatctgattcgctcttttagaatttctcatagcgtcaggtactagctcaaaataacaggagcaactgcttctttccatatcccacattgaggaaaacacattttgcaagccgtcttaaagaaacaggtcaacttagtttagggatgaaacttaaaagtaagcttcgtcacaaaaaacacagttcaacaccacctcgcccggctgcaggcagctcagaggacaggaagtgaggccaagacatatttcacgcagcacagactaaaccccagcttttatctttcccgctggtccttaagggaccaaccatactgattttccgtcatgttccgcgccacttccgttcgcgcactttaattacgtcaggcgtcctctctcgcggtatcatccggttgctgaggccctgtaataaaggtctcgcgaaatttgttctagaggtccaagtttgcttcttagcttactccaccccacccccaacctgtccctccttttctttccaagtcacaaaattctcccctcccctaccccggagtttacggccctcctcctgtttccgatttcagcccggaaccggaagtgtagtgggcggggcccgtcggcggaaaacgcagcggagccagagccggacacggctgtggccgctgcctctacccccgccacggatcgccgggtagtaggactgcgcggctccaggctgagggtcggtccggaggcgggtgggcgcgggtctcacccggattgtccgggtggcaccgttcccggccccaccgggcgccgcgagggatcatgtctacagcctctgccgcctcctcctcctcctcgtcttcggccggtgagatgatcgaagccccttcccaggtcctcaactttgaagagatcgactacaaggagatcgaggtggaagaggtgagcgaggcccggcatggagacgccggtcccggcctgccccgcccccgcctctgcctggtcccggctctgaaggtgcctcccggggcccctctaattcgcgggaccctgcggggtccacccgggagaccccacagccctcagtaacgtgggagtgggggttactctctgagctcaactgctcgggagtagctgccttttttcctctcttgggtactcttgattttggatttgatattccggtgataaacaggagaatgaactggtgagatagtgtggtccaccagttctcgtatctgtaagtagtagtttcagcgaagatcgtagccgttctggagtttcagtccgctggacgtaatgttctttttttttttttttttttttgagacggagtctcgctctgtcgcccaggccggactgcggactgcagtggcgcaatctcggctcactgcaagctccgcttcccgggttcacgccattctcctgcctcagcctcctgagtagctgggactacaggcgcccgccaccgcgcctggctaattttttgtatttttagtagagacggggtttcaccttgttagccaggatggtctcgatctcctgacctcatgatccacccgcctcggcctcccaaagtgctgggattacaggcgtgagccaccgcgcccggccggacgtaatgttcttaatggccaaagattgtattatattcgacttctacttcagtacctggcatgtaggggatgctcaataaatgcttgttaaattagtagatcatcaagtctaataaagtgtttcccttagcaccgaatggttctcaatttctccgataccgcacagcaatactcgtaatgtttaaatgctcggctttcagttgggctaatgtaggtgaatttcaccataagtaacatagactggtctacgatcaaaagatgtttcaagtagcatattctgaagagataacgaatgatttcggtgacaatcagaatataatattagactagaaatcgctatcagaaaacccatatcctttctttattctgcagtaatttattttagaacaagatatttcaaagtgactttaaagcgtcgtttttcaaattaacaggtaaattgggttctaatgactataaaatttagaaaagtaaaaactgcatatatattttttaaagacactttagaacttgttaaaaactttggttgaaaatactatctcttaccatttatttgccattttttaaatttattaagcactttgcgttatatagtccatgaaaaacctagtgaaatattatagattgtcaacgagttatgtctactttaaaattctaaaattatttttaagtgtcagcaagttcaaagtagtgagataacgttcaacaaataaattttttttcctgtgcatgttttggaagagtaatggattactgaattatatatgttttatcacataaagtaactttagagattattgagaatatcctcattttacaagataatatggtggaaagagcaaggtctttggagttagaggaaagttcagtgtatcagatatgccatttattagctgtgtgatttggggcaagtttcctaacccctttgaattttagtttactctaagaaagggctaataaattctgtttcattttatctgcataacagatcttagtagacattatatgcaaaacacctaccacagggcctgacacatattaggaaacctagttccagagaggaaatgtgacctgctttaaggtcatatggctaaaagaagacctgtattttgaaaagagggggaaatgtttttagtttctttttttttacattgaggctatgataaattccttttccagaagtggatagttgatgcagctttcatggctaatattcttttttaagaataaaaattcagtgagtcagtatacaagaattgcagtttttaaataagcgtttacgtctgctctgtggtgaattgctatgcttgtagactacaaattgttatataataataacttgtgctttatggtctactaaatgctttcacaaacttacttcatttggttcttacaaccttagtttttgaatgctactttctaaagctttttacattcttgattcagggaaaaacaaattactaaggaggtagttatcattttgatgttcttcccctaaagctatttcgcttctggttaggtttctgtgtttccaagacccttctctcagtttagataatgtttcaatctttgtgtgtatgtgggtgtgtgtgtgtttaggaaatttctgggagtaggtttttgtttttagatgaaaatttgtttctaatatcaggcagtcatttgggttttttgtttgttttattccctttcatgtttaatacttagttcatttttgcattaaagattgaatttggacctttctgatattgaaagcattacataatttccatcatcttcttcatttgcatacattaaaccagtgttacacaatccagggtgaaccatgaacacttattagctatttgtcaacttagattacacttccagttcaattgtaagataaacagaggaagatgaccagaaacaaaaactattttatgttgcttccaatattttatattgtatgagaatattaccttctaaattaagaaaatcatgtatttctcaatgtaattgaattgtattatatcaatataattagaaactgtaaaaaaaataataattcaactacaggccaaatatgcagccatttagtagatacatatttctaagacattagctgatcttgcatttctaatattgtaactcagtagtattagtttggcacatcttagattcaattcaattcagtcaaattaggtaaggtctcagcctcagaaatctgcctaggtactttttaaacatcatttagtgtttaccatctagaactggctgtagagaatgttggaataaaagaggggatgggttgcaagaagtgttacacagggtagtatagtggaaagtgttctggactgaaaaagaaaatttagatgctgtactgattctgccataatatatttttgtaactttgaggaagtcaccacatttttctgggcctgtggttactcatgtaaactgactgaacaagatcatttaaggtcttttccagttctaaaatgaaaacacattcatgttttccagtatttaactgttttctatagtaagcttagcagttctttaaagactgatcatggtctcctatagaattcagttggtgaccaactaatcctgggttgacagggcaaatgatatcccattgtacagatattgacaagcagtcatagagtttgacttgccagaagccgcatgcctaagtaaatggtaaagctgggaattgaatatgagacttctcacttgtgagtcagttgccctttccactggatttacagtgtcactcagtactttctgaagtactctataaccaaacctaatatgggaaaggggaaacaaaatactgatttcctttttagtgtagttggtcctgagcatttaatgaacattctcatctgtgcgtaatactctgaggtactataaaagataaatagggcttggtgcggtggctcacacctgtaatccgagcactttggagggccagtgcgggcagatcacttgaagccaggagttcaagaccaccctggccaacacggagaaaccccgtcactactgaaagtacaaaaattagctgggtgtggtggcacaggcctgtaatcccagctacttgagtggctgaggcatgagaatcgtttgaacccaggaggcagaggttgcagtgagctgagatcatgccaccgcaccctagcctggacaacagagggagactctgtctcaaaaaaaaaaaaaaaaaaaagatgatagaagaatcctaggattacctccttaaaatgtctgacttagtatgatatcagactggagtaaacacagaacagttaactatagaccacaaatttaaaactgaatatagtgtaaattaaacacttaagccataatttgaaaatagagttaatcacagaaggttccattgagtagggacaagtttaaaactaggttttgaataaagtgaccatcgtgggttgggaaagtcactaagatgaattttctttgtagttgttcctctgcctaaagcgctgttcccccataacttaagatgactgactcctcaccagtcaagtcccacctcaaatgttattaacacttccttagagaagcattccctgaacaacctagatcttttgtcatttctattatctttcatggtacttaccagtaactgaaattgtgtctctccttcagcaaaatgtaaggcgctttattcacttttgtaaccccaatgcctagaacctagaaggttctctatacatatttgttcaatgagtacatgaaagtatcacagcataatcataagaattaaatgcccatcttgttctcttatattacatgtgataaaataggagctgagttatgcgatttggctaaggcaacacgttagaaatgagatccgagtcttgttttaatgtcgactctattatagttagcagatacttttgtttagcagggataaaaaatgctgtaaagggccagatgctatgagtaagccacgtatggtaggtctttactacagagtgctaaaaagacactatttacaatggttgcttttgaaaagggagacccataatgctgacctcaactatagtgtaggaacaaagctatagtattggacacataaaattactgcagcatttgtatatattcttcagctttgttaaggagacacacaaaagttttgttttaaaagctaaaatatgctacaaagaggagatatagatagaacttaaacagttatatgtactttgtaggtttaagttataaatatatggggaattggtattagagaaaaacctaatttatagtggtctaaacaaactgagtacatagatttgttagtcactatttaattatggatacctaaaataatcaatacattctttcatgtgaaagtgaccactgatttcagtagaaatctggaattactatagttaagaggtagctacagagataatttttgcattgtacacgtgtagcttaaaagatagcatgagcatattatttgaaataaaagcctagaaaatgggtgagatgtactgtggcaggtattaaaagactgcatgaaacattcagaagaaagtttgaataatcaaagctttacttttatgttatcaaatccatcttgtcagcagatggcagttccactctgccacagtttattaatagatattgaagttctaacatagttggaggctccaagtcctaactaataaatgtatgatctatgcttgttctgtcttgttccgcatttccagccagaacaatgccagcatcaccaggggtccattcagatagttcatagaacagggccaaatgaaactgacagctgtagtcactgaactaaaaataacatgaattcagaacaattaaaagaattatttaataataaattaagagcacaaaggcatacatccttttccatttaggttaggtgtgtgtttggttgttttctttaacatgacttgtctgaaggaatggagtcatcttacatcataaagaaattaatttttaaaggaatttctttaaaaataacacacaaacacacaaaacctgatttttgtttttgtgcctttcaatagtagttgcatggaaatgttctatataccatctcatattcttctgtattttttattaagaaattaaatttaaatctacttaattgtatgagactaaagttgtagacccaaaacaaagaggtttcaaccatagggggagaaatgcttatcataaagtaattaatcaaaaacattttgatttagaaaacattcataaatttagaaggaaatatttccaaattgacctcccttttaaaaccaaagtcctttttgcattcctctgttttttacaaatgaaggattatgaagaatatctgaaatatttatttgtatgtcaccattttagttggatgtgtgtgatggggaaatacttgtaacttgatatgttctcttttttactcttgatgaaaattcatctttggggaaaaaacagtcatttaaaataatgttgggctaggtacggtggctcacacctgtaatcccaacactttgggaggccaaggtgggagattgtatgaggccaggagtttgagacgagtctgggcaacatagtgagaccctgtctctataaaaaattttaaaaaacaaaaaacctaattgttaattacagtgtgtcaaataaactgtattattcagaaaagaatacggttcagaaagcacgtttgatttgtgaacttggactagaaatttggtagtaaataaaaagtggccttctttcagtggtttacaacttgaatattaagttttttcattgtttacctcagttgccagtatgtctcaagagtggccatctatgccactttttttctgttgatctaccatatgtcaagaaaaatatcaaatttgctttctgtagtttgtaacattggctcattccttatctaataatgtacataatctccttatgtgtttttaggcttggcctttgcagtccagacatactattattctacatctgatcttctccacgattttatgttcttgattaatacaataaggaaatttgttaccaagatatttgcatttgaaacattttcttagaaatatgtgatatattttttaaaaatctatacacatgtaagattttccccagtcagtggagtgctgttttacatagcctgagaggtggagtgcagacagtaatgaactttcttaaccagcgtttcctgttggagcggtggtgtccacaattttttgtttgtctgtctcccactggtaaaacaaaacactttctattttgtatactcagttttcagtgtgtatgtatgaagtcggtatttttaaacaatgggagatgaaaggtttcatactatcatttgatcatggctcaagttgcaataagtactttctaaataaaacctttctaaaatgtgagaattgacttaattaaaatgagataatatctgtaaatctacttaactaaggtcaagtaaactacaatatacacaagtgagggactgataatggagtcagtatttgacatattgaacttaataagcctgtaggaccccttagtctcaaaggcagttttaaatatatcttgagcttgggcaaaaaacctggatgggagagatttgagagtatgaatccatgagattagagaacagattcagaaacaaaagggccaaggacagaaccctggaaagtagcaacatctaaggtttggacagaggaaggaagaatcagtgaaggaggctaaaatagaactcttaagcagagacaggcagagaagggattgttgacagccatctttggagactgccataagccctttatacacaagccttctattaacccaacttcactcttttcttaaaggagattagggctttttaaaacccccttctaaacagctaaaatctgattcgaatataatcttttgaaaagttaattgttgttagttatcatacttgctgcctttgagtagcatttttctctgtaccaggcactggaccaaatcctggcaggcctctgttttgttggcaccatgaaacatacctgaaagctgactctgatttactaattacatgatccttgaataggtaacttcagttcttggagccttggttttcttctctctaaggtaggaataaaaaatcctatatattcatgggtttatggtgacactcaaactccatcatatttgtaagaaagagctttacaagttgtaatatattgttaaatataaggttgcattatcgttatacagataataaaattgcatttctttaaaatgttatttcttgaagaaaggaatgagaagtatattggaatgccctgggaagctttttttatgctacgtagcaccttctgccacctctaattcccattcagacttctcccttagagagctaatatcagaatggggggaaggagagcaaaatataccaggaaacaactttatccattgtatatatcatctgattattctatcttctactcttatggatatatgcttatactcttttttgtttaaagcacaaaactcctgtctctggccaggtgcagtggttcacgcctgtaatcccagcactttggaaggccaacccaggcagatcgcctgagctcaggagttcaagaccagcctggacaagatggcaaaaccccgactctactaaaaatacaaaaattagctgggtgtggtggcacaagcctgtaatcccagctactttggggtggctgaggcaggagaatcacttcagccagagaggcagaggctgcagtgagctgagatcgcgccactgcactccagcatgggcaacagagtgagaccctgtctcaaaaaaacaaacaaaacaaaacaaaacaaactcctgtcctcctgccggtatttcttacttgtttttaaaagttaagaaatgtaactatttttctataaactactgtttaattatgagtcattcctcttttcaactcagtagagaaaagcatttaatcttgccacaacaaggataatttccatgtaatacttacctcttttatgtatctttgtactcagaaatttcaagattaattcggttatttcaaaattcagtcttcccccataaggattttccttttccctttctcctgcccaagatgacatatgggtgctgtggaaagcttccacaaataatataaacagcaagggagagctctctggtctgtgtgatggcttccactgaaatatcttgccttattatctgttgttaatggattagccttgaatgcagtgattttcaaacattgaaactacctggagggcttggtaaaacatggattgcttggccttaccgtcagactctataattctgggttgcaccctgagaatttatatttctaataaatatccaggtgatgttgatactgctgaaccggagaccacacttttagagccactggcatatgctttcactgtccttatatctgctttccttctggaacgtctttttcttttggcttctctgactctctcctagtttgcctgctaccatattgactgttccttcctgttccttgcccattccttctcctctcttgtgatctaaatgttgaactgcttcaaagctcagttcctctactccactatctccatattatttttggttacctcttccaactgattgactagaaaaactgactacatgctaatgactcccaagtttgtatctctttgtctgacttctccatagatcctctcactcacgtttctaccttcttacttgatatctcctcttggatatccagtaggcatcttaaacttcatatgactaaaaccaaactctgagttattaaaaaaaaatctgcatcattcttatccctcagtaaactgttgtccagtctaggtgttttccttgattcagctcttttcctctacacctgtcctgcctggatgcagagcatcagcaaaccctattgactctacttctaaaacatttcccagatctgcccagtttctgcactaccattgaccttgccctcgtagctattgttgcttgtttggactgctgtaatggcttcctaatgggtctctatttacatatcctagcttccctacaatcctttctttaagagctataatgattttgtttaatgtcacataccatccttacttccttgaattttttcagttccttcacattgcacttagactgaaattcaaactcctttttatggtaggtagagccgttcaggatccaacctctgcctgtccctccagccttaccttacaatcactcttcccttcctccactatacaccagccacaccaaacactcccaagtatttctctaaatcatcactaaaatgtcacctttctcagtgaggccttgagtgattaccttgtctaaaattggagtgaggcagagtgcatacatgtgtgtatacacacacaattatactccttttcttcttagcacacaactcccttcctttttatttgtctttttccacaagaatataaacaatgagaacaaggattttgatttggtttgttcactcttgtatcatcagtgcctaaaatagcgcatagcccttagattgggctcacatattggagtaaataaggtagtgaggtttttcttttcccttagggcaaagctttatattagttgtttcttctgtgtgtgtgtgtgtgtgtgtgtgtgtgtgtgtgtgtgtgtgtgtgtgtgtgagagacagagtctagctctgttgcccaggctggagttcagtggcgcgatctcggctcactgcaacctcggcctctcaggttcacgccattctcctgcctcagcctccccagtagctgggattacaggtgcctgccaccacgccccgttaattttttgtatttttagtagagatggggtttcaccgtgttagccaggatggtctcaatctcctgacctcgtgatccgcctgcctcagcctcccaaagtgctgggattggtgccttgtgtcatccaaatgtcagattcgtaacctctttatatggccttttcaaactgcccagcctggagctgccactagtctcttggtcatagcatcctattttttgttgttgtcgttgttctatgtggcatttttttaaagtctgatttttttcttactcatcttttgtttgtatatcgattttcttttctcctcccctcccttcacatacgctagaaagtacatttgtgtagatcagagcctttgtcttatttctttctgtatttctgatgtcccaaacagtagctggatgtagtacacactaaagaaatattggtttaaggagtaaacaaacgaagttcattattctttcaacatcaagcctcacttgcatcctttgaaggcagaagacctaacccagttctccctgcttgctgaccaggccttccccttggctttcattaatcctctgaaacccagctgtgttcttcattaagtatttgagctagctaccatcccacagacctctaatgtaggtcccaacactctgccctaccgcagcctccttcctgcaatcagaagactccttacttctcagttagcttgctttttgcttcacaagagcttttctttatcccttacgtgttctactggggctgagggaacccgggttagggcctcccttggtctgtcttccttgccacaatccttactcctttgaagcttctggtgtttgcagagcacatgctgtgaggatgcctgctcttagggatctaagtgagaagagaagggtatgagtcttttttgctgttgaatccctaccctaaccctatcctgaaaagggggagggaggagtttattagccttcatcattagcccttacctttggctctcttcagctggtaagtgtttaaaagtttttaagtactattatttagtcttaaatttcttctctaccgcactttcattccatgaaggcaggggtccattctttatatatattttttcttctcatccccagtgtatctacctttatgctatttttaaaaatgggaagtcatttttgatacacacaaacttaattctttaagtattgactgtgcttataatctcactcctttgaattcacagcagttattatttctatcctgtatttcaggtcagtacaaccttggacatcttcacctttctttattataactttagatcctgtcatttcactgtgcatgtgaaatatctcgtggccctaataagaatggaggcttcttaagcccatgggctcatcttacaggaatgtgcctgttttgtatttcagggtgttctagaaaattgctttcttgagcaaaaaggagaaagtttttcatgtcctcatttgaccacattttgttcccatggctttaagttgaaagctcagaatcagctctactctcatcactaggtggcacttgtgaattacaaatagtcaaatgaatttttatgacaaacatgtgattcacaaatatagataatgtttggaatccctgcatggacgttcctcaaaatggaagaaatgaaagaaggggattcctagtaagtaccagttgctgtgatgtatttataaatacatggttgaagaataaattacttcataatcatttcgtatttaatagtaatatcaataggtaaagtctggtctccatgcctgtgttcttaaactaatgttgccacaaagttgaaatttttttaggacctgcttgctattcatcttagttaattgcaagagaagtgagtactacaggtcaggtgcagtggctcacacctgtaatcccagcactttgggaggctgaggcagggcgattacttgagttcagggattcaggaccaacctgggcaacatagtgggatcccatctctacccaaaagaaaaaagaaagaaaagaaatgagtactacagccctttacactgattcatacccaattccaagcacttactgttctttgtagtatttgaggaaatacctggttttaacttacgaatcctgtagatattcatgaaggaaaatgtcagcacttctattttactgctgagaaaacagaaactcaaacttgtccaccattaagagataataggtagacagagccctacattcaaactcaagtctgttggatttcagagcctgggtgtgctctttcatttattctaatggtaccaggtagccagtaccctctattcacaataaagtaactgaatggcaagtacaaatgtctgatgagaattgtgaaggagaacaagaacctaaaccacagaacactgagtgcccagggctaggacgagtgaaatgggaagtcaacaaaacaaagactagctaccagagaagttggcctactttgaaattttgcctagaggcagccccatttcctttaagccactgatgaacagaagctgaatatagagtatgttcatcattaggtgctctaggcttcaaattctggcttctctgaatattttctgaccatccaatcttgggcaagttacaaccatgtgactccatttgcctcccttttaaatggaagaggattaaatgtgttaatgtatgagaagcacatagaatagtacctggcacatagtaaacattcaataaatgttaaccatttgagtagctttagacattgaacaacatggtaaatgttcattctgccttattgatacatgaagtggaatttaagctatggctagagtggtcatacacatcgcagtttacaactagtgtcctaatattattattattaatgccctttttttgatctccaaagtgccctcagttagataataactcatttgatcaacctagttatagtcaactttgttatagaagagttttgtgccaggaatttgttcatgtaagtctaaagtaaaagttcctccaagggaagatactaacttctacttcccgacatggggctttatatatgttacaaattaggactggtaacattcccgtgttagactacctggcatcagactgcactttaacacttgctagctatatagccttgggcaagttttacttctttaaagctaggcacttcaactgtaaaatgaggacagcattagtaccttcctctaggcctgtgtaaatgaggtaatgtatataaagcattagttaagtgcctgctgcatagaaagtacatataaatatggttaagagatgcagattttttgctaaagaaaaaggccttgatacaaagtgcttaggttcattggaagctgagagattggagtaggtggtgcttaactaaggtcctttcacaatgataaaatctaatgattttattctaacaagtatcaaaagctatttttgttttctttttttatattatgaaaaatgtcaaatatttgtaaaaataggactccatgagagagcaatgaacccatgcagtattcatcagttggcttcaacaatagtatgatacatgtctgatctttatttttatgacttttgaaaaataactgtaatgagatctattttacacatcataaaattcacccatttgaagtgtacaatttggtgggttttgcaaatttaccaggttgtcagccaccaccataaattaggtttttggttttttttttttaataatttcatcactttgtcaggataccagctactcatttactgttaattctaattttcaccctcggacccaggtatctatctatagatttgccttttctgaacattttgtataaatggaatcatacaatatgtggtctctggtgtctgacttctttgacttagcataatgtttttggagttcatatcgtaagtaacatatatcaatagtttttcttgcggaataaaattccatggaataaataatactatattttgtctgtccttcatagccggtcttttaacatctatatttatatcgtttctcctccattccctatccctgttgaattattcaaaggctatttttaatttcttaaatatgatagctgaaaatatttattatatgttcctgctttttgtttttccatatcatcttctgtcttctcattcatcttgtctgttttagtttttttttctccatttaacaaatcactttactttgttcctccatgtgtcttttttggttttacttgagaatgaaagggtgtacagatcataaactttcaaagatagagacaagcatgcatttaattatcttctcactttaacaaaaattcatacttgttcagtggcaaatccagatactgttgatttccatgttttttttttttttaatttaaagtcttaaagattgactttagttttttatattgggctgatctatttgattccgattcttgtggtgttttttgtttgttttttgtttgtttgtttaactcaggttgttggaagaggagcctttggagttgtttgcaaagctaagtggagagcaaaagatgttgctattaaacaaatagaaagtgaatctgagaggaaagcgtttattgtagaggtaagttgagatttcatttcttttgtgtagttctgcacttaagatactctgtgaatttaatattatgaaaaagattggtttctcagatgtcatttctttgtatacatgaacatcagcaattcggtttaatcaaaggtactgccataggaacattttctcgttcatactcttaattctgattaaaaattaggggaaaagcgacttaactacataaatgaattcacccctgaattaaaacagtttcatccatggaattcagatctatttcaaggcgtaatattttaattttaaaatagaaaagaaatggtatgctttcccattatctaaaattaagaaattttatacacttactttaaatggaatgtttttagaaactcagattattttaaagaaaaattatttcaaatttgatttttctcatttagcatgaaaatttgcacctattcttttagaaatagattagattgaatgatgaaagaaaatccaataatcatgaaattagcatattatcaaatttatcctttactaactttgttattttgtattttggatcacattatttagttaaatcaatgtttttatcactattaaacctcattggccaatggataagtggcctgtaccttataagccttctgaatttatatctctgttttttcatttaatcataatttcaaaatatacttcatatttttaatgtataacatggaaaaatgaggacttaattgtgatatgagaaagtgatttgtaagtggctgaatgagttgagaaatgctgataagtgatttgatgtcagcatgaagaaagatgatttctagtaatatgttctaggagtctagcctcagctttgttttatgcaatatttttattacagtttagataaagctattgatcatttcctgttacattagcagtttcacaaagctgggtgaaatagcatatgtgttaaacattaggaatcacaagtcaaaaagatcgtaatagcgtgaagaaaattttttaaatccagatgagatgtgcatgtaatgtaaaaaatcaaatggttctccaaaaattcttagtaaaaaagacttcagtctcctgtacctcctccaatctaattttctgcttcccaaagacaactactttgagctcattccttcatgtttggtgtccccagtccagatgctgtttattaccccttctctaaagaatcaacctctagtcttctgctgggatgataagagatagtcattgagctgtttgaagtcaaggaaggaatctttgagtcttttacactgtcccctgccctatcctttgattagctcatttgcataggtacctcattctgctgccactccccaaccttttggaagctttgtgagataaatctggttgtttctccatttttctcattgccagtttatgatgcagctcttctaggtctgctctatcagttattgctagtcatttgctttccagcttccaaaaatgtatgctgtttgtgcactttgcattctcttcatccttctgaggttatgccttaaaatttttcaaatctttaccatcttagtgggaattagggagagaggaggaaaaaatgcttgtataatctgctatctgaatctcagtgctgaaccttagcaagatgaaatatagtaaatatattttcatatagtaaataaatataataaatagtgatactaattctattggacgaaaaatccacacatgttggctctagatagatagagctttttattagcatacagtatgaaggtttagagacattagtgtactgaatatgagccagcagcataatgtatgtaatagagaagaggaagaagagtggaaaaagggcagaaaagagaggagaagggagaaaagaatgagcaagaagcagtttgctgtggagcgggatgcattaatagaaagaagtttgaagacagacatgatggttcacatctgtaatcccagaactttgggaatggcagatgggttgcttgagcccaggagtttgagatcagtctggacaacatggcaaaaccccatctctacaaaaaatacaaaaattaaccaggcatggtggctgtgcacctgtagtcccagctactccagaggctgaggtaggattgcatgagtccaggaggcagaggttgcagtgacccaagattgtaccactgcactgcagcatgggtaacagagcaaaacctgtctcaaaagaaagaaagaaagaaagaagtttgagatctagaataagagaagtgagtatagccaaacccctcattgacctctgtatggatcattggatcagggatgattaaaactgaaagagggaaaccagctagtaggctataatgatcactgcagcagttcaggttgggattactaaggcaatggcagtgggaatggagaggagagaattaattcaagaaatgagaaatggaatggaggcaagtatacagagggagtgcacattttaagtcagatagactaaagttcacaccccacttcttagctatagaacaggtcattcaaccctctctgagacttgaggttaaaatctcatctttaaaatggaaatgataatacctaccttgcggagttgtgataattatacaatatctataaagtgcacattagggccccacgcagagtagctagactgttcaactatagctatgaagatgataacaatgatagcatgacgtctggtttggataatgcagctcagtaccatctctgggatcatatcctaacatttcttggcagagttcatctcttcttattctatatactcatcgtgccttgttcataactcctgttatagcactttgcacattgatttaattatttgtttagatgtctatctctccagctaaactctatgagctggagaacagggattctgtgccattctgggcagtcacttggtattttcagtgactatgattacaatgcctgttacatagtaaatagtgattgttgaatgatttaaacaaatgttttgtacaacagtaagattttaatgatactgtgaaatcagtacttcaaaagttatcactttttaaaagaaaccttaatttcttaacagcttcggcagttatcccgtgtgaaccatcctaatattgtaaagctttatggagcctgcttgaatccagtaagtttgttactttttcatggtcacctgtgagaaatgacatggcagatgtgtgtgtgtagtttatgtagctatttttgggtttttttgttttttttaagtttttcaaaaatattatattttttcaagataaaaaggtacctccaatactttaaaatatcagcagtgatcccaatagttcaaggactatatgagtacatgtggctattatacacgcacaatatgtcaccaacacactctaaatagtgagaatacagcaccgtggcattgctcccatattattatttttttctttctctttatgtatttattgagttacttacttgtttttgatatctttttttattatactttaagttctaggttacatgtgcacaacgtgcaggtttgttacgtatgtatacatttgccatgttggtgtgctgcacccattaactcgtcatttacattaggtatttctcctaatgcttatccctcccacctctccccaccccacaacaggacccagtgtgtgatgttccccttcctgtgtccaagtgttctcattgttcagttcccatctatgagtgagaacatgtggtgtttggttttctgtccttgcaatagtttgctcagaataatggtttccagcttcatccatgtccctacaaaggacatgaactcatccttttttatggctgcatagtattccatggtgtatatgtgccacaatttcttaatccagtctatcattgatggacatttgggttggttccaagtctttgctattgtgaatagtgccacagtaaacatacgtgtccatgtgtctttatagcagcatgatttataatcctttgggtatatacccagtagtgggatggctgagtcaaatggtatttctactctagatccttgaggaattgccacactgtcttccacaatggctgaactagtttacagtcccaccaacagtgtaaaagtgttcctatttctccacatcctctccagcacctgttgtttcctgactttttaatggtcaccattctaactggtgtgagatggtatctcattgtggttttgatttacatttttctgatggccagtgatgatgagcattttttcatgtgtcttttggctgcataaacatcttcttttgagaagtgtctgttcatatcctttgcccactttttgatggggttgtttgattttttcttgtaaatttgtttaagttctttgtagattctggatattagccctttgtcagatgcgtagattgcaaaaattttctcccattctgtaggttgcgtgttcactctgatgatagtttcttttgctgtgcagaagctcgttagtttaattagatcccatttgtcaattttggcttttgttgccattgcttttggtgttttagtcctgaagtccttgcccatgcctatgtcctgaatggtattgcctaggttttcttctagggtttttatggttttaggtctaacatttaagtctttaatccatcttgaattaatttttgtataaggtataaggaagggatccagtttcagctttctacataaggctagccagttttcccagcaccatttattaaatggggaatcctttccccatttcttgtttttgtcaggtttgtcaaagatcagatggttgtagatgtatggtattatttctgagggctctgttctgttccattggtctatatctctgttttggtaccagtaccatgctgttttggttactgtagccttgtagtatagtttgaagtcaggtagcgtgatgcctccagctttgttcttttggcttaggattgtcttggcaatgtgggctcttttttggttccatatgaactttaaagtaattttttccaattctgtgaagaaagtcattggtagcttgatggggatggcattgaatctataaattaccttgggcagtatgaccattttcacgatattgattcttcctatccatgagcatggaatgttcttccatttatttgtgtcttcttttattccaatgagcagtggtttgtagttctccttgaagaggtccttcacatcccttgtaagttggattcctaggtattttattctctttgaagcaattgtgaatgggagttcactcatgatttggctctctgtttgtctgttattagtgtataggaatgcttgtgatttttgcacattaattttgtatcctgagactttgctgaagttgcttatcagcttaaggagattttgggctgagacaatggggttttctaaatatacaatgatgtcatctgcaaacggacaatttgacttactcttttcctaattgaataccctttatttctttctcctgtctgattgccctggccagaacttccaacactatgttgaataggagtggtgagcgagggcatccttgtcttgtgccagttttcaaagagaatgcttccagtttttgtctattcaggatgatattggctgtgggtttgtcataaatagctcttattattttgagatacgtcccatcagtacctagtttattgagagtttttagcatgaagggctgttgaattttgtcaaagcccttttctgcatctattgagataattatgtggtttttgtcattggttctgtttatatgatggattatgtctattgatatgtgtatgttgaaccagccttgcaacccagggatgaggccaacttgatcgtggtggataagctttttgatgggctgctggattcggtttgccagtattttattgaggatttttgcatcgatgttcatcagggatattggtctaaaactctctttttttgttgtttttatgccaggctttggtatcagaatgatgctggcctcataaaatgagttagggaggattccctctttttctatcgattggaatagtttcagaaggaatggtaccagctcctctttgtacctctggtagaattcggctgtgaatccatctggtcctggactttttttgtttggtaggctattcattattgcctcaatttcagagcctgttattggtctattcagggattcaacttcttcctggtttagtcttgggagggtgtatgtgtccagtaatttatccatttcttctagattttgtagtttattttcatagaggtgtttatagtattctctgatggtagtttgtatttctgtaaaattggtggtgatatccccattatcattttttatcgtgtctatttgattcttctctcttttcttctttattagtcttgctagtggtctatcagttttgctgatcttttcaaaaaaccagctcctggattcattgattttttttttgaagggtttgttgtgtctctgtctccttcagttctgctccgatcttagttatttcttgccttctgccaacttttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttcttctcattggtttcaaagaacatctttatttctgccttcatttcgttacgtacccagtagtccattgttcagtttccatgtagttgagtggttttgagtgagtttcttaatcctgagtctagtttgattccactgtggtcagagagacagtttgttgtaatttctgttcttttacatttgctgaggagtgttttacttgcaactatgtggtcaattttggaataagtgcaatgtggtgctgagaagaatgtgtattctgttgatttgggatggagagttctatagatgtctattaggtccacttggtgcagagctgagttcaattcgtggatatccttgttaactttctgtctcgttaatttgtctaacattgacagtggggtgttaaagcctcccaatattattgtatgggagtctaagtctctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgccttttttttgttttccatttgcttggtagatcttcctccatccctttattttgagcctatgtgtgtctctgcccgtgagatgagtctcctgaatacagcacacttactggtcttgactctctatccaatttgccagtctgtgtctttcatttggagcatttagcccatttacatttaaggtgaatattgttatgtgtgaatttgatcctgtcattatgatgttagctggttattttgcttgttagttgatgcagtttcttcctggcatcaatggtctttacaatttggcatgtttttgcaatggctggtaccggttgttcctttccatgtttagtgcttccttcaggagctcttgttcagcaggcctggtagtgacaaaatctgtcagcatttgtttgtctgtaaaggattttatttctccctcacctatgaagcttagtttggctggatatgaaattctgggttgaaaattcttttctttaagaatgttgactattggcccccactctcttctggcttatagagtttctgctgagagatccactgttagtctgatgggcttccctttgtgggtaacccgacctttctctctggctgcccttaacattttttccttcatttcaactttggtgaatctgacgattatgtatcttggagttgctcttctcgaggagtatctttgtggcgttctctgtatttcctgaatttgaatgttggcctgcgttgctaggttggggaagttctcctggattatcctgaagagggttttccaacttggttccattctctccatcactttcaggtacactaatgagatgtagatttggtcttttcacatagtcccatatttcttggagtctttgtttctttttactcttttttctctaaacttctcttcttgcttcatttcattcatttgatcttcaatcactgataccctttcttccacttgatcaaatcagctactgaagcttgtgcatgtgtcacgtagttcttgtgccatggttttcagctccatcaggtcatttaaggtcttctctatgctgtttattctagttagccattcagctaatctcttttcaaggtatttagcttgtttgtgatgggttcaaacatcctcctttcgcttggagaagtttgttattaccgattgtctgaagccttcttctctcaactcatcaaagtcattctccatccagctttgttccgttgctggcaaggagctttggaggagaagaggtgctctgatttttagaattttcagcttttctgctctggtttctccccatttttgtggtttttatctacctttggtctttgatgatggtgacatacagatggggttttgatgtggatgtcctttctgtttattagttttccttctaacagtcaggacctcagctgcaggtttgttggagtttgctggaggtccactccagaccgtgtttgtctgggtatcatcagcagaggctgcagaacagcaaatactgcagaacagcaaatgttgctgcttgatccttcctctggaagcttcgtctcagaggggcacctggctgtatgaggtgtcaatctgcccctactggaaggtgtctcccagttaggctactcaggggtcagggacccacttgagaaggcagtctgtccgttctcagatctcaaactccatgctgggagaatcactgctctcttcaaagctgtcagacagggatgtttaagtctgcagaagtttctgctgccttttgttcagctatgccctgcccccagaggtggagtctacagaggcgggcaggcctccttgagctgtggtgggctccacccagttcgaacttcctggctgctttgtttacctactcaagcctcagcaatggtagacgcccctctcccagcgtcgctgccgccttgcagttggatctcagactgctgtgctagcagtgagtgaggcaccgtgggcatgggaccctccgagccaggtgcaggatataatctcctggtgtggtgtttgctaagaccgttggaaaagcacagtgttagggtgggagtgttccaattttccaggtaccatctgtcacagcttcccttgtctaggaaagtgaattccccaaccccttgtgcttcccgggtgaggcgacgccctgccctgcttcgactcacactccatgggctgcacccactgtctgacaagccccagtgagatgaaccctgtacctcagttggaaatgcagaaatcacctatcttctgcgtcgcttacgctggtagctgtagactggagcttttcctatttggccatcttggaacctcctatgtagctattttgatctgctatcttagatgtatttctgaaagaacagttatagtttgttcatttgacttgtttctagtcttttagcaaaactgtatcggaagagttcttttaggtgattttgtccaataacctcatcttcttatgaggcttttgatgtcctgtggcagcacctacttactggcactggagaaagtccccagaatatcctgtgattgtattttacatacatcttcactgttagtggactcctagaagacagtcttagtcttaggtcatagataccttttccttccctagtactattcacatagtaggggccaaaagaatgatttttaatatatctataaaatcaggggagtgaattaaattctctctcaaaggccctaagatgatggagcttcttggttaatgcttctgatatatgtttcctttaggtgtgtcttgtgatggaatatgctgaagggggctctttatataatggtgagtgtcattagacctgtctttatctagtggattaaaataatttgaaaaattttaatataaaccctaagttgtttaacattcttcacaatttgccgtcagagtcccaaaagggcataatttttaaaaatctgctaagaataaaaatggaaagataagattctataacattagtatgtgaaatttagaggtctatcaattttttaagtagatggtactttgcatttcattaaaagcatttaagtaaaagtttactttttaaatagattttaaaatatcttcagatttttttctttttgccctctcataactttgagcctcctcattttagaattctttaaccatatttcgatttcactctgctttattttttcttttttttcaaaaaaaaatgtgaaaactcacttcacacaaccttttatttgtagtaatgaaaaaaaactttgtgtagttacattggagaacagagttcttttaccctaaaaataccaaccatatgcagaaatgtattgtctcttgtagcaccagttatataaaacaaattgttacattttattttttaattagtattattttatgtaaacttttacttatatttactgcccatgtgttcatcattgtgatggatatctaataccccattgtcttatttgattgaactacttctggtttttagccattacagaaaatacaggtgcaaacatcttgatatacattgttttgtttctttctgtactgttctctgcctctctcttgtagtagtgtgccataagactgctcataatttatattactttataaaagtctttatctgtttgaaaaaatgtggtaatgtatattgattttacttcaatgtaggaataacatttaatagatgtactattaaatgttaatatcatggcaattatccactcaaaattagtagatattttcatcctttttatttagaagaaaaattaaaaggccaggcatggtggctcactcctgtaatcccagcactttgggaggccaaggcaggcagatcatgaggtcaagagatcaagaccatcctggccaacatggtgataccctatctctactaaaaatacaaaaattagctgggcgtggtggcacacgcctgtagtcccagctactcgggaggctgagccaggagaatcgcttgaatccaggaggtggagtttacagtgagccaagatcgcaccactgcactccagcctggcgacaaagtgagagtccgtctcaaaaaacaaaaagaaaaaagaaagtaaaaaattaaaagcaggactgatggagcatatgtatatgtagaaaaatacccagtcatgtgttctgatagtgcttgcattcacattgtgtcttttgttatatgcaataaagttctttttagtttgtgcctttctttcgcagtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaagtaagttataataatgtgacacccctcagcctcttcctccttctctctcactctcaccaccccgaacccactctctaattcaagctcattattgtacaggagtttctcttttctctatttggcttactcagtgtttacttttaactcaccttcatcatttagtcatttatctaagcttgtattttagatgttgtctttagtgggatttttatttttggtaacctctaccttagattagcatacttctagaatctgttagcctataaaaatctcattttgtgcctgcagtatataatgttgctgttagacaattccttgggggcagagataggtctgacgtttttcttgctgtgtccctaacacctagcacataaacattctacagaaatttgcagagttgttattacttgctctttcagaggaaagtaaaagggcatttcttggcatctgggtagaaattgaaaatattctggattcttcataatgtgaatacttgggactttaaaaaacttataaattccttagataagtattttaaaagactaaaactttgggggttttgtttgtataggtattcagttaaagaaaacatacacataaaacatattgtttccttttctctctttttttttcttttatgcacctgtgacacagtaaaaatagtctccacgtatcttctttaccctccccccaagctcccaccccagcacattagtctttacagaagaggtttcccttaggaaatcagtatagtcttcagttattccattctcttgatactggttaaagcattaaaacatcccttctgggtgcaacttgtcactctcaggtctaatctgatatactctacataggttccaactcttagaatcactgttcttgctatgtatcttatctctactcccaaacttaaactgatttctgtttccccaggtcactgataaaataatgtttaagcttttatttttcctgaggctattatcttagttacctgccttaactaatgaaaaaatcacttagcctttttttcttcattgtgaatattcagtcatcctttttccactatattaacagagttgaattattaaagcaaacttatgagaatcacagctcttaaccagcaacaaattgacaaatgatccaaaggatataggcaagcatcagatacagccaaagcattcttttcctaaaagagtctgaacgcatctgatgcaacacccaaaagtatcccttttctcctcgttacagtatgttttggctttggaataaatgattagttattgaacaatatatggagaaatatcttacaaaaggaagtcatttccattttctaacatcttttacattgcactaattacatggtttaaatgactatccctaatcttcatccaactacaccccatgaattttaggtttatttaatcaacctagttagaccagatatatccttctaaaatcatttgtagatagagattctccttttgctagtaaataccattaacatatttacagaaggtctggtctaggtcatttattccaggcctctccatgattggattcatcttgcaaatcgtctttggagcccctggtatacaagttggactttagaatcagaattgattctagttcagaaagtactgggtaaaagaaattctttggaatggctatgattttatatataattggacatacatgaatacctgctatatctttattttttaattatttttattattattattattttttattttgagacacagtctcgctctgtcgcccaggctggagtgcagtggcgcaatctcagctcactacaacctccacctcccgggttcaagcaattctcctgcctcagcctcccaagtagctgggactacaggcatgtgccaccatgcctggctaattttttgtatttttagtagagacagggtttcactgtgttagccaggatggtttcaatctcctgacctcgtgatctgcccgcctcagcctcccaaagtgctgggattacaggcctgagccactgcacccggccaatacctgctatatcttattgtcagtggaaaacctacagattctgtggtcaggaagagttcctcaaaatggtatctaaagaaggtacctgatgatctagggaggtgttttatacactatcaagttgtgcttgtgcttgtattttatcttttgcaagtttattcacatttacattagaaattaaaatgtgtttttaatcttaacagtgtgaaagtaagcctacaaagataatttaagttcagatttcagtgagccctgaatttcctgttcaaggctggtgaacttttgaagtcgagtaaaggagtactaacataaaactcattcaggaaaattatcttgaatcatcagaaattatcttgatatcttgaatataccagtataaaacaaggaaactagttacagagttcttataattttcttgggtaaaaagtgtaagagtttgaacaagaacattgagatgcgggaaaaaagctttgttgaagtacatatagaggtatactggatttagcattcttttcactggaatgattatgagagtctttttggtattatggaactgtgaatagtagtttatctgacttattttagtcacattggactaaaagagaagaaatttccaaatagtctctccagatgtaaaaagtttataaaacttgtaattaaaatgaattcctatgtactgctattggatattactacaatgtgatggtgcaaattatattacccatttctatttctctttgtcatgaaaagcaaaaccttgtaagtaagagtatgctacttggtgactgtagttgggtaatagtacacctaggaaagtccgaatcttaagttcagaaaattttccagaaatctctcattaggtcattttagctataatagatttgtattcctcccacacattcatagtctaagcacaaaaatggttttgggattgaacatttttagaagtatcttcaaaataaagacattaaattacagaccatttttttccttctatattggattattttctttatatagtgttactattttttaagtaatacatatttatgattaaactcccatttcaggataccgtaatgttgacctaacagaagttttttaaaccccacgttttattttggccagatagaagtatgatcaggaaagattttggagctagagatgaagacatcagaatgtgagtctagcagccttccaaagagagctaggttatggttaattaatttttgcttattatttctctgaactattaggcttttatagtgaccaagtaaattagtcatttcacagaagttgaatgataacattcattttgcttaaccttttccatttccacaaatgtctcttcttttattgtagaataaaatgttggccttgtaacttttgatgttttttgtttttttttaaacagcttactgctggttgcaggggggacagttctaaaaatttgtgattttggtacagcctgtgacattcagacacacatgaccaataacaaggggagtgctgcttggatggcacctgaagtttttgaaggtaaaatggcaaaagtatggtatgtttgataatctccctcactccttgtgaattcatatgtttttatagattttccccatttccatggttttatttctgcataatacataaagtatacaatgaaatctaaggggatattaaatatagtgttatatcctaaattttatagtaagatttaaatcttctatgcttctaagcatatgtacagttgatcctcattgttcaccaatttcttaattgcaaaattgcctatttgctaacatttatttgtaaccccaaaattaatactcatggtgctttcatggttatttgcagacagtgctttcatgtactcgcagacagtgtgcatgcgctgagcagtgcaaattttgagtcatctaacgcatgcttccagctgaggttgaacaagacaacgtttttccgtcttgtttcagctctcatgctgtaagcaggtgtccttttttgtgctgttcagagccctttttcatttttgtgatttttgttggtaattttgctacttaaaatggccctcaagcatagtactgcctaagtacaagaaggctatgatgtatcttaacagacaatatacatatgttaaattatcttcattcaggcatgagttacagaaatgttgactatgagttcaatggtaataaatcaacagtatatatgaataaggtgtctttaagcagaaatacgcatgaaacaaggctatatattgatcagttgacaaaaacatggtgaccagaggcacacaggaacctacccctgtattttccttaggagcagtgattcagtgttcactaattcagtgttctcagaaactttatagaacataaataccaggaataatgagaattaactgtgcttttgtattggtttcctagcaattaaaaattgagagccctaaagtttaaatgaggatgccttaaaaagaatgcaaatagctgggcgcggtggctcaggcctgtaatctcagcactttgggaggctgaggtgggcggatcatgaggtcaggagatcgagaccatcctgtataacacggtgaaaccccatctctactaaaactacaaaaaattcgccgggcgtggtggcgggcgcccgtagtcccagctactcgggaggctgaggcaggagaatggtgtgaacccgggaggcggagcatgcagtgagccgagatcgtgccactgcactccagcctgggtgacagagcaagactccatctcaaaaaaaaaaaagaatgcaagtaattggacagaaataagatactaagaattacaaataaatgtcaagcttatatgtttaccttcttttatacctccatatgtcactgaagttttaaaagagttgtctgtaaattatatgctaggtttctgtataaaaacatcaaattatcttttaaatgaaagaagttgaactgaaggtatgtgatttgtatgttaggaagtgtaaatgcccataaaattcagatacattcagttaatcagactctggttatagcttatttctttcagttttgatgactttaaagggttttctgtttgtttttagccaccccagaggaagagaaattgcaatgcaactagtcacctgagtggagctcttttgccctaaaattcaatttagtaataaatgaataatcaggtgttatattacacaagattaaataatgcctcctgtttcatatacagaatgtatacatttgacattgttttaaaattatttacttatttaatatacctttatgtgagttaaaatgacccaatgttactgtatgtggagagcaaaaagatttgtttatacaaaagattaattttattgctctagacaacccttaattgtctagagcaacaaaatgcagactgttaggctgtgtaagtttcttcatttctgaaagatgtcagtcaacctgtagcccaaattagactgtagcatggttgtagtgctatattacagtgtactgcttagcatgtaaagctatagctataataattgttcattcttacagtgagttgagtgtttgtttgtttttgggagattatgacgggtgcttattgtgctggctgattcaaccacctacttagtttgtaaattttgctgtgtaactcaggttatccataattttcgttacttacaacgtaatgtttaagtttataaattaagaatttcccttcaccatatattgaggaaaaaactgtaacactaaattagaaagttcttctgctttgatagcagagtagtgctgtctgtcagagtgggaagaaaatttaagattaaaatgtaacagaaaggaggccaggcacaatggctcatgcctgtgatcccagcgcctcgggaggccagagcaggaggatcagttgagcccaggagtttgagaccagcctgggcaacatggcaagaccccatctctacaaaaaatttaaaaaattaaccagttgtgccagcgcatgcctgtagccccagctactcaggaggatcacttgagcccaagagtttgaggctacactgagctccagcctggatgagagtgtgagatcctgtctcagaataaaataataataaacaacataaaggaatgtacagatgtttcatactctgccccagagaaagtatcagtctaaatacataaaagtcaagtcctgtgcctcttgatgaaaaaactgcctcttgatgaaaaaagatagaaaataactgagtttctgaagtagttttttagtgtattgttgatacttaattcatttaaaaatgtacttgttgaaaagacaaagtacttcagaaagagtagtttcttagttctacatgtgacagcctcatttttatccctgatacccattctcaaaatttaagccattgtttctgtaagtcatgtggaaaaatagtctttaggttatatactaccttttttttttctaggtagtaattacagtgaaaaatgtgacgtcttcagctggggtattattctttgggaagtgataacgcgtcggaaaccctttgatgagattggtggcccagctttccgaatcatgtgggctgttcataatggttcgtaaaaagaaatttttcttaaaagtactttttgtgttttctacttggaagactactcctgtccccttccctaaagaatatcatttatctctaacattaaaatgtacaattctttgttaagagactgctttgctattatcagactctgccctgtccctgccccagagtccagcagagcaggattgagagtagtcctggtctacacatgcggctgaggatgttcactggctccgctgattagggaaaggccatcagtacgcaacctagacagttggctctctcttagggagaagcatcaggctggatcatggaaaaaataaaaaaatacatacataaaatctctgacatggttaatataactggagagttatagcccttttctcctgaagaagcaagggcctcatcaaggagaagaagcaaagaataataatgcttcacatatttttcctgtttatattctcacccacccttagaaggtgagtactgttgcctcattttacagattaggaaactgaggcctagagaggttaaataacttgcttaaggtcacaagattagtaagtggtagagctgggattcaaatccagatgcttctgacttgaatgctcatatcttaagtcatattgacttatggactcaatgtccttgcatctgtcctgtttcttttatagttctggtaatgttgtttttaaccacatatgatgttagaatgcatcctcttcattagtaaagttactttacatttgcttgggaaaatagcttttcatgaaggaaaattacttaccttcttaattttagcgccactcttagttatttcatttctatgccttgtttataatcatgtgactaatggccattttttacattattccacaagtctaaaaacaaatgtctgcctaattatttaggtcattcatagatttatcaaacagtaccatcatctgagtaatcttagctgtttttaccagtttcctatactgcctttaatattactaccattagtatcattgtggagactgttcagcattgaccaggacagcttgcttgcttgctttctatcagttgtcagtaaataattgaacgtccgtgaagtaaagagtaaaagaactaacttgttaattgataaaattacaaagcacttttattactccaaattacagatcttaaactacaagatctataaaataaataccactttggaaatacgtacaaagagtttgcatcattctttgggtaaatacattcttccccccttcctctcattttcaattgtaggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagtctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcgtaagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggtaaatggatagattggaagagtattgacttgatttttctttcatctctattcccatgaaattataatcaggaagtaatgaataatgtccccatttgcattttaattccttcatttcatatgattgactgcaatttgagtttacaggtgcgtcattcttcatgtaggtaccctgattaaagagttattgaagacctgcttccaagtcttagaattcctacataattatgaataaaaagatggcatattgtattacagtgaatgtcattcttaacttgaaaaatcacttttacatgcatactactagatcaagtagtattagaaattattgtaaatgtatttaaacatttcttcatcacgaacaccctagtttttgttctcttctacagaggctctgatttaagaagctatgttaaaagttccttagttttccgaaatgtgaagtagtagtgggacatgtaatttgtggtcatcaaaaagatagtagaaataatactgtaacttagaaatattgtacttctcaaaatatagtggcattataagcatttcattattaattgaaacttaaagatatgtgtgtgtctatatgcacatgtatttaccctgcatttattgaaaaatacttttactgatctatttctcccacctcaagaatagttttatttattttaagatggttactgcttggctagttattctcaaattccagttttactgaaaatattttgagttgctctgaattctaaaatgtacttctctaaaattctatcatttgtgtctcccacgtcctctaaactctctcttcatttccttactgtgaccttgaattttttgagcctcccaccttttcactggtcctcagtcctcttaggtccttttttctttctccctccacttaattccaatcaactattataattcttttgggaataattttcatctttctagcctctctctcaagcttgcttggctaaaccacaagcctaatgaaagctgacactcggcttactccttgcctgtaccaatgcagctgagtgtggctggagatagcacaggtttactatcctcacgtgcatgtttagtgctattggacagttgtactgtattgtagttcatctctttcctcctatatgtcttaattttatactgtagcctctcctcagacttcaaacacctcctcgccactcctcactctcagctgatcttgtttgctctttctctgagaaaattggagtaatcggaagacagcttccacaacatctgtgcccatctactctgctttcttctgttactctggctaaactatccatacttctggccaaaggtgtacctttctgcctgtgcattatatcccatctgctcctctgagcaattctcccctgtctcttgcatcatcagttttagctttctactggatcattcctaaaacatacgtagtctgtatttgcattcactagcttctcttttccccttctttcttgagctgactccattcagacatattatgccagtacttcagaattgttcttgtcaaggtcactagttatctctacatcactacatttaaggaatcattttcatttctcatcttgactctcagtagcacttgacctaattcattactttctccttcttacagacagcactttcttcagttggcctccgagataccatactagcctagattccatcttacatctctggccgtctgttctcagttttctttgctggttattcctcatctccccaacctagaaatgttggagtgcccagggcctgctcatttggcttcttcacttatctgtctgcactcatttccttggtaacctcattcattattatggccttatataccatctgttggctcataatgttttccatcttatacctgaactctatactcatatatccaactatttcctttacatctactagaaactcaaacttaatattttccaaactgagttcctgatacttccttcaaactcactcttcctttagtctttccgcatctcaattaatagccctcagttcttctactagctcaggttaaaaaccttaagttattcttgactattagaagactatttaggcatcttggttccttttttgtgctatccttaagtttctcttaaaatgggtttgtttggatatcttcattagcttgaaaagtcttattttatttctgttcctgcctggctagtttataaaagaatgtaagttacataataccaagtgaagcatttgtattatttccagccattagtcataaatgtttctgcttttcctaggctcattcatggacattgcttctacaaatacgagtaacaaaagtgacactaatatggagcaagttcctgccacaaatgatactattaagcgcttagaatcaaaattgttgaaaaatcaggcaaagcaacaggtttgttatgttattacaagtaaaactggtaaccttaccagtagtcacaatattatactaactgaaattaattatttaccatcttctattttataaatcctgaattttcttcctgaaacatgcaaaagagcttacaaatagagacacgtaatgagattctcctaccatttattaccaaatggtttttccttctaatgattgctacctttgccaattctaaatccctatctataataatccctaaatgtaatggttgatggttaaaaatgtaaaatgggtatattttggctgcgctgcccagttagaggagttgttctaagtctatcatttcatgctgttcagatttattatatttttgccattgttgatttttaaaaatatttcaaggagtgagtttattcattttgcctgaggcatttaggttaacgaataattggggcttttagctcccagttctagtgactgccttttcataaagacagtatctgcagcttgctttcccttacccctgtagctccctctcgtacaaacttccctctcctttcagagcagaacaggatctatcagaatcccatttgccatcttcctccttttaggttgcctaagattgctaaatctaaagaacttcagtaattcagattgacctgtaattttaacagagtgaatctggacgtttaagcttgggagcctcccgtgggagcagtgtggagagcttgcccccaacctctgagggcaagaggatgagtgctgacatgtctgaaatagaagctaggatcgccgcaaccacaggtaaaaaggaactacaagtctgaagagtgaaaatgtatataagcctttttggccatggtagtttcagttgtcaaaggttttttgtgtgtgtcttatatttttttttaaataggaagtaggtttacaatatatttttctaagttactagcaatagtttatgcatttatctcaaattccaaataaggaaggtatgacttgtaaaattatttggatgagaaagtatgccttcctcatttacagattttatcaaatgtaattctttctgctcaaacatgagttgaaagtctaagtgagaaattgaaattctgccaaaaccagaatattttggggattttcagtgatactactagatttttgtgctgaactcaaataatagcaaatattttgtttcaaatttaacagaaaaatgtattccagatccatgtatgatttgaccttctatctgcttcttcattccagtgacaaaataatagctaagctggttgtggttaatttttttaattgtaaaataaaatatcataattttattagatcttgaaaaagctagcatttaaattccattgttcagttcttaaaattattaatcatggaagaactggtcagcacaaaaacaattacatgttttgttacttaagtaaactgacaacctaattctgtgaccaggtttcattttagtaatgctggtttaatttggacgtttttggttttttgctgattctttccagggatcagggggagctgattttaaaagtaaacacgtttctgttgtggaaaatgtggaaatgtaaacaagccaaaaaaacttacataattaccccactcagagataaacacttaacatttttgtgtatttaccccatcttttaactatgtatgtgtataaatgtatatattcatgtgtatttgcatcttttttaacttagctaaccaattttttaggtctttttttcacttatttggtttttttctaaatagaatattctcattgtgtgtggagctcttttcagaaagaagttgtcaagatggaccatcatactatacttgtcttcaactaatcatgatcattgattttatcagctactattagaatccattagatataacagaatatccgaaataacagtgtctataacacataagcattatttttcacatataaacaagtctggaggtagtgggctctgtgatcttgaagtaactggtctcctatttctgtgctgtaatccctactgtatagcttccattctcaaagttatcctgtgctccaaaatggctgttgaagttccatttcatcacttctacattccaggcaataggaaggaagacatgggggcagggcaaatagacatccaagttctttgaaggaacattcccagatgcctctcttaacaacatccacacatcattggtcaaagtaacatggtcgaatggctacacgtagctccaagggaagaggagatctgccctcttttatctgatgacttttctgtcctaaataaaatcagagtactattgctaaaacagaagggaagagtggaaactggcagaagatagctgtgtctgccacagatgggtcttcagaaactatcaagttgagtagaagtcatcagccactgacaagcccatgagtctccatgagtcacaagtatttctttggagcagggttgtctcactgtagtgtcagatgaaccctactcaccgggacataccctcatgctttgaggaacccttttcacttcagggatgttgttcaggatagatctgccacatactaattgctgtctcaaaactgaaaattgttataataatggtttcatgtcttcgctagtatcatatttctagtcaagcactggttttttattattatttacagaaatgactttgctagaaggataaccacacacattaaaattttgcctaagtgtagaacaaatgctattgtacatcccttgagttttacacaatttaaattttttcatgaattgtcttacttggaaagagtcatactttccagtcttttgacagactttgtgtttactgtgaatgtaccctaaactttggaaaatataataaatatttggtactagaaatatgtataagtatgatcaaaagcatatacatttcacactttgattcaataattattatttaatcattggattttactttatagcacacttcaagaaacacctaacttgaacatgtattcctgtgtttgtgtaattaaaacaaatacgacaacttactttttaacgcctttcttcctctcctccttcgttcccccacccccatcacagatcagtgatttcacttaggtagactgtttctatgaatatatttgaaattttgcttcctcattaccctgcagctttgtctctgttctttttatttttttctgctaattaaaaccagtgtgtaaaacatcttgtatttggtagttgtttgctctttaatctcgccttttctgagcatggatgaaaagttaggtagttctgcatgccattctgcatgaaatgttattaacatgaactatttgaaaatgagtctatttttgtagttaatcattttccgtgttactgtttgtggttgtttgcatgtatactgtatatatgtgtttttgcagcctattccaagcctaaacggggccaccgtaaaactgcttcatttggcaacattctggatgtccctgagatcgtcatatcaggtatcatagaccacctgagttggtctaatagctgtggaaccggaataatgatccctggtacttgtaaaatgcttcttgctccaatttttacaagacatgaaaatggataccttgcatgcagtaattagggagacagattgaaaaactacatttattctgaagcagtcttgaaaagatacctctgatctacaataagtgaggataaaatagaagagaaagtaaacctttttggagaagggagaacaccaacccagaattctaccaacttcctctctacttttaagtgagcacatgagctaaacccagaccttttttgcacccaacagaaagaggaaacaactaattaaaatttgttattttccttggctcctttccttcctcagttactgctttttgggtcccctctagactttctgtcctaacctctttctgttggtagcaagtgaatgtgaagttgagagaagagagttgctaaatagcattttgccttaacctggaaaacaaaaagtaaagctaaatgagatgtgctgttttgcagggtatcttgccaaagaatcatgtaaaatagttggtcaattctgatttttgtgtattatcaggagaatctcataaattacatgtttttatacctaacttacacatggtactttagtgtctaaaattggtaaactgctttatttcttatggtgatcatttcatagaggaatatgttaccatttttaatagaaacttaaatggcatattgaccttcagtattgattaatgtattatcaaaattatcatttatttatccctttaggcttttctctacctctttacccaaaatcttgataaggaaatacatattttccacacacgttcatgagtgcgagttggatgaattcttcagcatgctgtcctttgcctgtgattgtgtttttagcagtgttgataattctagttgaatacctaatggttattttctcctctactaaactgaaaactatgtaaggatagaatccatatctttgtgcattattttgttgttgttgcttattattgattgtatcagcagttgctggctcagtgcttcacatattaagcatattaacatagtgtttaataaatacatttattaaataaatgaacagacctattgagcatctcccctggtgagaaactagcatacaaaaatatgaattatactattcttaggtgccattttgtctgtataaaactatcttatattaattttcccctggttatcaaagtggtttcttattttacaacatcattactattgctattcaaagagtagagttaacccatttttcacatggtaatttttatttattgaatctggactgcttcagaaattaacaaagagatcattttacatggagatcagtttacctccatgcggaaaggtactgtgtataagggacgtactttaaagaggtggaagcatttaaacttacccgctgaactgtgcttcccttaaatgtttgagggaatcaggaaaatttagacagatggcagtgtaatcttatgactaagcattaagaataaatttatatatggcagcgtagcccacgctatacaagataatgggggagggaaaaataaggaaagaataatagtttataactgtcaggtactactggcatctagtgggcagagaccagggatgctgctaaacatcctgatgtgtaccaggcagtcttctccaacaaagaatgatccagcccaaaatggcagcagtgctgaggctgaaaacccctgattagatgttctttgtgccctacaaagtagcttaaagtacatcttattttacctttatacaatcttacaactaggttatcggatgaaattatagctgtttaacagacgaagaacttagatctgatgatgtttagtggtttttccagaatcatatagccaggaccccaacccagatcttctgactccaagtcacatccattttttgttcttttgtttaagtcagagaagctagagtaatttcttcttgctttctcttagtgttcacattaaggagagctcttcagccagggagatcctcttttatgacattgggcctttatggaatcaggtaaccttaattctcttaattgccagagcagcagtgctattcatatgaaaatattattcagtaataccttttattaaatattctttttaggcttttcccccctcagatatcaaacattaacttactcaggtgcactttctttaatagaagaatacaagctgtagaattgacactagtggacataaaagccaatcatgaatgtgctcataggtaatgtttttaaattaaatataaaaataccgcccatcctttgggaatatctcaaatttcctacatgacattttaattgtaaagaagggtgatacttaatttccaaaatttcttaatactttctagaaattgttttgttctaagtggatttcccacaagctttatggtattagcaaatacttcttgatatattcaaactgtttaattagcattaaaacccaattgcaaggattctttttaaatatagctttttaaagatcttatttacatggataagagtttcgttaatacttccctttggccaagtgcaatgtactgagtctaatgtacttcttggaatgaactacctctcttaataagagcaatccttcaagcatcacaaaaaaggttttgtatatatatctttaaagtcactaaaatgtctaacctagtcataggtaaagaaatgcaaagaccctaatcttgtaatcttgttttttgctcgctcttcaaaatgtgtatactatgccatcagtcaaatgtggaagaaaaagcaacttagcaaaacagcactatttatcaatttagtagtctctcagatcatacagaaattaacctttaataccttaggactccctgtgggtcagactgtacaattttttatacctcttctaccatattactggctctgaagaactgacaaacttttgtacggtaacccttccttctttccactgtccatctgcccttaaaagagtgagctttatagattagcctggctcctttttaccaaggaagacacgcagctaagagcaaattaccagtagagtgtgtgacattttgctgactcttcctttgtagagaaggtcctgccaagtagcagtgtgctacctaagcaaagtaaatgtaaatgtggaagtttcttgcccagtatttagaccatatgaactacagttttctaatgcatttgcttgctggtaagttggaagggacttcgagaaaagaaatagattttcttaaatgttttttattaaaacttgagttttaaaaaccatatcctttctcctttcagccagtacatctaatttgttacatttatatttgaagaaaagggaataggtagcagattattggattctttgaagtttttctagattttttttgttctaggactttaataagggcagtaagaacacagatcattgttttgcatggattttctttactttttcccatattttctttttgtcactatctaagcttccaagaatctatttttcacccaccttcatctcaagtacacaaatgaaatagattattgggattgtgaaactatgtaagacattctaatgcagttcatctgatgttagaagaatacctaaattttacatttcttttaaaaatccaaatgtcaaagaggaacaggtagaatgcctaaatattacaaaaaaagaggaacaacctttttcagtttaacatgtagagtaagagaataagtagttaagaaagcgaattatttttcatgcttgtagcatcagtaatggaagatgggttgttctgctctggagcctttgtgtgagtagttatagcatttaaggaaataaactgtaattataatgcattctaaaatctactggaaaaaaatactgtcatatacatatatacttaccacctataaaagatttaattaaacattagtcttctgcacttctactctgatataaaatttgttgtacatggttcataccagcttgattgcttttataaagtgaaatgagtttcccaaatgtgatatgcaaaagtaaaattttctaaattacagacatttttaatgctattatatcatcatagataaatttatttcttagttcagattagattataatgcttgatttcaagtacttgaaaaccatccattctatagatgaacattgccttgaagtgcttcaatttgagaaccttgaacagtgttgctttagtgtaccttttgttatttctaagcctaaaataatatggcataacattcgagagcaataaaatgccttgaccaaagaggattttctgtcttacatactgttcttaaggatatgcaaaagaagattgaatatacaaatgtttttgagtcagatcttactgaaatagataagatttttgcctagtttcctgaagaacctgaacttaattgatatttattgtttgttatatcattcttaaagctaaaaagaaaccttaggtgtccttatgatttcagccgcatttagatctcttaactgaataaaaaacgcgtattcgcttttaatttcagtcaaggacgtttagctctattgtatattggttttttactaacagtatgataagtagtaaattggagtaagtagaatgtagagaggcccaaacattttaaccgaaaaatagatgagtagttaggcttctaatacttgtatcttgttgccctccttcagaagtttcaaatgtcaggtattggcaaataaattatctaggtggggagggctttatagaatgcttaaacaactggaagcagagatgcttttcaaggacacctgagcactattttgctttctccaccaggatgaaaatatcacttttttaatagtatatttggttcaagagccggtcgataactaatgtttgtaaacctttctttaactggaagcatgtaagttattaaatatttcctccagactactgcagcaccaatatgaagaggcaaagagagaaagaattgagtttttctagatctggcaagttcttacctagcacagatagtgtcattagcagatgtaagcctttgatagggatcctagggctaaggggtgctatactaagatgtactgtactagtttctgtgtatagccacctcactttcaataaaattctctatttgtggcatattaaatagggaagttaatctaactttataatgaatatttaggtggcctttctgccatattgtatagtctaccaagatcactttttgtaatctaaaaaattcaactctaagctaataaagctggtttattggaaagcaaataaaccacctgacggacctttccagtgaaagagccagaatttgttaaaattagtaaagaaatacgaaactttggcagcctaaattagaacatatattttaaaattacatgttcagtttaccatgaagcagtaatgtaatgctagtgtatcatgctatgcatttttttaaatcttgggtattttacacatgaagagaatggtgtcccataatgtgtaatattcaaaactcgtgaatctcaaaatttctaacatttaggttaagagaagtctccaggaaaatgtagtgttgattcttacatgaagacagtcttcaggaagttttaaagtagaaaataagagtagtgtaagtcaaggaaaactatgagcttaactgataagaaaaattacaggagtggctgtctgggacctaagccagcagtctctggaagaaacccgggataacttttaaataccagctcaggaaatcagttgtacttaaaagagcagcttttttgaagaggggctctgttttaatgacattactgtaaaaagaatggaactgacccctaagttgctttctatttgcggtgggcaggagtgcagatttagtatgcactggcaatgtgatgtattcttagaagtcattctaaaaagtggaatttgttctctattataagacatgaacgttccagaattcattacagaatgaaatactcaggatagcatatgcaggtttcagattccttgatcaggcatctgtttacatcatgctgtcctcatttctactactttttccatttacactaccatgtataatataggtatgtacatatcaaaggaccaaaaaaggtaaaatgagtgaatgtctaaattagtattcagttgcaaaaaacttcagaatcaattcaaatttactgagaacacacccagtaattttcatttgaagtaataggaggttgatttttcttacattcatatttctaaattatgacttaaaatttaatattggagcaacaagtatttgttgattgcaatcctgttttgctttgtctgaactatctgccagatggtttctgccatggttgtgctaattaaaatgcattgcctaatactgcttgctttgattcatgcagtagcttaaagatttctcattttatggcatttgttaactgtcagctcttctttaccttacttccttaaaaggttttacttcccttttctcctatccttccacctaaatttaagttcagtttttgttgttattgcaatggtgatgtaatggtttatagacacatgtgtcgggtggttcctcagattaacaaatgttgctgtgttgctaatctgaaaagagaattccagacacttttacaagcctgtctcatcaccgctaattttagaatgaatgtgttgaatgaaatgtgcctaaaattgcttattagtcacggttgtggggatcctttttgtccttgggaaacaggggtagttgaaagtattcagaaaagtaatctagtggatctaattcaataaatgcacagttttgttgttttagtttgtaatgaaaagttgaaatttttggaataaaatgaaatttgaagtaaatgtgaattcagataatgcaaagaattataaaacgtagcttaaaatggaaaaaaactgatgatgtcttacatttgcaagaggagttacaaatttgagtttttatattcactacacatattattctattaaacattcttattccattgtaaggtccttttagtttatctgcagcataataatggggtcatgtgggttaaggtgctaaattatattgctgattggttttaaaaggatgtctctacgaaagattctggaagtctaaaattttaagaatgaattctgtctactaatcgggaaactacaattagagtgagtacatgttctaagtgttgcccactagttgagaaattacgtaatacagatttcagagtcaaaagaattttgagtattgtatcagctgttactcagtattttggtgtttccttttagacagctgatctctcacgttagaagatactgcataaacagctttattcccaaataaaagtgctgagtgaagccattgctcaattcattgttttgctgaggacttatatgtgtagaattctctcataaattgatttttaattaaattaattataaacatagaagtttctaaagcagaattaacacaatagcccatttcaacaagctgtatatttgagaacagagtgacagttattaacatccagtaggaaattaagagttgttgttcacaaataataaattactagattctgacaaagactaatggggattaagtaagcgtgactcaatataacaaatttaagcctaagcatcttctaggccctgaaatgaacaaggtattgctgccagttaaagtcagttgtgtcttacaacctgctagctgtcttgctgtaaaaactgtaacgtaaggcccttgaaatagatgccgtcatcagccccagcccccaagcattcatctatttaaacacatgacagaagatggtggaagagagttcagcagctattcatgtggtagaagtggttattgtattaggacatactctgttgtaggccagcaacttttgagttaaaacaccgcagctgtttctcttcctttctttacatctttctcttcttttttttttttcttagcaataaactcacttttttttccccacaaacattttgtgtagatccaaggagcaacaaattccaactttctgctgtagcaattacacgctttttgtctgtttgactagattttagtattttactttttttcttctttttaaaggcaacggacagccaagacgtagatccatccaagacttgactgtaactggaacagaacctggtcaggtaagacaacattcaaattttctatctttgaagaatactaggcagaaaacaagaattaactgtattctactctgcaaaattagttttatgagttgacctaaagttgtgatagagaaattcattgcacctgaacttaaatacttaggggggaaaaaaacataggtgccattgttaatttaacttgaaagataatttattaaagtaggtttattaaactccatggaaaagtaaattgttcattagcgctgtatatatgttatatggttttatgtatgttttaataagtattcaattttataatttaacaatttatcattaaagtgtcctttaaagtgaatcattagtatgtctcctttttactaataagggtagtaaacatttccccaataagttgctactcctctagcgccacgtagggcattacatggagaactctaacgtcttttaacttggcatatccactggattaatatttttttcaaatatccttaagataacatttactaagcaaatgtgtaaactctcgaaaggcttctattccagtggttaagatttcattgtttatatttctggatcctcctctaaactctccttgtctctttatcactgctgctttgcagatgatgcagacagtgttataatttaagccattactgattagtgcagagttttaacccaccaggtatataaaagtagctcagtcattgttttttctgtgttactcagattaatacacttgacatatataatttattatatactatattctgtaaaatgaatgaagattaattataaggtgtttgttttcagctgtacaagaataagttttatgagagcagcataaaagtaatgaaattaagtaatgaaattgttacatattaagaagtattaagtattaaattattaagtattaagtaatgaaattattacatcgtgacccatatttttgtaaaattttagcgtttatatattataaacaatctgttgtaatttatgataatatgtattagtacttgtcatcctaaaaaggtattttattattatatcatttgtataatatacttaaaatttgggagatcctttgtagtcattaataaaaaagtcttttatacccatcaaccaacttaccaaaaaccacttcaaatatttaagtggtgaatatccttgatcttcatttatatctggaaatatgtttatttcacaaaatgcttataaacacatatgtaaataaaatctatatagacacattaatttattatgttttgtgatactagtgactctaaatcttgatttcattatttagtgatagtttttttcagtgcatctgtttttgtaagaccccagaacttttggctgaagtttcccgttttctccccctcagatacttaaaagttttaatcagcccatttagtaacagatagtttgacatctgctatttgctttgattctttggaggtttgatgagctcagccttttaaactctgtttactattgccactgatattccagttatgagaacttctagccaactgtttgactaggaatgagaagcttgtcctaagacatgtcaggagcagctactagtttgaaagcttttctgtagactctagaataaaagtgttgccataattcaggactgatcttcccacaccaagtcttacttatttcttcacaagttccacattatttgagattttcgttgttacccttttaattcacaataccttcaggtagtaaaacgctggaactgaggccaactatgggtgtgggacagtcatttgtggaattgtcatagaccactctgaaagatttggggtgagggagagtttgatatgggtgagggagagtttgatatggcagtaaaacctgttctgaaacaggtgatgtatgaccattgtgtagccacattttaaaactgatccactctttcaaaattatttgtgttatagccttaaaatgcctaatgttcagcttggcatgagagtggcaaatactaatcctaatgtactatgaaaacatttctcccaaaaaatgtatgataagtgaccattaaatcttttaaattactcacaaagatgatattcatttgaggaagaaaagtattcacaatatgtgttttcaaaattggaaggtgccatcctttttgaagtctggctaagcgtgattccatcttgcagaggaaagtaaacttattgtactgtggctcttgactcaaaacataatcttagtaaaaccacttagaatttccatctgtaaactaaaattaaattggttgtttttctgctgccatccatttgagaggaacagtaaatgaagcaagcttcttaattaaaagtaatgatataagtataggtgtaaaagattgcattcttacaacatacaactcactttcaaacatggttttttcattaattcaggaagctttttaaacactcaatagatgtgacttcctagaagctttgaaaagatactgagaaagaaaaaagcagtccctgacatccaggaactggtttgacactgtggcctcactgttgttagtagctagccttattctcaacggctggctgtcacagctagagcatgttactgtcttattggacataatctctcagaacaccaatatcagacaagataatgctgagaccgtgataaaaggagacaaaacaagactacttcggaatgttttctaagcacagacaaaaacaaggtcactgtgccacccacaaaatacctaacattgtcctctcccagctattaagagtgactgctgcttctttaccaattacagcttggtcctcactctggactgccctccctgtggaattgcccttgctttctgacagcggccaatctggaacgaacccctccttcctttgagtttccccaaaatcactcaaccaaagcctaaatcctataatacattctttttctaaaaccctcttactgagacaccccatgctgccccatggtaagcattctccttcactgcaataaatattaaacccaactctttccactattggtgtgttcctggcagtctttggctagagggctttgacaataccaataaagcctattccgcaaggacctcatttggagagatcagacttatgcccaaatcaattagaaaactaaagtaataacagcttccatttgttgtgcactgactttgtgccagataggctcttagtatacattatcagaatgttaatcctgttatcaggatcttagtcctgtgaagttggtactttttcacctaatttgcagccaggtaaagtgaggatgagagaaactgacctaagtctcttacttccttatactgccagtaattcctataaccaggttttgaatccagacctgattgcaaagcacacaaactctatactttaatcattctaacttgcatgtgaaactagatgtgatgcatgctgttatagccctagatctcttacatttaggtattttggcttctaatagtctgcattgtcattaattatttaaacagttgttaagtgatgatgaattgtagctgtatcatatcattgaacaaggttaacctatcttgataataaatttctaccaatgactgcacaaatttatgttttatacacctgggtgagccattctgtgtttcactaaaacaatatacattcttataaatgcctgaataccccttctggaattgtattcagtatagatctatattcaagaattctcttagaggaggctgcagtcagtgaaaattacgactgcaagatgatacagttatgattatttagagaagtgggcatattacatttccatatggactttataatctacttttactagtcaaatatgtgactttgggcaagttccttaatttccctgagcttctgcacccttatctgcaaatagggaccataacacccacctcccagagttcttaacagatgtgaaagtgccagggcacacagtagatactaatccatgttgtatgccagcctctccacagtgtgcctcaccgggctcttgatatcacttccttgctctcatgatagtgagaaataaaaagaaaatagcacttggaaagaagtaaaatccaccagcgttctttctgtatcataaggaaaccttgtgtcaaggatcatggaaagtatttgctttaaaggtctcttatcgcatattgagtgatattaatatacattgttattatttatttaagggatgtgatttattatactacttttttccatcttcattctgcacctccttttgtgtaaacaaatgttctggtaaactctaaatcagaaacttatgtaatagttttgaataattccttcttcatagtatacctttctattggagaatagacacgtttcttcttttttttttttttttccgagacacagtcccccctgtcagccaggctggagtgcagtagtgtgatctccgctcattgcaacctctgcctcctgagttcaagtgattcttccacctcagcctcccgagtagctgggattacaggcatgtgccaccacacctggctaatttttgttttatttttagtggaggcagggtttcaccatgttgcccaggctggtctcgaacttctggcctcaagcgatctgcccgcctcagcctcccaaagtgctaggattacagtcgtgagccactatgcctggcctctgttggagaacagacacctttctattgtagaagaccatgtaagaataataaaattctgaaatttccttatgaaaaactgtagtgaagccaaaatagatcaagcctacagacctttagattagaaagaatattttcagtacaaccttcatgtatagatttaattatctgtaactaccataataagtacccatgtaaatccacattaccaacttatacccattttaaaaatatttatattattgagatgttactttagcaagaatatcatagaagtcatcatttaatctctgtgttttgtgcttgtataattttagctactaagatttctgagggtattaaatagcttttaaatgtcagtctaaataataacactgggtgtaaattcctgacttatgaaaatattttcccagtctttcaggtaagatattaaaagctgagctttatttttgtctgtaaaataacttccaattcctttttataaatatagggataaatttctggtcaaaggccaattctggttcatgtctactgatggtaatctgcccctgaggtttaaatttggcttagtattcttttgctgccttaaattgctgtgtcacgtttctatactcttgtgactttcatatccagttcttttggtaagtcaagtttgcctatatctcttaaactttgcaattaatgtggggatagaataagtaattttaaatgtcttagaggaaggagcaacttaaatgagttttaatagtttgagagcatttgtgaccctcagaattttaccagtgattttaaaaaataagtactgtaaaaacttcttcagtagttggttacaagcagtaacataaattcagccacaaactagtttgagttttttcattgattgtcagatgttatgtgttcctcttatttatgccttgtattattcacatactcaaaaactacagttatgccttgtttttaaatatttccttagtttttttatacaaacatattagcatatttttatttattgagatacacatttcttaaaatataaagatttatttattagttaatggatttaaatctaactgtgctggtctaaaaacagttttgaaacttgcattaaaagtgcaagccttatatttcttagtttcatagctgttggaaattacaagtgggacaaacaagcatgcacagaaggtgctaagagtttcttggaaagtagaaggtgaaaagaaaggtgtagcaaagaatcattttgcaaaagatttaagcttaaggagtactataaaattcctattaggtccaacttatttgttttaatattgcagatgttcagtgacctcttttttaaatatactaaatccattctcattttaaaaacctaattattacttctactgtattttgttgatttctcacaactgatactgattcttacatgtcacaaacatgtgtttctctttttaaaatgtgcattagcattacactgactctgaaaccctggtctgccaccactttgaaggaaaaatgcctttgatttataatagcagttataactatgggcatatttgtgtacttgctttcagtcaaagaaagttaaaaagactcaggaataatttcataatgtctatacttgctttgtcaagggtaaaagtatcctaaaagtaagagtgaaacatttcatcactggttttctttggtgtatgtcgttgttattcttatatactaaaggtaaataagcttaagcaccaatcttgtatctgagtgctaatagcttgtgttctcattttattcaatgagtatctattatgtgtttattatatattcagcaatttcccagatcctgggaagtacaatataaaaagtacgcatggtctctgcccttaagaggttataatacttttggagaggagtaaaactttgagactactataatttcgggcacaagttgaagtaggaactgactatacagccaaaattcaaagaagaaaaaaatctcgtgtgaagacatttcatgtacatcatttcatttaatttttataaccttatagatagataatactgtccttattttcctattgagtcttagaggttaaataagttacccaaagctgtactagttagaaatggcagagcacagtcaaactctgggctgtcttgtctccaacacccaacttcttactgctactactttttctcattcacacttcatcaatgagaaacctaagtctcagagaggctaagttacttacacaggttcacacagctgtaagtggcagaatagagacataaccccaggtctccaaagtattagactgaaacatgtgaagttgctgagttttcaactacaaaaacaccagttttatctggttcagttttatgcatgccctgtgcactacgccatattatctttaggtgaatatgaggtcaggattaaaaactgcaagggaaacaggggcatgaggaattttaagaggagagaaaatccagatgggcaaggtaaacctgctgatggagagtcatgaatgccagagtgagaatttcagaattgattcagtaacaatcagtaaacgaacattttgcctgcagtacactgttaggcactccatgtcctcaaacacaaggtctggccttgtacacaaacaaccagagaagtggcaagaatcaccacataatgtagaagaaaacctgagctgggccttacagggtggggaaggattaacaaggagaagaaaagaacagaatgagcaatcttatatggagttaaaaattggttatggtgtagaaaagctttttggaatttctgaagcaatttcagtgggtacccaaaatgaaagtcatatttcatcagtttttcttcaaagttaatttatgatttttttctctgaaattgttaggaaagtacctttcactaaaagtataattagattgtttgtaacacaaaggataaatgcttgagggaatgggtaccccatttttcatgatgtgattattatgcattgcatgcctgtgtcaaaacatctcatgtgccccataaatatgtacctactatgtacacacaaaaattaaaaattatttttaaaaaaacagaaatgagaggaaaacaaagtacctgtcactgtttattatcctgaatccattgtggcttttcaagacctaaaatcatataattttagcactatatggaacacttctcatcacattcttaacccagccccaacccctctccagataaagagaggttgaagtgatctgaagcagacattacagcataattagaactcacatacgatggattctactcaaaggtacttttgtattgcatttcattttacttgttgcagtcttgaatttgagtgtttgtatatatgttgaagctagatataagattcttcatgaatttattttaagttttattttctataactccatgttcttttttaagtctcttctttggtactcagtaacacatcaagaaaaaaaaggtgctttttaaaaagtccttatgaggccgggcgcggtggctcacgcctgtaatcccagcactttgggaggccgaggcgggcggatcacgaggtcaggagatcgagaccattcccattttagtttctgtgtcctttgaaaggctttaatatatgaaatataaatatgtagacaagaatgtatgtaatgtataagttatgaaaataaaatgagcacttgtgaacccaccacccagcttaaggaatggaacattagcaatcnnnnnnnnnnnnnnnnnnnncatttcattttacttgttgcagtcttgaatttgagtgtttgtatatatgttgaagctagatataagattcttcatgaatttattttaagttttattttctataactccatgttcttttttaagtctcttctttggtactcagtaacacatcaagaaaaaaaaggtgctttttaaaaagtccttatgaggccgggcgcggtggctcacgcctgtaatcccagcactttgggaggccgaggcgggcggatcacgaggtcaggagatcgagaccattctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaagtccttatgaaacccattttagtttctgtgtcctttgaaaggctttaatatannnnnnnnnnnnnnnnnnnntggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaatttgtatatatgttgaagctagatataagattcttcatgaatttattttaagttttattttctataactccatgttcttttttaagtctcttctttggtactcagtaacacatcaagaaaaaaaaggtgctttttaaaaagtccttatgaaacccattttagtttctgtgtcctttgaaaggctttaatatatgaaatataaatatgtagacaagaatgtatataatgtataagttatgaaaataaaatgagcacttgtgaacccaccacccagcttaaggaatggaacattagcaatcccagtgggggttggtccctgtgtgttcctcgcctgtggccttccctgtcatttccccaccaaccctcagtgccatgttctgtcatatgtcatgtttccagatatcataaataccttttatctgattaagaagtcctcttcccactgggcacaggggctcacacctataatcccagcacgttaggaggctgaggcaggaggatcgcttgagcccaggagttcaagaccagcctgcacaacacgggcgagaccccgtctctacacaaattttttttaaaattagccatgcatggtgccgtgagcatgtggttccagctactgaggaggctgaggtgggaggattacttgagcccaggaggtcaaagctgcagtgagctgtgttggtgccattgcacaccagcctgggcaagagaacaagaccctgtctcaaaaaaaaaagaaagaaagaaaaagaaattctcttctcatacatggaatttaagtttgttaaatgtcttttttataagtagatgttaaatgttgtcaaatgctttttctgcatctgttgaggttttgtcctttaatctgttgatgtgattaattttattaatggaatttcctaatgtcagatgagtgacctttgcagtcatttgcaaagttggataaactaaactttttaaatggtttttattgcttctacactgccacattatatttgctaatataatttttagaaattttgacttttgtgtctttttatttttattttatttttttggaagtgaggttcagttgtaactttctttctcacactgtccttacatattgatttttactgccttcacagaatgggtcagaaagtttcttctttctttgtttaggataatttaagattggaaaaatccttatcttgaatgtttgatagaacttacctgtaaaaccctcctctgtgcttggtattttctataatgtataggaatttttgaaacttttttttaaagaatgtgttcatttttatagtattgtctccgatttcaaaatactatcttttactatttttcattttgggaggcaaattcttttttttaactaagttagatctctagcttataaattgtcagtgtttctggttttttcatatatatatttagaattaaatattttcctttaaatgctcttatagtcacatccccaagtattagcatgattcacgttaaaagtcagttcaagtactttctaatgtcccttttgttttcttctttgaccaatgagttatttagaagtgtttttcaaaacaaaagatttttaaaggttttgaaatcagtataaaaagtaattaagttatgatactgaaattttttttaactttgagatttgctttatagcttagtacataatcagttttcattagtgtcccatgaatgcttaaaaagaatgtgtattcttcatttgctaggcgtaaagtcacttatgtttagattaagcttgttttttatggagttcaagttttactgtgtgtgttttgttttgtttttttggtctccttttatataatttacagaagaatattaaaatatattactgtggggctgggcacagttgctcacacctgtaatcccagcactttgggaggccaaggtgggaggatttcttgaagccattaggtcagcctgggcaacataacaagatcccatctctacaaaaagtttaaaaattagccaagtgcaatatcatgtaactgtagtcccagctactcaggaggctactcaaggaggatcacttgagcccaggagtttgacgatacctccttgagcttttttactttatctgtttatatgtacagcatataaattttgaattgttggccaggcacagtggcttatacctgcaatcccagtgctttgggaaactgtggagggaggatcacttgaggccaagaggtagagaccagcctgggaacgtagcaagaccctggctctacaaaatattttaaaattaactgggcatagttgtgtgtgcctgtagtcccagttactcgggaggctgagatggaaggatcgcttgagcccaggagtttgagggtacagtgagccatgatggtaccactgcactccagcctgggcaacagagcaagaccctgtctttaaaaacaaatctcactgtgatggtggatatgtcctttttccttgcagttttttgatttatctatttgtatgtacagcatataaattttgaatcgttggccaggcacagtggctcatgcctgtaatcccagcacttagggagactgaggcaagagggtcacttggggccaggagattgagagaagcctggtcaacatagtaagacccatttctacaaaaaaaaattagtttttaaaaaataaattttgaattgttgtattctgaattgaaccacttatcatattatctctttctctagtaattttttggaccctaaaatacattctctctgatattaatataggtaccttatttggggtagtttttgcctggttttctttttttatcctttaactttctgttttctctgtctctgtaaattagatatgtctcttataaatagcatttaattcatcctgacaatctgatttttttttaaatatcttaactggagagtaattcatttacatttattgtggttactgataagtttgctctcttatgttttatttctctttcttttctttcaagttttgagttgaataaatttattcttcattttattattttctttctggtttgggagttatatattaattactacttttagtaaatacctttgaaattttaacattcatgcccaacctagtaaagatctgtaccctcatcctgaacaatatttaaaacaaggagttttaagtcagtgcttttcatgcttgtgctattgttattataattttagtgccatcttgtttgtttgataattctataaattcactgtttctgtcactgaatgttttcagtgtgtagatttatttccctgtttatcactattccttgttgcatcttgatccttctatcaagtaaaatttttcttcttccaaaaatacatgcttgaaaaacttatgtggtaagaatgtatggaaggtaaactcagtttttgcccatctaagaatgttattttggcctctatcttcaaattttgttggctagacaattctagactggcagttatttttcagcactttgaagatattgttctgctttcttctggctgctgtttctgtctcctgttgattgtttcctagaatttgaatgtatacgttccatgttgaactcaatttgtgagcttcctcctatttcttatgctggggatttgttgtggttggaatttgttgtaacctgcatccaatctggaaattttttgtggattcacagttaatacatttctcccttccacccagagccactaacccaagagagacaaatttgtttcctgtctgcttttgtaggtcagattttttttttcctagttgagtgaccttttctctgagagtgaagcctttgctgagttttagctttaagcagaggtttctccagtcttacttccatcctacaaaggcccaaggctttatggtccattcctctgagtgcagcagcctgtgaaaacagtagctctaggccattggtgtttagttgaaattccgagggctgtcagcttaagcacttactagtttcctgatattgttttgtttctaatctcagagtatttcttagtttcttgcaagctcatcagtttttaataggtatcatgcgtgagtgaatataaatttttacatatatataagagaggatttattttgttgtttacaagagttttggggggatctctaagtctcttcttgccttttaatggaaacgttctcgtcattttttttaatcaaaaaatcacattttgtttctcctgtgacttcttcctgtaggtgagcagtaggtcatccagtcccagtgtcagaatgattactacctcaggaccaacctcagaaaagccaactcgaagtcatccatggacccctgatgattccacaggtgaccagtctgtttcttcatacttatgaagttgaatcagtcatgtttatattcatttggccatgtcattactctaatgtttacaaaggcaggcattatactgttgtttagatttttatattaaataaactatttagtaatacatgttaaaataccattttgaatacagagacagagactgccttgccttctgtattttttttaatccagatactaaacatgtattttaaagattgtctgtttggggtttttttccagttgcgaagcatattgaattcttgatacttcagcctgtgattttcctactagattcatcctactagatgatagtagtaaagtcattttttcagtaaccaaaatcggagaatggtaaaaatcatccccatcatcttcatctcaatcttttaaggacacgagatgtcatgtaccttaagttgaaaaaaattctgaccattgaccttttgaattgtttttaactgataagagacaccattttcagttatacaaatattctattagacctttagaaacctgtgatgagttattaaagctccccaacatgaataactaactgttcacaatattagtattaatgtctacctgcctaaaggtagtgacggcatcgtttcattatgggcaaacaggaaatgatgtgccatagtagaattaacttttccctaactttaagagaataccttgataaatgcttttaagtgtacttatgaaattttttatttatattatattaagtcacgaagggaaagatgatctcttagcccttggaaaattaaagcatttgatattttatataagatcgactatgttattaatagtaacaattagattgaagtttaaaagccagctttctgtctttacaaactaaaatacaactcaagtatttatagttatctgatgtggtttggtcaagtttataatttaatttaaaaaattaactgggtggtttttctgtgtgtcatgtaagatagaactatgtttagccagggtgtactctctagttttagtaagtttaaatttagtggcggcaaaaactcctgtttcacccctagcacagcccaacctaggactgtccagagcattcaccactacgcagcacatgtgtagaattcattatagacttgctcctccccagtggtagacagggcaatgctcttgcccagttttatcattaacattcaggtgatagcagctctttttgatttctgaaccccctggcaagggagtacgttctctgacattacagcatttgcccgggtctggtactcaactcagcagagccttctgtcttcagtctacactaatctgtatatgccagtcaatagtgtggcagattgtgacttcatgggggtaaaataaaaaatgtttaaggctctctctcacataactgctacatttctgcttcatatgttgcttctaccttccaactcccgtcccattgttttctttttctgtacctagaaacaccacaaaataccaattgctagaaataatttgcaatatcagctgaattttgtctttgccttgaaatatattgcacatgtgtggctataattttgaatacattttaaaaatggatgctctggtttaagtttataattaattcagctttgcagtatttgtaagaaaaatattgataaccaagctaatagaataaattagggaacagataggtaaagtctttttctttgaaggcccactgaccaaggaaaaaattaagagtgtaaatgtaagttaaagtgacctaattaaatttttttaatttgagaggtttttgtatattttcagagaaagctaaagagcataacaatttaataatcatagccgataataagcgctcttcagttcctatttataatataatgggtattcaaaaagacacacatactgagaggatctagtgagagagagatctagacgcagtagagggagccgcagagggggaaactcactaaagaattttcacctttgcttagtactttgcaaacatgtattaatataaagtgtaagacatggcccattccttgcagtctggttagagtcataatactgacacattaaaaataaacttatactatataataacttactaaatttatagtacaagctgagtgttttgatagttgtaagagaaatcagttcaacaagacttggcatagtctctggccttttcataaaatgatgagacttttctttagccataaagcagaaaggagaaggcagcattccactgaagggaatgcatactcaaagaatatgagatagtaacaagtgttgtgtttgaggggtcagaaaagagagtttgccttaatttaaccaaaccaacatgagctttgacattcaggagaagcaattagatttgattagcaattgaaacacacacacacacacacacacacgcaaaaaactttcattaaataatcttccgatctgtgaccaattattgctagtagagattggaagttcaatatcaatttagtgtaaagtgagaaagtgaaatcccacttctttttttagagagaagatgaaattcaatgaaggaccttaagttccccaccatacaagggctttaattatttgaataacacaatccttggactttttttctactcccagaataccacgcaacactgatgtattaagcttaattctaaaatacatatcagatacagggtgctgatataatgagatatataatgtatcagtgatttaagaaagaataataggaatggaaatcttaaattgaaactttttcaagacacttaaatttttctagtaaatcaggaggaaatcagtcatttttaatcagttttagttttgtggaaagcagtgtttatgtgggagcgtagtttgaaaccactgttggggtgggagaagagttggtcagagaaataacaaattaagtatatttcttgtttagccacttcagaaaaacacacatttatgttagtactgtatatgagccttaagggtaagggtaagtgccttaagtctctactgtttttctgtattgccctgcaatatttaataaacattactttttcaatatggaattcatactatactattttaaattgttctttctaattctccatttagtatgaataataatgataactaccgtcatgtattgagtgcttaatatacgccaggatttgcatggtgttcctcacatgcactggctcatttggtctgatttcgctaattagcttttggagtttcttgagagcacgttctcagtggctttaaaaaaacaaaaacaaaagcaaaaagaaaaaaaaacacctggattatcagttgacaataaattagaagattactgagccagcaacccttcttgagtttttttggattgcatacagtgcgtctgctgtcttcctgacttgcctttatccacaccactccttcaaggagttattcgtcagaaaaaggctgaagagctcactcatttagctctttttttgtctactaacagtgggaaagcaactacttctgaagtagaaaagtctgtattgcttcagagttactctgtttacttctggaactgttctacataaccataaatgttgagaagagactgtcccacgcatctcagtcaagttgtatggcagttttacctcttttgaaatataaacaaaagcattctattcaaataattttataaaattgactgattgtttgaattaatcaacttaactgttttcggcatgacattgagccacaggtttcaacctcattttggttccttactgttcgtatttgtaatatactctcatcaccaacatctcgttttctgcagtgattcttactgggaagggcaggatgagtggtggaggtcacattataatctatataaattgaaaatgatccactggaagagaatgtgtctctgctttctccctttccctgttaaggaacattgatattagcagagttgatatagccttctataaaataaacttagcatgataaagaaaagagatggggagtttgattagatagggtcaattaagactgaatttaaaatataaaggtctcatcactgtttttgtttttaattaagagcttagaagctctaatatattgtgttctattcagtttatagccaacttaaattataggtatgagaatataattgcattctaatatctgataattgaatatcctttttttaacctttagaattcagaaatagactcttcaattaccaatagctgtaacttttaatttacatattatttactttagggaaaaaaagcatttcattcatgctttcttgctgttcgtttataattatttgtgacagaaaatcaataaaatacatgcttgaattccagataccaatggatcagataactccatcccaatggcttatcttacactggatcaccaactacaggtaaaggagtactttcttattgaaagttgacttttttcttcttagagagtttaagttgacaattgtgttgctacctgtcattgtatagtcactccttaatttatccttttagttggcctccttaaactttttagaatcaaatcaaaataattcttttggttaagttaatcaaactttaaattggcagaatcatattcttatcttttcagtcatcttaaaatcctccagtatctttctttagtactgctaagcattacattttcactctttaattttagtgcattaaaacaaaactcataagcttatttctatttaatacatttgtgatacattctcatgttcatagtgactgaaaatgtaaataatatacttcagtgccccctcatgagtatgagggctataaacatcatttagtttgagcctgtttgcagcctgaaatgtcataccagagactacaactccaacaatcatgattctctgtaacagactgttaaaacagcaagaatagatttaaatgctgagttaattctgacaaaaggacactgagattttctagggcatggtttaacacttatttttaaaagatcattgctttagtgctataaaaatatatcacagtctctgtcttgactctcatcttagctagatattgaaatttgatttaattatgttttaacattcctgattattttcagcctctagcaccgtgcccaaactccaaagaatctatggcagtgtttgaacagcattgtaaaatggcacaagaatatatgaaagttcaaacagaaattgcattgttattacagagaaagtaagttattttttatgaataaaaataaaaatacattagtattttgagtttaaaatatgataaggtgcaatgaaaacgtagtttttagaattagtcattaagtatactttcaacttgtttaagctttaagcacccttttactaaaaattttttatgcaaaactcaatccttttgactatcatattagtgctatggaaaataaactggtgctttatacttgttgttttatgttctcagagctgtttagacttattattataaagatttattgttttcttgtaaatagataaaataatttgatttattaacattcagttgtgccttatcttagaaacatttttgtagatacattttttccaggtgtatgtttagaattggattacttattaaaagactgtatttcataactgagtgtttttctgaggagttatagaaactgccttcctccctttttaaagaaacacagcctaatttccttactactacattcacagttcttaaatatgtatgtatcttcagttttcttaagcatgaccttcatgaaattttatacttaggtaactgaattgttggtggtaactaaaatgaagtgataaggaaaaaattttggcaactttatatatgtatgataataggattcccttcattaattttaatctaaataaatgaaagttgtttttttctgaatttgcgaaaagctttctgtatgtacttcaaaaaaaagagagaaaaaattgttttatcataatttattgatacagtgatttaaatggaaccaacctggtatttgaaaggtaagcctaaataggaaattaaatactacagtttggaaatcgtagaagtaattatcaaactgctggcacttttatgttgaaaaagcttgatttcttatttcacttatttaacctatacttttgccatactttaatcatttgaaagaagtattctatgctggaaaaaacaaatggtggattagggtgttggctgtgaaaactatgacagttttaatcaattttaaatactttcagaagtagtattagttagttattttgcttgaggactttttattaattattcatttatatccagtaacctcactttaggaaatgcctaaagatgcatctttttcgggaatacttaatagttcccaaataagagggacttaaataagtttatcagactataaaagaatgagggtctttcctgaaagtgcttgcaaatgtaagtgttttaaaagaagtggtactttgtcatttttctcactgctttaaaatgggaaaaagctttaaattggatagcatttattttaattagattgcaaatttgctattagcttaccactctctgctatagttaagtaggattgtgacttcagaatgtgaatcagtataaaagtagaatgtgaaggataaaaacttcatgatattttcccatagccacatagaacccttcccagccttttttcatccttcctacacaaaaagaggatagaaaatgaaattttctgaaacttttattttaccattttatctgcttcgctaattatccaagtacagttacttaataaaaggattatgttatttgtatgattacactagaagtagatgagagttccatcccagcccataattatatttgattagtgtacctaagatgcaaaatgataaaccaagaataaaaattctcattaattgagcttccatcatcagctactaaggtatgaatttttccatcatgtgtaatattatgtggtatttgtttgtaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttaagatttctttttatgataccaaatgagaaataaaccaggcaaatcagaaggaagttaaagaagtaaatataaattcaacaagtgtcctaattatcctggatattggaatatttgattttccttacaatcccgttctagaatgcctgccacctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttatatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacagatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagcttt

SEQ ID NO: 15774 - DNA, 43307 bp, Human
gtgtgtgcgtgtgcgtgtgtgtgcatgtgtgtgtgtgtaaaatgcgcttcctcaccagaaggaatgatagttcctagttgattctaccacctaggacaggaaaaaacaaaacctcttgttgccagaaattaaaacatgcttcaaaaagctagtgcaggccaggtgtggtggttcacacctgtaatcccagaactttggggggctgaggtgggaggattgttttaggtggggagttcgagaactagcctgggcaacaaagtgagacgcccccacccacaatctctacaagaagaaaaaaagacaaaaaaaaaaaaaaagtaaaaacagctggtgcagacttgaaaacagaggcaggcttacaagggccttttggaacaaattgagcatttagaaattatacttaattgatgtaagctgacactataatgatagtccaaaatgggacaagataaaccatacaaagcagtagctgtaaaacgaaggactatatgatataatatttttaatttttaaaattaatttcacgtacatatatgaatattgtttaaatgtatgcataagtacatacacagtagagaactgaataattctactagtggaaactgtatcaattacaataagggaagattagcaccagtgagcacacttactaccaggtagaggaaaagtccaacactattgcaaaatgagattaatcaaatgtctgcctctacaaagtcaactctggtctcctgggagcccctcccaatattaatatgatgctaataaggcatgcaaaatgttccaacaatgttaacagaccagatatatctatatgtatatttaacaagacaatggtatacaaccaaccctctaaaaggacaattttggggaaagaacatgctgcagaaggtgtgggctgctgggcagctcagaatcttgcatccctattcctgtaagtgctgaggtattttcatattattttaaaccaatccacatatcttgaacatcatttatttcaccaatgaattatttctaatatcaattatgatagctaattaacatcccctagtgaaagtggagattatagtggttaaaatgcctgttgatatatctaattttttttgttttttgagacgaagtctcgctgtgtcgcccaggctggagtgcaggggcgcaatctcggctcactgcaatctcccgggttcaagtgattctcccgcttcggcctcctgagtagctgggattaccggtgcgcgccaccacgcccggctaattttttgtatttttagtaaagacggggtttcgccatattggccaggctggtctcgaactcctgaccttaggtgatccatctgcctcgacttcccaaagtgctgggattacaggcgtgagccaccacgcccggccgatacatctgattttttaaaggccgttttgttgtgcgaagatcattagttagaatgcctggctgggtaaatacaaccgatgactgctgacgatatggaacaggcacaagacttctgaacgatatgtagaataaattataacttatctagaacacaaggtaacagtggaagataatgagccaggtggaagttacaaatgttgccgcaagtagtttctgttactttacgagttctgggagcttctctaacagctttgacaggagtgaatccccaaggctaaacccaaatccttatttgccgcctactcacgcctttgtgaggactacgattcccagacggcaacgctcccttcactcaacttccttagccggcggggagacgcagtttacagaactacctccccaaccgaatttcacacacctgtcacctaggacgcggccgggaaggcctcccttcgatccgcgttctccccattttggggtgtagcttggattcctgagcccagttttagtgcgtggccgaccgggaggccggcgaggcgctctaggccgagcggcttcgtctctatgaccacaaggggcggtccccggtgtcctgcgcgggggcgcggagggggcgggcgtcagttccgcgcggggctgtcggggaaccatggctgccccgagaggtgagaactgggtctgctgggagtggggagtccgcggggggcggcggcgggcgagcatctgcgctggtcagcccctgtcgggcagcggagcaccctggttgcccagtgcctctggggcctggctgaggcgtcaggagtttgcgtggagccgctcccggcagtcagggcagcctgccttccgctgcggctgcagtctccgcggctgactccgcgctgggcaggtcggagtcagagaccgcactgacctccactagctgggagtgggtgggaaccgaattctgacaggccggggctgcggcggacccggagagaggccagggcgtgggtccggggctggaccgcattacccagcgaggcaggacagttcttcaccctggccccgcggctccggtctcctctgcgcctcctaccctgtggatgctcagaggcttaaaggcaggctccgggcgcagatcccatgcggcggctgggccatgcaacaaccactaaagacatcactggggcgtcaaaacagcactgaaatcgtaacgaaaggaagataacagtcgttaacagttcccacctgtatgctgtgtgtaattatagagaatgctgtatgctgctatttggggtggaagctgagatccacctccctcctcctgagggatggcacattcgggtgaaggcgtatttgttgactaattgacatttaaggagggcgagtctaattgactccgcaccactttttgctgagcagtgtgtgtaagttgggaccagaggtggattctttgactgtggtgcattaaccaggagaagttgggcaacacccggattcttgctccacccttcctccatagagcacttggcttcacccttgaataaatattgaacgaatacataaggaatatcttcttgcgtgggtttcaagttattttccctgttgcggggtccatgtttctcatcaggccctgcccaggggcattgtctttagttgcatatgcttctcttatgtcttctttctgtttcatttcaaataagtccaatcttaaaagcctttttttgtagcaacacaggaaataaaagaaaaagaaatagaattgttttgataactaaaatggaatggggatagcaaaattgatccgaacgaaaacttataaattacagaagtcaaatcattacttgaaatagctgcaacaatgtaaaggtttaggcttattgccaatacatatttgttgagccttgattgtaatcctaacaaaactacagtttccatagtttccgaatatccacaaaggatttatctgggacttacagaatttctaagttcttaagtattacaaataatgtccccataaactatagtaaaacataaccgaaaaaaaacattttaaactataagtttcttttgggggacatttccacacaaacactatatgggagctaatagaatttcgtgagaagcagggaacaatgcagggttaagatgtggctgccagttgagttgtgggctagctttatagttactggcattgggtgtgatttgaattatttgcccaatttgaagtgattacatatggacttttgctgttaccctgaaataattgaaattgctaataactgaagttttatactggagaatttgtgaatggagtgaacaagaaatagtttggtctgatgttaaactgccagagaaaatcgtacttaaaaacatttagtatttaaaagttgaaatacgtttaaaaactggtattccatgtcaaagcccaatctgttttgcacatacctaaacttatttgattacccttccacttagatcagtagttattttcaagaatataatatatattcccatatactcactatgcaaaaaggtattttttcaagttaatgacaatattataagtcagaatatgtttgtaggctatcaatatttggtttagtgtttaaatattcactttgttgtttttggaatcaggaacctgtacagtagctaaaataaagtactttttagtttatcagccctaacttctcttatttatgaaagtgttgataatctaggacatgagatggcaaacttttcctgtgaagggctggatagtctcttgtcataactactcagatctgctgttgtagggaaaaaaaagtagcctggataatttagaaacaaatgagcatggctgtgttctaataaaactattcatggacactagaatttgaatttcctgcaattttcacatatcacaagatgttattacattttttatcaaccatttaaaaatgtaaaacaatcgtgagttcacaggcctcatgtaaactggcgacatatatagtttgttcaccctttatctagaagatgggaagtgccttctcttctactgattaaaggttattgctgtatatttttgaagtcatatttcttcccttgtgtaggaaagttttagaacaaaggaagtattatagtgatctccttcacttccttttatataaacactgattttttggctcctcagatcttttggaaagaaagtttaagcagttaaaaactatttcttctgttttactttttatttaaaacctgatatggtttttaaaaattgcctacaattcagaaaatattctttaatgcactcgggaaaatatttatattgaagaacctgtttccttgtaagttccaaccatactgtatctaaagataatctgtttgaaactcctgttttatttccctatgaaaaccatctttgaattgtgattaggctcccaaagcagtgaacaaaatcttacttagcatataatgtagttaaagtagcaggctggagtcacctggtgtccttctggttcttaacctggagttgtcaaagtatggctctggaaagcctaaaatatttgtttctggccctttgcagaaaaatttgctgatccctgtttaaccttgagcctaaagatttgaatggaggtgaaggggaactgggggacaataggtgggaggtgggtgaggaaagtagaaatagtttgatccttgggtgatggcagtacccgagcaggtctgggaataaggaagtatgagggagacttggtacccactgcttatggttttaccaaaggtcttggacaggctctggtgcctgagagatggctgctgctcagatatacttgcaggcaattcttaaattaagtgtttatatgtttcctgcatttctagttttatagaggtgtgttcttaatattcttttcctgtgttatgaattattgttttgtataatgcaatgaaatgagtggctagttgtaagttcttattgtgaaaaagttttatattaagccccactcatttctcaattattattttctttctgctgcctttaaatctagaatatacattgctgcagttggtttcatgctttgcatccacaagtttgtaatcataaaaatatttaaaatatgtgctggggccaggcgtggtggctaatgcctgtaatcccagcagtttgggaggccgaggtgggtggatcacctgaggtcaggagttcgagaccagcctggccaacatggtgaaacctcttccctactaaaaatacaaaaattagctgggtgtagtggcgggtgcctgtaatcccagctgctcaggaggctaaggcaggagaattgcttgaacccgggaggtggagtttgcagtgagccgagatcacgtcaagatcatgccactgcactccagcctgggtgacagagtgagaccctgtcctaaaatatatgtctggcacggtggctcacacctgtaattccagcacttcaggaggcggaggtgggcggatcacttgaggtcaggagttagacaccagcctggccaacatggggaaaccccatctctactaaaaatgcaaaaaattagctggctgtggtagtgcacgcctgtagtcccgggaggctgaggcacgagaatcgcttgaacctgggaggtggaggttgcagtgagctgagatcgcgccactgtattccaacctgggggacagagtgagaccttgtctccaaaaaaacccaccaccaccaccaatatatatataatgtaatttataacatcctgaactagaatcagtacgctacatagtcttgcaattggggcactccctaggaacaaaacttatgcctaattggctgatgtttaaagtcagctgtggtgtgtgtgtgtgtgtgtgtgtgtgcacgctcatgtaattggcaaacattgttttgaaaaaaatttttaagcatgagttttagaaaatattttgtgcttggaattggaaagtatttttaggctataactagtttattaacttatatatacatatattgtctactaagtaatgtctttgttgcacgtattttccagacaatgtcactttattattcaagttatactgcttggcagtgatgaccctgatggctgcagtctataccatagctttaagatacacaaggacatcagacaaagaactctacttttcaaccacagccgtgtgtatcacagaagttataaagttattgctaagtgtgggaattttagctaagtgagtataaatacttatagtgtgttaaattatttttctacctggtgagggtatttgttagaaaattcaagctacatctttatatgtttaattgctctgggtcagtgtttctcaactaggggtgattttgccccccagaagattttttagttgtcacaacttgagagatgctactggcatctagtgggtggagaccaaggatgctgctaaacatcctgcaatccccatgacagcctcacaacaaagatttatccagccccaaatgtcagtactgctgaggttgaagaacgctgctgtagaatagaagttggcaaactatgtctcatgggccaaatccagcttgctccctggttttggtgtaatggagactgactggcttgcaaagcctaaaatatttactgtttggcccttacagaaaacaattattgacttgtgttttggatgaatataataataataacatttcttgagtgtttcctatgttaagtgctaggcactgtgctatgtgttttttgtgttttctcatttacttcttccacattttcaaggtaagtactttacccctgttttattgacgcagcatctgaggttccttaagattacactgttaatatgtggcagcactgggctttgaatcagaaacatcatgcaagaattgtttagctaaggatgtggtataagagagggttaagaattaggggcattggaggagatagacctaattttaatcctagactgagattgtggctgcatacacacttgtaacctctttaagcttcagtttgttcatttttttaatttgagaaaataatatggggtgctgaaaattaaataaaatctaataggtaaattaccaggggaaagatttatgagatggggacctataggagtcattggggcagttaagaagtcatacaggtttcaagatgtgtgttggtgagtgaagggaagcagggaggaatagtgttgtgtgtaggcttttatgtagaaacagacattacatttaaatattgaaatgttacacgacattgtgattgcttcagcttcagcaatgtgtgatgagacagttgataatgcaactgcaagcatggctatcattttgggaaacataccgagtgaaagtgttgaaaattggttctagatcttgaaaaggcttatactaatccacttgaagtagttcgaatatgaaaaatatgtgttataaataaagtttcagtgccacacacaaaaaaacagcactcgaatacaaaattttctttttttcttctcagcaaggcagttttccttctatagaagggtgtgccctcacagatggagcaatggtgagcgcacacctggacaagggaggaaaaggggacttattccttatgcacgtggcctctatggctctgtcgttcccctattggctagggttagactgcacaggctaaactaattccagttggctaatttaaagagagtgatgggatgagtggtttggcgggaaaaatggttatggcagagcaggaaatcggaatgagtcagggtggagagggtaatcagaaaaggttgctttacgaggaagttaaatttaaaagtagaaggcaaagaattgaacatactgacatactgattcttcgaagagaaatttagaactcatatctaacaatcccctcctcttgcattttccttacacctctttctcttcaaacttctttaacatgccttggcttagttctgctcaattttccgaaagaagaagcttctctggataaggtggaggatagttaagggaggttttagtaagtgccatttctatgagcacttactctgcaccaacccacagatgcatggtatgacacagcacccgacaagaataagtacacccattacagctgtgagggaagtaagaattgaggctgttattcctttccatttaccgaaccacttttctagccatcctgtaaaggggtcatttaccgctgagctgctggctaactcattggacagagcagtcagaccttgcaatgcctttgttatacttccattaggggcagtgttgtttgggatgaaggcacaacattcagttttaatcatgatgcaaactcctcctctttctgctaatatcatgtctaaggctatcctattttcccaagccatctggcagttagtccctaattgctcagctattcctttaacagcatctctagtgtagttcataaattgctgttggttataatagatgtagtttatccaatctatgtttttattaattgtgacccaccaaaatattgactcaaatcctgcagctatttgatttcgggctttaaattgatctggtattccccgtgggactccaattgcatctaaatagacatgagagttgaatgacctataaggagcttctctcactttatgatgtcttatttttccttcctctggttgatgaaatgccagagtaaaagggatagccaattgaactagagcataactactgctctaattatttggcagagtgtccagtaaaggtcctccataataccaccatacatccgctcagggatgaataagggcagattgacgggtcacctcttggaagtgcctaacttcactgcatcctgttaagtctccaagaaatgccaaatttttccccgtgtcgttagagacacgaggtaaaattggttttggaagatggaggctggatggcccttgggggctgacctgcagggtgttggacttcaggaaatagcagagaaagagcttagcacaatttgttattccaggcagtagaatcttgaaaaagctaccatgcactccatgtccacttgatttgaggaccatcccagtggaaaggtaacaacctgggcctctagcctaccgtgcacacaagtgtaacagttacttttgtttaaagtgtgaatggaatatttaatacattttaaccaggcatttacatctttataccctgtcaatagctatggtttgccttaggtctcctatttctactactgagaccttgcttttgtcatttggcatgaggcgaggcatagttttatttcgtaggtttgtgaaaggggcagttgtaggaggtagagcagggagaacaaagcgcatcttaaagaagcctatagggtcctttccagtgacttctgctcctaaaccatagaaacgctctaaagtggggttagagttgctagtggtaggaacagtaatggatataggcactgtgttaggaaaggaaaggaaaagatagatagactaagcttttcttagctttaatttggtaaggcttgatccaggaacaatggtccatgattctgatggtaatggtgcttgcttgactcgggtgtgatgtgtccatcccccttctgtggtacaaaccatagtcttggtggttagcagcacaaggtagggtccttctcaggctggcttgagttttccttctttctaccctttgatgagggtgtgatccccaggctagtgcccgtttaccagaaattctaggggtggtacctgtgctaaaagacttgtagttttgagggaaaggaaagtggaagataaaccaagtatataatttatgagaaactgatcttttgttttaaatttggggacaccaggctgggcgcggtggctcatgcctgtaatcccagcactttgggaggccgaggcgggtggatcacctgaggtcaggagtttcaagaccagcctggccaacatggagaaaccttgtctctactaaaaaatacaaaattagccaggcttggtggcacatgcctgtaatcccagctacttgggaggctgaggcaggagaatcgcttgaacctgggaggcggaggttgtggtgagccgagatcgcgccattgcactctagcctgggcaacaagagcgaaactctgactcaaaaaaaaaaaaaaaaattgggggacaccagcagtggactttatagtccttagtgccttcttcctgagaaacttcctttagaaacttcctgagaaacctatttttattagtttttagaccaaagaaagccaaacaccattttatatttgacagtgcttcctgtatgattataccagataagctaaatttcacctttatattagtgtattattaatattaaactcaattttaataaaaccctgtagacatatttatccgattttaatgtctgaccataaggtaagatttccatagactctttttaaccttttataaaatttgttaaagagcagtttagtgttttttagtgttttaagaaaaacccattgtgcttttattttaatgtccagttcacagaaaaactggatgatacccctttaactttagccaatatggttacacacagaatttcctttacaattaacattttaaaacttgcttaaacgctcaaaacaaaattttttttaaccttttaatgtaggtaaaaatccacattctatgcctccttattatccttttaccaaaagtatattttactttcattatacaccttgcacataaactgtttcttcaatagttttacattcaggaggcctaattacttttaaattatacaacatttcttgcataagttcccttttatagcatttttcatgactttcgcaatcttcgacaggcctcaattttctgacttcctgtaaacatcgctttctttaaataaccagttaatttattttaggataataatttaccatataacattctttttatataaattctcccccccctccttttttttcccccaagatgataaccattcttttccaaagcaaacttccttcaggtctgtggactagactgcctaaggccacaagattagaagttaggataatacatattacactgctaacttttggcaaactttacctttgtggaaaaccttgtaagtttggtatttcaattatcctttgctattaataagactttctttagtttaaattaacttagaattggtatagaccactccttcctgattctgtaagtactttaaggcttagctgagtgcaaacagcttaccaactattaggcaattttcctaactctacttctataagagtttccctatcacttactgaatacccgttgtggctttttccctcagtcacacgggaggaaccatctatcgtcctgtcctgaagggagttccttctaggtctggtcggacctttatatggtaattaattaagatttagatcccctgttaggaaacctgctgggttaagggaattatcagtggttaatgttaaatcatctttttctaacagaatagccccatactttaagatttttgagttagtaagttacctttttgtcttaggatacttctgaactggtgaggtgtgctcacaatgaggtttcctctaaaagttatttttctactttcttctgttagcaaagcagttgccggtacagattgaatgcatttgggtcatctgcgggttactgggttaaggatttttgataggaaggctatgggtcgtcagtgatctcagtgctttcaggctgtgcccttgtttacactgacaacaaggtggtattggagtgttatagagtcacggagaagaccttcaattatcaattataggttttaaatttaccctagcttttaaaggaatagggtacactgtttttattacttctctctgtctctctctctctctttctctctctctgactctctgtctctttctctttctctctctctctctgacttcctttcccagtttctctttcctctctgctggtctttccctgcctctgccagccgcttatgctgctgttcttccctctcctccttcccctaggggagcgaccagtgggagtggagtttagcctttctttcccccgagaagaagcgaaaggggagttctgaatatttttcttactactggaggtttctgtgaggttcagccccccacaatggggatttctcacctcattgaggttcaatgtacccctattgggatttttcacctcttttgaggttcaacccctcgtaatggggatttctcagttctttgaggttcagcccctgaaattagcggaaggctcaacccatcaaaccaggggtgtcttccctcgcctgtcctggaagactcaacccctcaaaccagggatgtcttgccttgcctgccgtggaaggctcaacccctcaaaccagggatgtcttgccttgcctgctccggaagcctcaacccctcaaaccagggtgtcttgacttgcctatcctgggaggttgacatgtttcctcccctttccccctctgaaggtcccttgcacacttcccactcatgttgtcctctctggctgctcccccaagggagaattaggcccttcttagtgttggcgtgctggtataaatcccacagcaggatccgccctaagccatatgaggtagctgtggaactgcagagaggacgcactcactccatccagcagtaggacttgtcaccatccacacaacaccacaagcagggttgtctgtgatcattcacgcacacacacattcagccctccagactttgaccaccaaggaagtactttactggctcccgtggtttcttcttcattggtctgtgcacagtcattgctgtggtatgtgaggatcctttacctcaggttgccagccggtttggtttctttctgtgttgctgagagctcgggttattccttgcactgggcgggtcctgatttctcacccctgaggacgccacaagggggcggggtgcacctcctcacaagagagaaccagagaccgcctctggaggggaatgtaatcccagacgagcccctaaattgttataaagttttggtgctgcaaaagaaatagcactcgaatataaaattttctttttttcttcccagcaaggcagtttccttctatagaagggtacaccctcacagttggagcagtggtgagcacacacttggacaagggaggaaaagggggtcttattcctgatgcacgtggcccctgctgctgtgtcattcacctattggctagggttagaccgcacaggctaaactaattccgattggctaatttaaagagagtaacggggtgagtggtttggcaggaaaaatggttatggcagagtaagaaatcagaatgagtcaggatggagaatgaacaggtaatctgaatgaatcagggtggagcaggtaattggaattagggtggagcaggtaatcggaatgagtcagggtggagtaggtaatcagaatgagtcagagtggagagggtaatcggaaaaggtgctttacgaagaagttaagtttaaaagtagaaggcaaagaattgaacgtactgacatgctgattctttgaagagaaatttagaactcgtatctaacagatgaataaaatacatggccagactgtgggccattaagagtgatatgaacagttaagaggagcagcaaatcaaagggcctagagctttataatggtcttttagatttagtgtttgcaaaaaagtaaaatattttccaggtactctgagtgttgtcaattctttgtacacatattaaaattggtaattcaaaaagagtaagtagatgaaaggcaaacaggatgttatctagtctgttaaaacacaggttggatgtcagtgttttatttgctgtgatggagaggcttctaaatatcagaaaataattgttacaaaaaatgttatgagatgatttgttatatgcacaggaaaccaaagttgattcatgtttgaatttatatttgcttgaaaattcttttcccatgtaatgttaaaataattgtgtagagctaaaaaaatgaaattagacttttttctttgctttcaaatcaaggaagactttatcatctcacagaaaggatgacaatttcaggatattatgggaggctgtggaagaattatattagaaataactaaaggtttagaacttgaactttctcttcagaggagaaaaattaagaagaacttagatcttggccaggtgtggtggctcacacctgtaatcccagcagtttagaggccaaggtaggaggatttcttgagcccaggagttggagaccagcctgtcaacatggtgagactccatctctacaaaaaataaaaaaattagctgggtgtagtggtgtgtggctgtagtcacagctacctgggaggctaaggtgggaggattgcttgagcctgcgaggacctgcagtgagccatgattgtaccactgtactctagcctgggcaacagagcaaaactctgtctcagaaaaagaaaaaaaaaaatttgaagaacttagatcctgatgattaaaatagtgtatttcccccatatttccagaaaaatactgcagagttagtgtaaaaattagtaacatttgctcaatgttgatttgagttttctggagaatgaatacagggaaaggaaaagaaattactatttaaatggaaaaaaattaaacttcatttaaaactatgattaaatgaagtaaaagcttcttcctttttgcccattctttacactgtgataaagtacaataactttatagggttgatacaaagtattatactagaacttcaatttttttggaactgtgcaaagcttaatctcattatagagcagtccatttggtggtttgtttatttagtatggtctctgatgctgtttgctcagtaatgttctttgcttagtgaatagtcttggctaattgttaaagtacatatattatacgggagtgggaggtgggggcagaaacttatcgaagtagcacctgaaaccatgttttggttataattaaggttcacttagataataacataccactgccatattcaaatttgtgtttcattccttccaaacattggaagcaaatagtcattctaagttgtttcaaggtattgttaataagatataatgggacagtcaggttcacgcattcatttatttagttagaaaatacctatcaaacctcaattatatactcaacactattctagtgttttcactagaacactgcaaattaaaaaggtgtagttctgccctcatggacttatagtctgttggagaaccaaatattataataaataataaataggtgatgttatgagggaaaagtagagggtgctacaaacatgcatgatagagggcctgcatttggattaaagggtttcctctctgaggaagttacgtttaaacctagacctgtcaattgagtagactttaggcaagaaaagagcagagaggaggcagagaactgcgtgtttgaaatccctgaggcagaaaagtccttgactttggtgctgagatgaagcaggagaggtcatcagggtatcacagtagtagtatggacctgttaaggattttagatttaatctgaagtgcattagaaaaatcattgagtggagccaggtgcggtggctcacacctataatctcagcactttgggaggctgaggcaggtggatcacttgaggtcaggagttcaagaccagcctggccaacatggtaaaaccccatctctactaaaaatacaaaaattagctgggcgtggtggcacatgcctgtattctagctacttgggaggctgaggcaggagaattgcttgaacttgggaggcagaggttgtagtgagctgagatcacaccactgcactccagcctgggtgacagagcaagactccgtctcaaaagaaaaaaaagaaaaagaaagtcattaaatggtttaagtgagggactaacatagaacccatgttgagagtcactttgacctctttgagaatgaattagaagtagggaaacaatagaggcaagagataatcagctaggatgacagcacaggtcacgaagagaagttaatggatttgagttatgctctggcagtagaatctgtaggacttcgtgatgggtttggataacctgctcctaggggatatacagggtagtttcctgtgagcaactgatcacatttttgtcaattaatcaatacaataaccttgttttgtgtgtgcttcaatctaaagacactttatttaatgtacattattgattaattagcattgaactcatggccaacagcactataacatgcctgaacaaagcttatctatcacatgtattttctccataatatatagcatatccttcttatacttaggaacatcagacagtgcgtcagccctacaatgcttgggagccatttaaacaaaatcaccaacacaaagcacaaaaatgcaaaaaatgtggtactgaatagattgcacttgtttatgatctgaaagcggaaacaaggcagaatgttaacttgttcagcgtcagccaggaatgtgcacacttggtgaatcaaattttttgccactctgcacatgtctgccaatgactgcaagtgttaccagcattgatttgggggttacagatacattttaatgagtggagaattcacacgtacagtccatgaataataataatcaactatagtaggggaaggaaagggaggtatcaggaagcatatctgtgtttcctagtataaacaattgggtagagttattattatttttgttttttgaaacaggaaaaacagatttgggggaaaaagatatcaacagtttgattttgggtaggtataatttaaagtttttaatgtcttgagacatccaaatgggcagttggattaaatgggtctggaactcagaagagaggtctgggctagagatataaatttgggagttcttatcacataaaagtatttaatctcatggaattggaagacattgttaaaaaacaatgatcgtgtaaaaacaatcttatttgtaatgtcatttgactccatgtaccttaaagattgctgttttctggacaggataaccagaaaccccaggactaatataaagaggaacacatgataggtgtgctctgtttagagaaatggaaggcagcttgtttaagaaacaacaaaggagtgcttgctttggcagcacataatactaaaaatttggacagtacagagaagatagcatggcccctgtgcaaggatgacatgcagatttgtaaagcattccacattcaaaaaacaaaggagtcagtctggtactgaggcagtgccctagaactttgtaagagttaaattaagcaggccagggtaggtataactcaatcaagtgtgcaaattagaatcttcaggtcccaagaatttaagcagaggcaattgtagctccatggattgttcttggtgaggttttggagatctgaagtctagtcacactcacttcatgtgtaagaactttgagcctggaaagggactaattcatacaatctctgactaaaaattttgtgtgaccaaatggatcagcaaggttccagatccatgttttaaatgaaatgccagtctctttttcagaatttgaggtggtagagaggttctataaccaggtagtcctttttggacagaacccatgatggcaatctaggtcaaagggctgagaccccattgtcttttgttctttctcttgcctttaatgccttccttagggtagctgtagatgggttgcatgccatgaggcatggatatcctaacattcacattagtatggtaaaagttttgtaggctgaagggtataactggtttgctaaaacattggaagacaatagcttaattctaattccaaatattttctttgtcctggttatatgctgtggcttggatgtgatttgtctccaccaaaacttatattgaaattctatccccagtgtggtgatgttgggaggcggggtctagtgggaggtgtttaggttgtgggggcaaattcctcatgaatggtttggtactgttttcctggtagtgagctgtggctctcaagagacaggattagttcttgcaggaattgattatttctcgggagtgggttataaagccaggatgctcctcatgttttgctctcttcacacgtgtccacctccccttagaccttctctgccatgtgatgcagcaggaaagccctcgaagaagccagggccatgcccttgaacttctcagcctgctcaactgtgagctttttttttttttttttttttttgtagatggagtcttgctctgtcatccaggctggagtgcagtggcgcaatctcggcttactgcaacctccgcctccaaggttcaagcgattctcctgcctcagtctcctgagtagctgggactacaggcatgtgccaccacgcctggctaatttttatatttctagtagagacagggtttcaccatattggtcagactggtcttgaactcctgaccttgtgatctgcctgcctcagcttcccaaagtgctggtgagccaccgcgcctggccaaattttttttttttttttttaataccagtctcaggtattctttcacagcaacgcaaagcagacaaagacagtatttaacatatttaaaagagaactctattaaacattgtaaatgcacactgggtgtagtggctcacacctgtaatcacagcactttgggaggccgaggtgggtggattgcttgaggccaggggttaaagaccagcttgggcaacatggcaaaacctcatctctacagaaaatacaaaaattagctgggtgtggtggtgtgcacctttagtcccagctacttcaggggctgaggcaggaggatcgcttgaacctgggaggtggaggctgcagtgagctgagattgtaccactgtactctagcttgggggataaagtgagctcctgtctcaaaaaaaaattataaatgcaatttacttgaaaattttaggatatttaacttcttagaagaaatacagacttgcttcagtgaagggtgcctgatatatattgtcatcatttttttttttttttttgagatggagttttgctctgttacccaggctggtgtacagtggcgtgatttcggctcactgcagcctccgtctcctgggtgcaagtgattctcctgcctcagcctcctgagcaactgggacaacaggtacacaccaccatgcccagctaatttttgtattttttgtagagatggggtttcaccatgttggccaggctggtctcgaactcctgacctcatgatccacctgcctcggcctcccaatgtaatttttatttgaaaaaaaggaaaaagatatttctttcacgttggggtaaaagaacagaaggcaacggtgcatatgttgctgtggtctccaagaaaactaggcaaaaaatatgaggaaagcactgaaagtgtattattgctataaatttaaaatgccctagaaaagccaaagaaaagaataatgcccccttttgggactttgaaaagtatttttgaaaacctcatgagtagatgtcttctttagagagcaggtagctatactctgtagaataccaactagtaatcattgtcaaaatgtgttatgtaaaatgccacacatcctcctttaagattatatttgctgccttcagttattcagaattgttgctattgagaatggcaggctgccagagggtgaaagtgttaaggaaacactctttgatgtccagccttagaaacaggtgagggaaacaagctggtaaatacagcttattttcatttcattcttgtacatgttgactaacccttatccaaagtgcttgggaccagaagtgtttcagatttcaggatttttaggattctgaaatatttgcattatattaatttgatacgagcatcccaaatctgaaaacctgaaatccaaagggctctaatgagcatttcctttgaatgtcatgttggcattcaaaaagttttaggttttggaacatttcagattttgaattttcagatttgggctactcaacctttatcttcattttggctgaaactattatttcctcttctttgatgagaaatcttaggctgagggaaattttaatttgccaaaggaacctagaaagtaattgacaatgataggattagaagacaagtttcttgaactctgattttcaaattatgagtctttcagaaaaatgaagtaattaagtatttttgattaagacaaagataagcacagtggcgttgttagacatttcagtagtttacaataattttttctcttaactttttatttccaaatgttaacactttgccatgtgtcttcttcattcaggtggctctataataaaataccatagaccagttggctcaagcaacatttatttcttacatttttggaggctggaaagtccaggatcaagatgctggcagattaggtgtctggtgagggccctcttcctagtttgccgactgctgcctttttgctgtatcttcatgtgatggagagagagatggctctggccttttcctcttcttataaggcactaattccatcatgaggactctaccctcatcacctcactaaacctaagacccttctccaaatactaatcacatttgtggattagggcttcaacatatgaattttaaggggtaacacatttagcccatagcacattacacatacaacaaaacatttttgttttatgacattcttctatttgtgtgaacatgtatagaatttttttctgatttgttttagagtaagatttagacaagatgcttctttgtccctaacgttcttcagtgcatgtttcctaaaaacaaggacattctcttatatataatcaataaaattatcgaaattgagacatcagtactgatatagtactattacctaattcacggaccttatataaatttttccaattgccctccaatgtcctttatagcaaaatagttatttttcttggacttcagtcctgtccaggattacagtttgcttttaattgtcatgtctctagtttcttttaatctagagagttcctccatctttttttttcatgtcattgatattaacacaggccatttaatttgtacaatctctcaaattatgtttattgagttttatgattaaatttagggtttttttgggtcagggatatcatagaaatgatgcgtcccttttagtgcagtatataaagatgtacgtggtatctatttgttccattactggtaatttatcttgattttttttttttttttttgagttggagtttcactcttgttgcccaggctggagtgcaatggcatgatctcagctgactgcaacctccgcctcctgggttcaagcaattctcctgcctcagcctcccaagtaggattgggattacagggatgcaccaccacacccggctaatttttgtatttttagtagagatggggtttcaccatgtttgctaggcttgtcttgaactcctgacctcaggcgatgcacccagcttggcctcccaaagtgctgagattacaggtgcgagccaccacacctggcctaatcctggtttcttgattaaggtagtgcctgctaggtttctccacataaagttaccagttttctctttgttattaacaagtgtcttttggagagatactttgagacgagataaatattctctttctcatcacactttcacctactggttttgtggtctgatactgttgtcaaatgataacttcctgatacttcatcattacctatacatttattggcattctactctagaaatttcccttcttcccccctttctctccctctttgtatttatatgaacatggactcaaggattattttattgtgcaggttagaatccattattatcattattttgatgctcaaaatgtcccagatttgcacagtgggattaaacagtttctttttagcatatcttgttacaggcttttcttgtactttccctgccccaaccctgaaatcatacatttcttcaaggatcctttattccttttttttccagaatggtatttggaaaccagaatctaggcatttggtatacacattgatactggagtatcattactttagacccttttagcagagctatgaaatatatatgcatgtgtatgcatagacacctatctaaatctagttgtgtgtgtgtgtgtgtgtgtataacaaagagttctacattgattgataccacaattttgatctaacatcactgtgttcattctaaacttctccttacccatgtttgttcccttatctaatggtgaggattctagctcccattatgctcaagatgtttacttatttgctcaatcctagaatagataatgagtagtttcagaatttctaatatttacctgagaaaaaaacaaactactaactgaagtatgtatttgtatgtagttctctttgttttagttttacagcatacagtaaaatactgtgttttagaatatttgagttctctttttctccaagtataattttgtagacagttgtttttggcttctgtttgtatttaacttgagattccccccatccttgttgattatacttacaacaccctggaagttttggcatgtgaaattatacttatttcaataagaagttagaactggaaaagaaaaagggagtgtgggaaggaattaatggatggctactttgatagataaggttgacgtggtcaaagtagtaaatgttatgtgcaagagattgctgggccttgtgtgtgatgtacactgtaccccaccttccttttttttttttaacacaagtattttaccttagaggtggttttatgtcagtacatagaaatctatctcattctttttaaaagctgcatggtattccattatgtatagataccatatataccagtctgtactgatgggcatttgggttgtctccagtcttctactccaacacaaagatgtaataattatctttgtacatacactgttgtgcatatgaattattatatcagataacttttaaattaaaagagaaattagtaaattctgttttgagggaggggcagattagcagttggatattgcgaaagctgtacatgtaaataaggtgattttttttaaatatttgaatttttttttttttttttgagacagagtctcgctctgttgcccaggctggagtgcagtggtgtgatctcagctcattgcaagctccgcctcctgggttcatgccattcttctgcctcagcctcgcgaggagctgggactacaggtgcctgccaccacgcctggctatttttttttgtattttttagtagagacggggtttcactgtgttagccagaatggcctcgatctcctgacctcatgatccgcctgcctcagcctcccaaagtgctgggattacaggcatgggccactgcacccggccaaatatttgaattttaagttatcaatttctaagctataatttggttgaaagataaacaatacaacatttaaaagtactttttcataaaattaattactgctgcaattcacgggaaaattgttataatgctttactagactctatcacagctgttaacactaacagtttagatttaaacctgtcattgttagtataaagaaaaggaagtgaaaacactttcatattgccttggaacaaaggaacaaagtcaactttttttttttgagacagggtatcactctgtcacccaggctggagtgcagtagcgtgatcttgacttgctgcaaccatcgcttcctgggctcaagcaatccttctgcctcagcctccccagtagctgggattataggtgcgtagcaccacacccagctaattttgtagacatggggtttcgccatgttgtccaggctggtctcaaattcctggactcaagcaatccgtctgccatggcctcccagcatgctgggattataggtgtgagccgctgcgccagctcaaacaactttttattgtttgctattcaccatagtttataaagactatccctagcaggatgtgtaaatgttaatgtacatacactttgggtgtgtttagtaacaaaccaaatatatcttaactttgaactacatacccatattaagaccagagaaaattattctactgtttcatagtattatctagagaaattaatgtatctgtcaaatacttatagattatccagctttgtttatttctccttctgggtttacattttcagtacccttttgtacccatgctataatgggttcagggtgttggggaggaagtaaaaatcatgtccctcatatgaagggtatttttgtcctcaaattgacctcattattggttttttaacctagcccctcaaagtctttttttttttttcttttttgagacagagtctagctctgtcgcccaggctggagtgcagtggtgcgatcttggctcactgcaagctctgcctcccgggttcatgccatcctcctgcctcagcctcccgagtagctgggactacaggtgcatgccaccacgcccggctaattttttgtatttttagtagagacagggtttcaccgtgtaaatcaggatggtctcgatctcctgaccttgtgatccgcccacctcaacctcccagagtgctgggattagaggcgtgagccaccgtgcctggccaatcaaagtctttttaggtgagttaattatacttaactttgtagatgataagaaatttataaacaaaatttaactttcttaagctcatgagtaacttctgctgtgttccattttgcacagtgacttggtaacctagccaaggattttatgcctcctagtagttcttgttagatcagtagctggaagaatgaggcctacttttgaccaaacagaggtcagaaagaatggtttcagctggttgataggaaatttagtgggagaggcagcagcagaatctctctgcagtcaacatggagcttcagaatttcttcaggtaaccaaaggttgcacagggtctattccaatgataaaaataaaaagaattgttcaaatagaaaatttaacaaggaagactatatctaaaaagaaatttaatatatgtttttgattatatatgctcttttgtcctagctagcagtgtcatttatataattaataaatttgtttttaacagaggtgctcattaaggtgcttgtgatttgatttctaagaaagtaagttgagggccaggcgtggtggcttacgcctgtaatccagcactttgggaggccgaggtgggtggatcacttggtcaggagttcaagaccagcctggccaacatgatgaaaaaccccatctctactaaaaatacaaaaaattagccaggtgtggtggtgtgcacctgtactcccacttacttgggaggctgaagcaggagaatcacttgaacccaggaggtggaggttgcagtgagccgagatcacaccactgcactctagcctgggtgacatggctagactccatctcaaaaaaaaaaaaaaacaaaaaaaaacccaccaaaacagaaaatataagttcaggaaaatggaagaaaaagtaacctttttacaatatattacagtatatttaggactgatcatttgtttctatctctttcatagtaaaacaaaacgatgattactagtgttttctagcagatatattgctcttgttacttttatgtaacttcagtgagtaaagctaaatataagattaagagctgtattcttaataaatacattaacttaagcaggatttaacctgattaatactgaaattatttaccctcttctttaaaactttctgtgtggtgagattcccacatattctttccaatacctcctaaatctcctctactttctgatacttttctgttattctcttttactagttcttttagcatcctctgctttttttttttgtaacttatttcaaaatatcttatgtaacattgctataatctttggtactacagtgatatttgcactttccagcaattaacattctggtataccttggtttctctaatgtctacattagagaaggaaccagaaaaagataccttggccatcctgaccgtgaaaaaatagctcctaagcatccaacaaaaaggatatggccaaaagagacagatctgaaggttaatcctgacacactgtactttactttttgctccactgaaggaaaggaatactcagattggctgctaatttgtttcataagcccttctttttatgtgaaaagtgagggagaagtgataagaaagaaaagagtggggagaaaagggaccacagcagcctttattggtgcaggtatcgtgattatttggagtagcagttggatccttaagtagcccatattctgacaggacaaagagaatcagccctgttttttggagagtcaaaaggtcgtttgttaccagtgaaggcttctaatgtcttatttttttcttttttttaaaagagatggtatcttactctttcacccaggctggagtgcagtggtggcatcatagctcactgtagcttcaaactcctgggctcaagtgatgctcccacctcagcctcctgcgtagctgggatgataggcatgtgccaccactcctggcagttttttttttttttttaagagaagggattttcctctgttacttgggctggtctccaactcctggcctcaagtgatcctcttgccttagcctcctgagtagctgggatacaggtgtgagccaccacacccaccaaggctataatatatttaacaggtggaggtaaagtggcattgcccatagctggggattagggaaaggataaatagccattatattgtagcttttgagggtttagcatgaagaatcttacaccaggagataaatgaatatgggagaaggtggagtgtgaagcatgggcacaaacagccacctctcagcagttccttctgggtatcaccttaaagacacatcatcagtgtatgagtcagcattttagaagggcactaaaacttgcacttcatacagtctgtaaaatttatatctatgctatcatgatactagagataattataatgttcagttatcttctctgatacatcaccttattaaggtgattattttacattttaatctctttttctctaattttttcatcagttttataattgaggagaaaacattttgaaaattattctttatactctatttaagatgttggccaggtgcagtggctcatgcctgtaattccagcactttgggaggccgaggcaggaggatcacttaaggtcaggagtttgagaccagcctgccaacatggaaaccccgtctctaccaaaaatacaaaaataagccgggcgtagtggcctgtgcatgtagtcccagctactcaggaggctgaggtaggagaatccatgaacctgggagatggaggttgcagtgagccgagattgcaccattgcactccaggttgggtgacagagaaagactccgtctcaaaaaagacaaaacaaaacaacaaagatgtaaggaaagtatatggggcatcttagatttgcattaagcagttaaaaaaaaaggcaaacattagtttaaagagccaatcttcagaagcctggaaaactctcctacatagattttttggtggaaaatctgtggtatttttggtattcttctgcttttcgaatagagtttgtagtccaccactaggctgtgtgcgttccttttcagcatatagacttaacactgtggtgtgggtttggatttggtaatacaaagagatctgtaactaagaaggatgtcttttgtttctgtggcttaggtcaaagttcctgtcttattaattaagcattttcttggaggtagaatgttctacagcaaataaataggcacaggttagtcaatttaatataatggacttttgctttctctcagaacttgggcaattatatttgcagcatttaaaaatgaaaaaattcaactcacaactgttgattctaatatattaaccaaaaatacagaatctcattgtaattatcaaactttgagttggaacagagctatttcaccaacaaagtattatggttttcttaaggatatcgtgagctgcagttaggaccattattataaagcacttcttttggggtattggtgcttattataaaacattgctttatttttactttcaggaaatcaatgagctgatttatgatacaggaaatacaagccagattagccacgtccttctgaaataataatagcaaaaataatagttaagagcatgcataatcaatatgcagtcaaacagtaaactttatgtacattagagatagtttacttttgttggagttagtaaattattcagatctgctacagaattatacagatataaagtatgagaatattcttacataaggatttattatctactatatttcataagtactaaattcatttataaataatactgacctgactcttcctaacccacttaacgaactaccaaagcctttttatttgcaattaaatctattgtaatttaaaaaaaactttaaaaataggccaggtgcagtggctcacgcctgtaatcccagtactttgggaggccgaggcgggcagatcacttgaggtcaggagtttgaaaccagcctggccaacaatactaaaaatacaaaaaatttagcttggtgtggtggtgggtgcctgtaatcctaggtactcaggaggctgaggcaggagaatcacttgaacacgggaggtggaggttgcagtgagctgagatagcgccactgcactccagccggggcgacacaacaagactccatctcaaaaataaatataaaaataaaaatggatatgcaaactgatcaattaaaaagtaatcagggtgaacttgatgaaatagttaaagtagcaggggatgaatttttttataggtaatatcaacagttttcctaatctcattattcaatatactcagaatctctcagagctttgactagagatagtggtaaatctagttgttgtcatattttcccaaacagaactataattttttaaagaggatacattattggtatgtttcttttaatctaaaactagttagaaattattagtttgctaaattacagcaagcatagtatgcttgtcctgtgtttgaagaagtcttattaaaataatactctttaattttcttccttaccaccctctcatctcccccttttgttttcaaagagaaactggtagtctgggtagattcaaagcatctttaagagaaaatgtcttggggagccccaaggaactgttgaagttaagtgtgccatcgttagtgtatgctgttcagaacaacatggctttcctagctcttagcaatctggatgcagcagtgtaccaggtaagtggagttaatgataatgaaaagcacagaatcttttatggtaaaaagagtttttattaactctttatcatattatcaatttttttttttttttttgagatggagtctcgctctttcgtctaggctggagtgcagtgacgtgatctcagctcactgcaatctccgccgcccaggttcaagcgattctcctgcctcagcctcccgcgtagctgggactataggcacatgccaccacacccagctaattttttgtatttttagtagagatgaggtttcactatgttggccatgatggtcttgatctccagacctcgtgatccaccacccgcctcggcctcccaaagttctgggattacaggtgtgagccaccgtgcccggccattatcaaatattttttattgataattttatcaatgataccagaaataatatatttgtatcagagactaacattaactgaatttattaattcattctcttttttttaggtgacctaccagttgaagattccgtgtactgctttatgcactgttttaatgttaaaccggacactcagcaaattacagtgggtttcagtttttatgctgtgtgctggagttacgcttgtacagtggaaaccagcccaagctacaaaagtggtggtaagaaacaaaatgcacaccataacttcccataaatagaaaacttccttaagtcttatactgttcagttacattgatgcatgcagcatgactacatttctttgatttaaaataacttttgccttatagataggccttttttctttagcatattattagggataataatacttattggttgtttctcagaggagaatatgcataaaatatgttacagatggaacataccttagaaataatgtgttccatcccctccattttatggatgacagtccccaaagaggtgaaggaacttgtcctaaattagttaatagctaacttgtgaccacaactgtgccagtttccatactgtatatgtttagaacttctagacctctttcaaacatctcagaaacactgggcaaggtttttctgcatctagttttcatcttctctctcaactgtcagtctctggcacatctccctactgtcagtgatcaggatgacaagggaaggagtgttcttactgataattgataattatctttagtttttaagagttaatgtgaaggtacataacagatttttaaagagttaacgctaagatacatacatgattttttttcttacattgtatgcctcaatcagttatttccccaaagagaaacaggaaatgggatgccagtgaatagttttgtgaaggtcaggagtttcctacagttgaatatttactctaacttttagcaaacagactatggttctcttaggaatggaaggcggctgggatgtacagtgcttgtgaacagtatcatatccccaccctccaggtcccctccttccccaattaaaaccctactgtttctttctataatatggtttctagacagacttcctgatccctgccttctgcccctacacttttccttatatttttctcctagatgcattcatctgtcattatttctcaatatatcctaaaaccccactgtctcccaatgttgtctaagtaatacgaggcacagtttggtaattacccctttgttctgcataccggagacttgttatacagtcatgcatcgcttaacaaagaatataagttcagggttctgagagatgcatcattaggtgatttcactgttgtgcaaacatcatggagtatacttacacaaatctagatggtatagactacttactacacatctaggctgtacagtatatagcctattgttcctaggctacaaacttctgcagcatgttactgtgctgaatactgtagcgagttgtaacacagtggtaagtttagcgtacctaaacatagaaaaggcacaaatatagttttatcttacaggaccgctgttttatatgtggttcatcatggactgaaatgtcattatgtggtacatgactgttaatttctggggggcaggcaaagtatctattttacaattgatcataaaccactacatgtaactgtgtcacccaaatagtttgtctcaaatgtatcttgtatccctctcaccccactgttccctcaatctgtctgcactgccatgcactcctccactactggttaagtgggttccaagtgtcaggactggaatagactctcattgacactagaactcaaactctggcttattctaaaccagaatgcaggttgagtttgtatttattaagctcttcttgttagctttgggtcattgctcagccccttgagttatttccagttcttacccattattagcttctcctttgggtattacgctttccagagtcaaaaaaaatatgccttctgggtctttaatgaaaattttaggtagaacaggaccagagttctgtggctgtacctttagaattctctctagcttgatctttttcttgcttactgaacatatcatctctcatagtttttatgggtcaggaatttgagggtgccttagctagctggttctggcttgaggttgcagtcaagatactggctagggctgcagtcaactgaagacttgactacggctggaggatctgtttctaacgtggcttatctatatgcctggcaagttggtattggttgatggcctagcttgattttgttcaattaactaccatttttctgtatgagcattcacacacttacggattgtacctttatcctcactacagttctgtgttgtctataaaaatattatgtggctggtcgcagatcaccaggtgaggagttcgagaccagcctggctaacatggtgaaaccccgtctgtactaaaaatacaaaaacttagctgggcgtggtggcaggcgcctgtaatcctagctactcaggaggctgaggcaggagaatcgcttgaacctgggaggcagaggttgcagtgagccgagatcgcgccactgcacaccagctcgagtgatagtgcgagactctgtttcaataataataataataacaataatatgcaagtctgtcacattttttgccaaacattatctctatggaattcccctcatcacttaacattaggagtcctttcagtaaggaaatctggtatgtttcacacttggtgaagtcacactattttccactgatgaccattaagctttttaagtacaagtcatctctaaatctgttctaacattttgctggtaatcaatgtaacaataacagctgcaatcatttataatgcactaaatactagcattatctaaatgctttatatacactaactcacctacttttcttgatagtcttttaaatttatttagctaggtagtctaggcggggagaattgcttgagcccaggagttcaagaccagcctgggtaatatagtgagaccatgtctctacaaaaaaatttaaaacttagctagatgtggtgatgcatgcctgtagtcccagctacttgggaagctgaggtgggaggatcacttgagccgaggaggttgaggccgcagtgaaccatgattataccacaagatcctgtctcaaaaagaaaaaaaaaaaaaaaagctttctttaatgccttacaggattttttgcaagcctccacttattctgagttttcgatttcttgatactattcttaaattcctggttagattcctcttggtgatctgtacttcggctttgttcttgtaaaatcagaattcagtgaagatgcccttatttagatatgttgatttccttatgtattcttttttttacttttcaccagaacctccttcttcagtaactcttaatctctcttgaatgttcttctcacgagccatggaattctaacttgaagttttacatttttgaattttgatttattcaggactggagcacatgtctcttaactgtgctgtgtttggctcatgctcagatcacatggttgctttctgccaaagttcccatcacatctacttcatcacccagcagtttcttgtcagaatcaagtccagataagctgtttccatcactatttttcctaactgtagagacattcaactggcaggaaagtaagtcaagaatttatcaggcactctatttttagcagttggagcttcccagcagatgttgggataggtggtatctcacactatgattttattctatctatgccagtcttgaaatttgtattataggaaagtatacttgttaataatgtatagtctatagcagtggttctcaaactttagcgtacatcagaatcaactggaaggttggttgaaacagattgctaggcccattcccatagtttatggttcagtaggtctggggtagagcctgacagtttttatttctaacaaacccccagtggtgccactgctgctgatccagggtccatactttgagaaccactggtctacagtgtcttctgtttctccttttatcttcatgcaaacaatttagaccaagcttgctctctcaggtaccataaagtggcacttttcttatatcaggcttatttattttgaacaaggtatatacttccttgtcatattacagtcatgaatctcaaccctctaatttcagtgatactattgagatagtatttatctttcaggaaagactgatgaaagctcctgacagtttagaaaagaaagagaaaataaagtgaaacagagggttaggacccatatacttggatctgtgagcactggtctcacactattttggttatatatacttgtcaattttgcctatacataacagagctgtgtattataatcttctttattcatttagtatgtatcttagtccattttctgctgctataacagaatacgcagagtgggtaactcataaaaaacagaagtttatttggcccatggttctggaggctgggaagtccagaacacggtgctggcatctggtgaggctcattctatggcagaaggcagaagcgatcccatgtgacagagggaagtgggctgaactcatcctttttatcagaaacctgctccctcaataactaactcattccctcagtaatggcatcaatcccttcttgaggacagagccttcatgacctaatcatctcttaaatgcccacctcttaatactgttagaacggcaattaaatctcaacatgtgttttgaagttgacattcaaaccacagcagtgtgtatagacaatgtatctggtacacagaaggtatactaaaaattcaataaattggggagtcttaagaggcagcactgtatcctgtaggtgatgaggaataaataagttaaattgttatcattttcaggattgatgctataagctcttaaattagagtgataatagaaattaaaattaagtagtatgctgacttggcctgttcaaaagttcatgctagagtgcttattggtattaggaaacagtgggcacatattatattaagcatatactatggctgtgatttgagggacacatttttcacttaagccaagtgccctggttaatttctggaatggtctttttgtttagttgtcttattctgtagaatagctgtgtctgatgtggaatatacttttagtaagactgtaacaggtttttgtatttatttgtttggactcttggatgaactctgtttattagtcactaaaaataactttaacaattaatattgcaggtggaacaaaatccattattagggtttggcgctatagctattgctgtattgtgctcaggatttgcaggtaaatcatgaaagcattgttttattcttttgtcatatttttcgaaaacatcaaactttagacaccagtctagtttatcttgctttctcagttttattcccattaaacttgatcttcttgcttatatttagttttatgtcagctgtttttccagtaaatgtatagcattgttcaactaagttcagactcagtccctattcatacttgcagttaactacttctgttatccttgaccatctcagtccggccaaaaacccaaaagtaaatgaaaaaagacttctgaaaatggaggaaattagtcttcagaaagccctttccttttttctggaactgccactatcaagtcagatcctgctgctttaggttgttaatgttaccagctaagtatctttttttcccctataacctcaagttctttctctgctttaacaggttaggagctatggagtaggatcatgaggtgggtcgagagtaccttagaaaacataatacataaagctaataaccaaacagggaggaaagacaacacaaaatcactaacatcaacaatccacggaagtctggcgttgtatgtgtagggacaagcactcctccaatgcatcaagataagaaagtatgaatattaagtgtaacataaaaaaagttttagaaatagttccagcagagatttagtttttaatatattctgcttaaagcttttagtagaatatattagttatagctatacatctttattatttatttgtacctatttcaagtcaggactatttttgactaggaaagcaggctgaatacagaagtaaaatactgcttgtaaataagatgttttatacgaggggaaaatttaaattcaggaatatacttactgatagcattgtgttctagaaaccaacaaattgggaacaaaaattgagttacctaaaaaatatgctatttgattttttgcaatattttgaacagttaaatgattatgtccaacattttattagttcactctcttaatacacaattgaggaaatggagggtggtttaatatctctctgtgtttacggtaactgagcactggataaatgcttctcccagaaggtaaaatcagaggtgaaaataagaatagctattttatgttcccattccaacagactcatcaaaaataatcttgtttttcgttagactttttagttgataagtacttcattggcagttcctaagtctctagcatgatatttataactaaaatctttaatggctttgtaaaatatgcattcattttaagcataaatccagagataggggacttttgttggggaggggtatcatgtactcctttgaagtatctgaaaaaatctatggaccttcaactccagaaaaatgcacatatacacaaaatttattatccagttggggagttcatgatccttctgaccttgtgtatgaacttggcttgtggaaccctgctttaaaggaaaatggctttacacagcaaattctacttcaattttggttgttactctgaaaagattcctagtggtgattatagattatattgcagaattaggagtattcattagtaggcagatattacagggatgtgattaagataattcactcttaatgtagtttttcagctgaccaaagcaaatgacatactggcattaagtagtacagagagcttttgtggtcttactgctctaataaaggcagaaactgtcttaatttaacagccttctgttaaatgtagcttataaacttcccaattagttattattctatatactctgtaaaaacataaatttataatgtacagtatgtcatgtgtcacacaacctacataataaatgcacatttaagtaaagtatgttttgttccccaaatcatatactttatatatctctagggtattgttctaaatgaaagacattttaagttaatttatagtaatctttaatatttgcatgtctaattttctttcaggagtatattttgaaaaagttttaaagagttcagatacttctctttgggtgagaaacattcaaatgtatctatcagggattattgtgacattagctggcgtctacttgtcagatggagctgaaattaaagaaaaaggatttttctatggttacacatattatgtctggtttgtcatctgtaagtatccaggaattaaaggttcttagtagatcctttattttttttttaagttagatgtccattttaagctgttataacattttgaaattaatcctttgatactgtaaataccagtttgaatataattttcattttgttgacttagttttgattgtgaaggcaaaattgctttgggatagcaatgccccaaaatatctaacattagcaaaaaatgtgtaaaatttaatagaccacatagccctctgggcattgttttggaaaaacagtgttatataggaactaccaattttagtacaaactctcagatggctccttctaaggaaaacagtattttccttttcctaggtaaagtatggcatctctggggatgaaaattgcctcaccattatgtaatgtttcatttatttgagtgataagattttatttctctctgtatacaagttcttgcaagtgttggtggcctctacacttctgttgtggttaagtacacagacaacatcatgaaaggcttttctgcagcagcggccattgtcctttccaccattgcttcagtaatgctgtttggattacagataagtatgtcttagtttgtgttgagtttttaacatggaagagcctcccatttccttgattcatttaatcccttatttaaaagtggcagttggtcatactgtttacagaaattcctagctttgttactacagtttattccaccagtacagctgttcatagttgtgtgggatgtggctaagcagtactttggttgtttaggtggtcttagaggttaagacgaggggtgctagttctatgtgaaagtgaggggactttttttgcagtcaaggcctccctgtatttttaggtattgtatataggacaacttgagtgtctgaatgtgagaaggtactcaaggaaatacatataaagactttaggaaattattttcagcagtcagtttaaactatattggctcattatttagaagaatgtagaaaacatcttttagtcctccctcagcttgtactttccaactgctttgcatttgggtgtgagacggttttgaaaacaatcaaaatctagattttgtcttttgtatctttgtttcattcaatatgtaattaatacaaaactcattaatatagctggcattccagtaccactgctttgttagtcctaatataattttcccaactctcacacccagcattaatttggcttctaaattatttaagcaatgatattgacttaacatttcagggtgcttttatagtgtaataattttctttactgatcaattattataatataaaccaatgtatgaagaatatctgttaaatatattaagtaaaagagacctggcttatatttacatttcattttaaaattgactcctgtatataaatggaaatagtgttgtagaaattttagaaaaccatgtatagtctgtggcaaatcttgcctgtaccatttcttaactgtgcagccttggggaagttatattccctgggtgacactttcttcatctgtaaaatgggaataatatcacctattgcctagtggtgttttcaggtgaagtgcttagagtagtgcttgacactacttaccaaccacttaccatttcagtatcaggtacttataggctttcccttagatgtttttctacctgatttgggtgaacttttagctgtaattctgatctatctttatgttcaacaaaatccttataccattgctcataagaaatatataggaacagtagaaaatgcttttgtttaatgttcttactgatggtcaactagcatgtcttagcaatctttcagttaactgtttagatacaagtttttatcctaccttctccttttttgaaggcaaagctggtcttttttagttaggagtgaactaaaataaagcttgatgtcatataaatatatttatttgtcaagttaggacaagttatgatttggtttcttgcatcctgatttttaagattaaaatgaaaaaaggtgccgggcatggtggctcatgtctgtaatcccagcactttgggaggctgaggcgggtgataacctgaggttggggaccagcctgaccaacgtggagaaatcctgtctctactaaaaatacaaaattggctgggcacggtggcgcatgctcctcccggctactcgagaggctgaggaaggagaattgcttggacctgggaggcagaggttgcggtgagccgagattgcgccattgcactccagcctgggcaacaaaagcgaaactccgtctcaaaaaaaaaaaagatgaaaaaagggttaagactagtaggaaatgtagttttattcagtaaattatcgcctcatctccgattaagaaattatcaatggtttgaatgattggtcacctgtcttttactctaaactttcacaggttcctggttgtcacggaaaagccaatcctaccacattttcttttgtacttatatatatttatacttacatttaaaaaaaattatatattttatagggaaattagttatgttctttgtcagagtggtcagatagtgtcagttaggcatactcatgttctaaaaagtctgtaatcagtgatcaacaaaacactgccttgattttacccgccctgcctccccctctccttttttttggctgtaatggaagacctttctaaaccttgccatcataaaaatatgatctgatagtgtaaacccacaattaagagttttcaaaattttaaactgatcattaggcattttaaagacacacatacagataaagctatttttttttttcttttcagcactcacctttgccctgggtactcttcttgtatgtgtttccatatatctctatggattacccagacaagacactacatccatccaacaaggagaaacagcttcaaaggagagagttattggtgtgtgattttagcctcacgtgagactccttttaagactaaaccatttgcattaaactagagccttaagtcaatctcagaaggtagcataaacaaataaaaattaactgtatggcatgatcagtgcggttatgtggaaacaacaacaaacaaatgaagctatctgagtgaactgctaatacagaaacttaatgtagacctgtttggggtctactattgttttagaatgaaggaattgtattattgtgtgtatatataatttgtaaataaaaagtatggagatgatacggtgttaaaaaaaatcatggtgaggctacaatactcaagtaacaaggtttgggacaatgtctaagggttaaagtgccaaagccatttctgtactaactgttctcttgttccggtaccggggagaaggatgacccctccttattctccaattcatgtacagtattttgtcctagcagcataaagacctagctcttttcttacaagaggcagaaacaagacaggctagttcataaacaaactgaatgtgtaacttctcaaaatgaatctatttcataactcggacaatttctgggtggtgactgagtacccctttagtgagtacccctttagtgctatatttgtgccattcattatctggttcatatttctttgctgttagatgatacacatttcttcaaaaaaatttctaatgtcacttttgtacttttttaaataaagtatgtttaactgttgggctctcaataatttgtgaaatttcagtgttttctataatgttaatggggaaattcagcaataaactttatttgtaagaaagaattgtttaatcactttatattatagatatgaccattaagataatgcacttttattttctatatgtagaaatgcacttttattttctatatgtggaagtctatcggttagggttctctggctgcaaatcaactcaactctggcaagccttaagcaaaaaagaaagaatttttaagaaggtccacaatcagggctacaggcgtctaggttctaagaattaatggacagttgtcttttcagcttttgtaaagatctggctttacctattactgttcctgtatggtttcactcacgattcaaatactcgggaagacactactgatcttggaaggggaaagtttcttcaaacaagtagagagggatattggatgtgtaaaacatgtccctactttatatttttatcccatggctggtttatgctaagaaaaatgtgacactactttaagtcgaaaattagctatctgggagctaattcacttaaattggaactgcaaggctgaatcttttctaggactaagaaggtaagccatagttgctaatatgaaacaattttcactctaactagagaagcttcagttgtgctaacttggtaaatagaccgtcactggtattcaaaagcctactattagcaacatttagaataaattatagcagacctgaatggaaatgctggctgatgggaatggccgtactgatcaaacacatcacatcctactcttgtttcctaagccatgctcatgttatctaatgaagccacacaaaaatatgaagatagatacatgaaggaaaccataagaaactccatttcaaattatggttgaattaatggactacattttacaaaaagatcctaattcaacgtctttacaagtaattccttcctattaaaatgtatttagttcctgaattcacacaataagagttacctgtgtgtgtgtgtgtatatatatatatatatatatatatattttttatttattttttttgagacagaatctcgccctgtcgctcaggctggagtgcagtggtgcgatctcggctcactgcaagttccgcctcctgggttcacgccattctcctgccttagcctcccgagtaactgggactacaggccccgccaccacgcctggctactttttttgtatttttagtagatacggggtttcaccgtgttagccaggatggtctcgatctactgatctcgtgatttgcccgccgcagcctcccaaagtgctgggattataggcatgagccaccacgcccagccctgtatatattaactcaaagggaagcacgaggtctattgtctctaggagtagctgtcagctatattgacagaacggtgcttatttttgatctccctatgtttactccaaactagccacaattacaagaaaattgataatattttcccctcaccaattcttttatttcatgaaaacattaaatcatttcagttataagaatagtttctggaagaatgacatggtaagaaacttcaagccaaagtttaaactcaaatcctttagccccattagaccacaatgctttgggtttaaaaaactcaatgtctatttaaatacctactgaccatgagagaattcagataactcatttatttaaggataaagactgaataacttgacaagtcacatttaatacagattctgacacagaataatagtttaactttggctgggcgtggtggttcatgcctctaatcccaacactttgggaggccaaggcagacagataacctgaggtcgggagtgcaagaccagcctgaccaacatagagaaaccctgtctctactaaaaatacaaaattagcctggcgtgatggcacgtgcctgtaatcccagctactcaggaggctgaggcaggagaattgcttgaacctgggaggtggaggttgcagtgagccaac

SEQ ID NO: 15775 - DNA, 117937 bp, Human; identical to SEQ ID NO: 12762

SEQ ID NO: 15776 - DNA, 11811 bp, Human
catatcctttttccttcaagagtttttctatctaatgtacagtaatgcttccataatattgttttcagagttcatgccaatagtctgtctttatagaccaaaacatttgtaagagaatctttcagaagtttaaactaatgactctgtcttataccaaagttcatgtgatagcaaatagagttaaaagaattcctgccatgcttctattttgtattttattatcctctaatttatatgaatattgagtatttgcaaatacttctatctaagaagataccataaaaatttccttaaattattatgcaaattcaaagagaatgggtatgaccagaaaaatttgtttatttgaactgtattttttacaactttagtcttaaggaaagttaacattttcaggattccacaaacacagacacacacacacaatgagttagagctgcagttttatttcttagaatttttgatcttgtaggaaaagaataactaagcactttcatttcttcaaatttttcaaaattattcaggagaatttgtcttcatctattcttttctacaatgatcctagagaatttcttatccatatattcagtttggttatggatttatttgctaacctgataggtagtgttatcatggttttattttcataaatgtaatcgatgtcctagcttattttataaagagatatatttcaaattgaataaaatagttgttatcacaatcattgacccattatgttgaatttctgtaagtctccaataagagagaatgaatttttaaaaattagttctataaacttgttgaaattggaaattatatcccttaatataatcaatttatatctaataggactctaaatattttctacataatataaaatagtccataagatggagtattttatgaaacactttctaaattttcatttatattaaatgcaaaaatatattagagaatagatgtttgttttacaagttataataaacacactaactaactataaaagctatcaggtcagctaaatgagtgaatatgtttaagatattgctaagtaatatgtttgactctcccttctacaactttcatatgtaaaacagttactcagatcttaatgccacaatattttttctatccatcatctttttttcaattgcctttgccattctgtcagttcagatccttaaactctctcccctacctccgttttctctccccctcattttcagattcacctcattttcctactcattttcagatttactacaaagcagagctttgagcattccagaaatatatgtctgaacttttcaaaaaccttcaattattctacaccatttcctaattaattgagtagctcccctcagtttggcatttaaagtagtcctaaatgtggcctcaagtcatctctgacacagtaattctttcttaatcattgatcatcattgataaaaatgtacatattcatatatatgcagagttctatataatttcatggagtttacaaaatctttctctacaagtcttacagaaatacccgcctgctctacacatgtccatcctgccattctgccacacatacatacctaacattccaaccacatttgacgacaagcaacttgaggacagacatggtgttttctgcaagatacacgttcacatgaaccctatgatactatccaaatgtctccactgagtagcttggcccctggaatgtcttccctgaggttttcagaatgtttgccttccctttatctgtccctgttatctgttacctggataagttgggaggcatttggggaagataaatgtcatttttcagatttcagccactactaactattcttgctaaagtaaattcttttgttatggtggaaaataatttttactaatgaacttggactgtccctaccttgattaatacaggcttcatttgtgtttaaatttgatgtctatttgattcacgtcagctcaaaacgtgttttctaaatttatatttttcaggtttcttgagtacaggcgatcaggctgcaaaggggaactatggactccttgatctcatacaagctttaagatggactagtgaaaacattggattctttggtggtgaccccttaagaatcactgtttttggatctggtgctgggggttcatgtgtcaacctgctgactttatcccattattctgaaggtaaccgttggagcaattcaaccaaaggtattatgcaaggttgcaaattttgacaattttggtgtctgcatgccaccaccatcagtagtatgtgatgctctgtatatttctctgttcaaactgagtgttaggttgaactcaatagtttaaagctttgtttcttcagtttttctgtgcatgtttaaattttcgtcaaactcttttctttgtctcctgtggagcttggtaaggatgccctttcaagcacacttcagaatagttagcattacagttactcttctttcctttaaagggtgatttgaagaaaaaatcagacaaagacgttctacagttttgtcatctttgtttattcagtgatcaaaatcaaagatgagactttttacatgcagggactgtatataatctattttcaagacaatagacattttaaaccctttattagtatgaagctaacgaagcggtcataagctagtttgtctgaaaacatgtgatttcacttgttgtctgagtacagaatggattgttgattatttcgcatgcatgatccaaaattgtcaaagcatcaaggtcactggtagagcttttgattaaaaagaaaaatacatttgattcagtgttttttctatttttaactccaaaagcattatttttccccctaaacttggcaaggcagcatggagtattgaggctgctgaaatccatgaaatatttttctcgtttccattttctggctttgacatattttttccaaagtgcctgtctgtccaaggcttaccatgttgttctttatgaactccatctccattttaccatgcatagaatcacccattccaactgcattattaatttgaaatttcacaagaacagaagagtattgttggagaaatttgcaaagcaaatactttttctgcattatttatgtatgataggaagacagataatatataaaaacgtacaccatctttcttttaatttctgatcttttattgtcattttatatccaagaaaaaagtatacactgtcaagtataattcatgaagtgttttaatttgtaaggttgagttttgtgataggagcaccaaacatatggtatttgttttcagtatcaaaaacacatgaatgttgaatttcaaaagaacagccagtcattaaatgaatccatgtatttggagaatcatatatagactcaatttattaacatagtttacataacatttcatttatattagtaaaattctgattcaaggtgacaaaataacacagatgaacatttccaagagagatttcatctgtaaagaaatggcttcttttgaaataataaacttagtgtttctttaattaaacagattagattgttctaatctcagtatttttactaatgccactatgtagctaaagcaacactaagccacctctataggtttctcagggtcgcttgctcaaaaattgacgtgaaagccacctttagctagtatcaaacgggcattggtttaagagatgagtcagttagttcatcagctaacactgccagtcatcaactgatggcatggtaaacagtaggaaatggttatgcaaacagttgaaaatacaacattttattatacacttcagggaaatctgtctatccctggaaaaagacatcaacttaggtttggcctaaacctgtctccaaactaagctgcctgattttaccaggagatgctgaaaaaaatctcttgaaatcatcaagctgattctgcctccaatggagctataaactttaaaggcaataaatcccacaatgctcaggcctggatataccatgagtcaaccccatcttgcatccacataagaggcaatttcactaatatgataaaacaaacatacatttttcccatattttaggaatctaggtggcatattttaggacatattggacatgatgtgcctttccttctcaatctttttcggtatatttagttaatgttgagtccctgagatgggaaataatattatagaaatcaccaggtgcattttagttacacaatttttatttattaaaatattttcctgagcaaatgttgataaacagctacataattttaaaaattatctgtatttgtatcatttgctctagcatactttgttctagtaaactaaaaaatacttataaagatgtcagaaaaccaaaacaaatgtatattaatactgttagatttttttaatatcttcagaattatataggaacatgttacagacatgttgaatatataggcatattaggttaagaaaaatctaaaactttccttctaattcagacagtgcttcaacacctttgtgaaaagagtttttatctcattaatacatatgaataattaagcatgtttttaaataactgaagcacaaagctgtatttggaaattgataaaattgataataaatttaaatatgtaaaagaaaataaactatatttttaaaacaggaattttatccgaaaaataccttaatgagaagataaagtgtgtttgtaaatttgaatgacatgcagcacttaactgcatatggaaccatcatttacaattcttaaatgcaattaaaaagcagtggaccatgtgcttttcatcttttatgataaaaacagtagtgtacattcaacagtggcaaaagttaaatcaccccacactaaatctttctgctgatggttttttctttaacctagtgaaaacacttcaaaggttatgtcttcttctgaaagatgaatattcagaatactatgtctgacatgaagatctggaaagagtatgtctaaagtgatattctgttttgtgtgaattcagggccaaccccagggtataaacaaacagccagccccagtcattgtatgagccttcaagaattctttttcaaataacatctgtttaaaacaaatatagagaaccattttgaaggaagatggacacagccaaactggaggaaatattccaaacagacaatgtagagtctgttggagagttaaataggagaagattggccccatctggttaatgttgatgataatatacgtatttacacactcattgaagaacatatttgggactttttaccactacatcgtctccttttcttcttgcctactacctctttgaggcttcttgatccctaaagcaggtgccactcaaagcacaagacttagatccacctctctaatccattataccctgcggttggctttgtgtacttcccttaagaaaaatatctctaactccctgtttcttgagctgtatctgggtttttatatacatgtctaaaatatcagatgttattgttttaccacaacattacccaaagatcatctaaaattctttgttgattttcccataggactttttcaacgagcaatagctcaaagtggaacagccctttccagctgggctgttagttttcaacctgcaaaatatgctagaatgttggccacaaaagttggttgcaatgtttcagatacagtagagttagtggaatgcctacagaagaagccttacaaagaacttgttgaccaagatattcaaccagctcgataccacatagcctttggacctgtgattgatggtgatgtaataccagacgacccccagatattgatggagcaaggagagtttctcaactatgatataatgttaggagtgaaccaaggggaagggttaaaatttgttgaaaatatagtagatagcgatgatggtatatcagctagtgattttgactttgctgtttcaaattttgttgataatttatatggatatcctgaaggcaaagatgttttgagagaaaccattaagttcatgtatactgactgggctgaccgtcataaccctgaaaccagaagaaagacattactggctttgtttacggaccatcagtgggtggcaccagctgtagccacagcggatcttcactcaaactttggttcacctacgtacttctatgccttttaccatcattgccaaacagatcaggttccagcttgggctgatgcagcccacggagacgaggttccctatgtactgggaatccccatgattggccctacagagttatttccttgcaatttctccaaaaatgatgtgatgctgagtgcagttgtaatgacatactggacaaattttgctaaaactgggtatgtacctaaggaatgaagtttatttttaataaaaatgttattttaaccattttaaaataatagatatttatgcccagataatgtcatattggattaatacctgcaagatattacattcctttattcaaaattaattctatattatggtgtttttaaaagtcattgctttattatttctggtgttttagaagcttgttaagaaagcacatatctcaattgcattacttaattacatctgcttttggtttttgaattatacaagacttgttattgttcagcagtaataaatattattttatagtgctttgtcattcacaacactctttaatccttccaactacctttctgaatctcgcagatcaggtactattaatcccactttacaagaaggagacctgaggctctgtgagtgtcatagagatgttcacatgtctggtatatagcagagcctaggctcaaaccttcatctgctaatttaaaatcaaaaatcctttccactattccatgtcatctctgctagcttgcctatgagacaactcatacgtatgtgagtatttaaataattctttaaaatctttgggtagatagcagcccatctcaggataagcagagagaacaagaatgtgagacttacttgccttccattatcacccatctaacaatatgcctgctaggagatttatatttctaaattgacccaaattaatgttaaaacacaatctaaagcattgctgagtcatctatttaattattagatgttaaagtagtgtgattttaagtaaaaaataaaatagctttattctcataatttatcttttccttcttagtgacccaaatcaaccagtccctcaagacacgaaattcattcataccaaacccaaccgttttgaagaagtagcatggaccagatattcccagaaagaccaactttatctccatattggattaaaaccaagagttaaagaacattacagagccaataaggtgaacctctggttggagttggtacctcatctgcataatctcaatgacatttctcagtatacctctacaacaactaaagtgccatcaactgacatcactttcagacctacgagaaaaaattctgtacctgtcacgtcagcctttcccactgccaagcaggatgatcccaaacaacaaccaagtccattttcagtggatcaaagggactactcaacagagctgagtgtcactattgcagttggagcatcactgctgtttctgaacatcttggcctttgcagccctgtactacaaaaaggataagaggagacatgatgttcacaggagatgcagccctcagcgcactactaccaatgatctaacccatgcacaagaagaggaaatcatgtccctccaaatgaagcacactgatttggatcatgaatgtgagtccattcatccacatgaggtggttcttcggaccgcctgtcccccagattacacactagctatgaggaggtcacctgatgatgttcccttaatgacacccaacaccattacaatgattcccaacactataccagggattcagcccttacacacattcaatacatttactggaggacagaacaatactctgccccatccccatccccacccccattcacattcaacaaccagggtatagccagataagagaaacaaactattttttttgatggattgcagtaaacgatcactgaagattccttggctttcaacctacaagacttactatttaaataaggaggaatattatgtgaatatacatatcaagaactttgggggttttgaaaaaaatgaattgtatatatacaaatcaactttaaaaacaaatttcaattgcttgaagcaattgttctgaatgatactttttcattcacattcaagaattaattttttgaagatttaagttacataatggaattaggcatgtggaacaccaaacaggaaagaactatgtctgaaatataaaaaataaaaataaaaaaacaactatgaatatgcacaagggacacaccagtggaatgtcagataattttcaccagtttttatttggagccgttttattgtgtagaccatatttacatatttggataagtacacaaagcgtcaatgctgttaatggccttagcaaaggctcatgctgaaatttgccagtaaaacaaagaagtttaaagactggcaggtacaccattatcacataagtgctgtcagtataaagttgtggggataaaggaaactggatatttttagcacgatgtgcatgataatttatatgcttggtggctgtgctgctgattaagccgtaattaaaattcttctcatcccattggagtttttaatagaagcttcctccatcaattggcagaacctaaagaagattttaaggggcaaaagtaattacaataaaataattcacagtagtttcaatatagaaggaattagctattaaaggtatttgaagaaactataggtatagtggtgaatactcgctgatatgaatcccagaaaaaaatttcctgtttttaatgttcttttcaatcccatctagataatttatagaaatataaccctaattggacatgtggtacaggatctataagttgctgtgtttttttgttactctgtattttgttccttttggtaaggtgaagtgtgtccaaagagttacttgcaacagtctttcatgatatgaggatgcccccgtattaccactctgattatagttctgagttctttgatttactcatgctgcatgacaaaatgtttactaataacaattcattataaagttatatccctctttacatcacttatctttctcactgaggttcattcactggaatttactcacgcaatctcagtagagtacaacgtagatacagaacctaggagagtcaacatctggaggattttagtctttcttacacatatgtgtgattttaaacgaatattctcagaccacaggaaactcttcatccccctgttgtttaccagtaacagtatatcacagacctttccaaatgtttgtatatgtaatcagatgtacatttatattgaaaaacaaatgagatggacttaaagagcacatcctgataaatactttctctctcacctgtactatatttctattagactaaagttatgtgattttttttttacattttttcagatgactagcaattttgatagtttataagataatgcaaagaactttctctgacaaactaactgcagtaacagaaacctttcttttcagttactctttttcaagaatgaaagattattatacaaaaaattgtatactacttgatggaaccaactttgtacatcttggccatgtcactggtcattgtgtgaaataaagataatctggataatgactattagtccaatgctaagaaacatgatctttgctcattaaagagctaaaatgtttattgctgttttgtctttcttttttctaaaaaaagaaaaaaaagaaaaaaaggaaaagaagaacaaagaaacatgactgtctcaaagagtaatttttctagattagaccagtcaggtttttgaagacatataggtaacttccacagaaaacacaaacatgtatttaaaggcaagtctcatctaagatgaaactcataaaaattatttaatgtttgttatgaatttaaaagctccagaaatccatgaaaaaaagaaagattagctttgtgttgttaaatatctcttaggtacagatgttgtagaaataaagtgccaattgttttcagttagttagaaaaacaagttccaattctagtcatcaaggaaaaggtctattgaaaagaaatttgcaatatttcatggaatacaaataactaggttcataaaatgggggtgattaaactaccataaagtaatgaatagaaagttgccatgctaagagaatgtaaaagtgctgagcaagatattaaactgacactaaaagataaaaatctatttcaaggaatttatgtgattataatcccccctcccaattattatctatcaaagaaatgtaggtattcctccataattaaaaaaaagtctctgttagaagcaaaagtcttcaaaatccagagtgatctacatacagcttttgactgaggtggttatgcttttcaactgtgaactgccagtgtacacaaatacaaataattgtttagcatctgaagtattgttcaattggaacactgtattttactgtattaattaaacaaaacacaagaacagaatagaaatgacaacaaaataagatatgaatgaatactttcatatgcattgcttcatttggcaaaaccaaacattctattaaatagtatgttttaacgatggccatatttatatcatctacctaccaatctattgctctgcatttatcaatctgcctatatatagcataactgtcaccctctttatattaatttaggaaaatgattgaggaaaacaaagcatagccctattaattattttctctaaattagggtagaataactttatggaagataaagcagcctaggtttaattgttgttcaccagtcacgtgataaagtcattgtgaatgagtgttagttgctagttttataattgcagtctctagtttctgaatgaaaaaggatgccccacattatacagaacattaagaactgtttttaaagctgaaacataatctttatatgcaagaaaaataaatactgttactcaattttagcaaatatgtttaaaatgtatttatttagataattttctttgaaaaacaatgtaagtaacaaaattaaaataatatttttggcattatttgttaattcagattttcctgcctccgattaaaaattaggcaaagctgcttataatttatacaaagattacactaaaatgaactttatttcattgttttgctgttatataaaatttttaccaaatgtttaccaagagattaatgttttagagtatgaggatagaaaaataaaagtgacagatttcatagttttaaatctctactgaacatgttgactatgaacaaaatctaattggctaccacagatatataacaaagtttattactaactttatgcaaattggaaaataatttgctaaagcattaaaaatgtcagatttgtagacgtcttgctggcaactcaaagcagaaaatctgagtatatattattttattcctcatttcaaatataaaagttgaccaaaatgatgctttatttccgacttcctgatctgtatgtgaaaacagcaacatttttttaaaaattatcaagtatatataatattaaaaagaggaaaacagatggcactaattttcttacaggagtgaagtgctgaaactaaattgttacatctgtaacaacagttatttcacctcttgccacactcatcctgacatacgtattaatatcaaaaaatgatacaaagaatatgagaaatgtgttccagcattaaaga

SEQ ID NO: 15777 - DNA, 80411 bp, Human
  misc_feature (1)...(80411): n = A,T,C or G
gggacacagagccagaccatatcagtagctcttttagttgcaacattaataaacgtggatatgtgactaaattatttgcagggatagtagtctagatttattttatttatttagttttttgagacggagtcttgctctgttgccaggctggagtgcagtggcactatcttggctcactgcaacctttgcctcctgggttcaagcgattcccttgcctcagcctcctgagtagctgggaccacaggtgtgtgccaccatgcctggctaattttttatattttagtagagacagggtttcaccatgttggccagcatggtctcgatctcctgacctcatgatctgcctgcctcggcctcccaaagtgctgggattatagctgtgagccaccgtggccgacctagatttatttttttaaaggattaattgtcttcctttattggactttccttatgcatttaagacatttgatatatcagattttcccaaatcttgctattgttgtgacgactaaagaatttttcttgatagaactttcagcttcagcaagagccaaacttgaatataagctttttgctttaagaaaattcaaattttaattttattaaagactttaatgagaggaaattatttttagaatttaaactttattataaaataataacggcttttaaaatattttcttcctgccatattttggtataaggtagtcatgcttctcatcattgctttttctgcatcttcttgagatttgttgcatatgttgcattaagggaccctggatacattgattatatacggtgtgcttgtaattagttcgtacagagtctcctagattttggagacatccaaagatcactaaaaaaagattttttagtataaatatgtaggcatggttctatacactttctgcattttgatcaatttatctgtctcccccagtgaactgtatgcttcttgaaaacagtactgtgtcttaatcatcttgattccacaatgcctagatggggccttttgcatagcagacattttgctaatgttagtggaatgaagtaattctctctgaaaagatgaatcataaatgcactactcatgagccagggaatttcctgagtcttttcttaaaacccaggtgaattcttgtggaaatatgactgtttctaaccacagtcatacatttccagggtataaagctggtaccattatgagacatttatatgtgtattatacaataaggtaaggtctgtcaagtgaccacaccacaatgcttggtggccagtaggcacacaatagatgctagcctttgtttcctttttctgattctcctaggttttatgtcagagtcactataagaattactaaggataggggaaattgcctttctgtttggacaaatattcatagcagttaaagattctgttttgacatgcccagatttagaattctgcaggaaaacagaagtcagagcagctggcaggctgaactggtacacaatataacccagacagtagacctgcccagtgtcacagtattttctgggctggctgttttagtcacaaggtacttgagaattttattcacatacacaaacacacacacacacacacacacacacacacacacacacggtctttgatttagtggtttagactagctgtgttttcagaagttacttctttgtcaaagacgatagcctttatactctttaatttgattttatgcccttttaagctaccttatttagaaggagcagagtgtataaaagctgttcctggcaaagggccacagcagcctaataaacaaatctgacaggagcccagtttgttactaagccaagaataaggcttctctctgttctgaccagtgagattcctgaaacttaactattttttcttgatttttgatattaattatatttgattgtcatattactgtgtttagtgtgtcaaaatacagtcttgaaaatgataagtattatctctgaatccttttttttttccattcaagataagctgtcattggaaggaatagtggtacaaagagctgaatgccgaccagctgccagtgaaaactacatgcgattaaaaaggttggtgttttgtaactccagaatgatacctgatatttccctttggggattgagatacgtgtgttatatcgcctattgactgcattaaaactgtggttattgttgagtgtttgcttcaaaagctgtttggttttaaaagcaagtaagagtttctttggcactaaagaaatttcagtatctgggctgtttatttgaggtattttaagctactttgttaatacatcctggaatcaaagtttttaaactacattttctagttgtctttataaattttgattctttaaagacatgtataagatctttgtaatattttattttccagggctgtaatttttccataataaatatgtatccgaaatactgtaactgggccaggcatggtggcacatgcctgtaatcccagcactttgggaggctgaggtaggtggaccattcaagcccaggagtttgagaccaacctgggcaacatggtgatatcctatctctacaaaaagatagaaaaattagctgggcgtggctgaggtgtgaggattgcttgggcctgggaagtgaaggctgcagtgagctgagagcatgccactgcactccagcctaggtgacccagtgagaccttgtctcaaaaaaaaaaaaaaaattgtactgtataaagcaagtgtagttgccagaatatcgtcctattctcttgatctatagagaaatttttataaacatatatactgtgttagagagtttgtttcaggatcttcccctgccccctaaatttttatgtggttaacattttgtaattagtatttaaaaatgctgattgtaaattcttgataccccaaattttatgacgttcaaagagtcagcaattttttaagccctgaggaaatatattatacctgtttcatagtttatttttaatgtgttttagccccatgtgatttagaattatactttttttgttcattcattcagtacttactgtctgccaggtgctttcttagaagtgagagaaatagctgtaaacaaagcaggcaaaaatctctgcgttcgtggaccttccattgtcgcagattgtaggtacactgaatcggtagtggagaagacactgctgaagtagtggtagtggcctgttggatatcagcattctcatctacataagaggccagttgagctggatcatctcaaaattttgcatcatctttaaaagtttccttcttttgtcaattagattagactgtctcctgagaatgacatagacatgttctcttgtcaaataattcctctaatttaaatgtgtccttggggcaaataaaagaatgacaatcaaaatgaaaaatatttataacagaaaatagctttggaaaacaggcagaagatgtttctttcattgtttttagcttataaaacttattgtatagtagtaaatttttgaagtctttttgaaaatttatctcttcatataactactgaaattgaaaaaatgcaaaatctggttaccaagctgcttaccaagatctttttctgtggccgtaattttctttaaagggttctaaagatttctgatgatgagatcaggcaggtcacctgctgtgtttataaaatggctgcttttttcctaccaaaaaagaagtgaaaattgtttagcctttcaagtatgctgaaagatcagctgttacatagtcatgcactatataaggacatttggtggtctcataagattacagtactgtattttttctgttgcttttctgtgtttagatacacaaatacttaaaattgtgttacagttgcctacagtattcattacagtaatgtgtagcagagtataccatctaggtttgtataagtacactctataatgtttgcacaacagtgaaattgcctaacaatgtatttctcatgaggtatccccattgttaagccatgcatgactgtattttaatctttacttaagtgacttagaaaaagaaacaagtggttcaggaggatcatgtgagtttcatgaagtagatgatgacataagtcttgaagacagctttttttgaccaagtggagaaagagatggggtaagaacattcaaaatagacatgcacaaagacatggggaagactttagggacctgtgtgtggttctgtaagcctggaatggaggaattgtttgagaggatggcagaagctccagcccagacctctttcttcaacatcaaacatacatacaaaagccgggttgaatgtctgatagacatttcaaatatgtaaaaaactgaactccagatctttcccgcaaaacccgctctactagcacttttcttgtctcagttaataccaactctgtcctctcattttttcagtccaaaaccattggtttttagttaaaccttggtttagtcttagttcttgactcctctcacaccccacatccaatgtgtcagaagaatcttgttgactgttccttcaaaatgttacacatccatagtctgatcacccccatgaactgccattatttcttacctggattactgcagtagcctcctaccagagttcctgcttccacccttgccccactgtagtctcttctcagcacagtagccagggaagttcttttaaaatctaagtcagatcatgccattcgtcttttcaagtgtcacttgcagtgcttcctatattactcagaataaaatctaagtccttaataatgatctacagggtcctatgtgatcatcctacgactgtctacaccttcttgccatcctcatctttttcttccctcccctccactcattctgctccaaccacacctgtctcctaacaatccatgagccctccaggcacacatccacactgcagcctttgcacagacattcttttttgcctggaacagcctttctccagataaatgcatggcttgccgcctcacccctttcatgtctcttctcaaaataccactttttcatgaggcctaccttgactaccctacctctttctgtacttgtatcttcttcatagcacacgtcacctcctactaaactatgtagtttacttatatttattgccacgttttccctcctgcaatataagttcccatgaaaacaaagtttgtttttttcttttttgactttattttttgtgcatgtcgatttggctcactcatttacatacacacatttgtctacaatagttcattccacatagtagctagtcagtaaatatttggtgagtgaatgaatggcacaagatgaggtttaaaatgttaaagagtcttagatactatggtaagaaatttggacagtgtgctataactattaaggagatatggaaaaattttaagctgggtggaatctaaagggatttgtattttagatagatcattctggccatagtataaagattagaagctgggagataagcttgaagcagatataataatccaggttcaaaatgtctgaatgactaaacaaggtggttctagtcagaagggagatgagagtctcttttgaggatagctggaggtagagccaataggacttaatgaacttacttcagacttctttggttgtggaatgggagattcttctggttggtggtggctcttgtggcccagctgtgaatatcccagattggctccctgctgtcctgtgcattgcaaggaaagtttacactgatgagaggagagggacagggaagtttttgtagtccccgtgtccattataatttaatcccatttggcagtttacataagagactcgaagcagaaaatacataaaattgtaagaacggtaccaaggtataaattatcaaaatagcaaactaatttaagtcatgaattattttatttacaattacccaacattatcactaaggtgaggctcaaaattttttttgtttttttttttttaaactgtgaacaacatgggtttgaaattatttttaaatatttacttatttatttatttatttttagagacaggatctcactatgttgcccaggctgatctcaaactcctaggctcaagtgatcctcctacctcagcctcccaaagtgctgggattataggcatgagccaccatacctggccaagctcaaaaaaaaaaaattttttttttttttttgagagacggagttttgctctcgttgcccaggctagagtgcaatggtgcaatctcagctcaccgcaacctccgcctcctgggttcaaatgatgctcctgcctcagcctcccaagtagctggtattccaggcatgtgccaccattcccggccaattttgtatttttaggagagacgggtttctccatgttggtcaggttggtcttgaactcctgacctcaggtgatccgcccacctcggcctcccaaagtgctgggattacaggcgtaatccactgcgccagcccaggctcaaaattttaaagaatcataagatactattcttattccagatagtttagtctttaaacctgaagaaacacacacacacacgcacacacacaccacacccccacatatgcgcacgcacacacacagttaccctactacctaaaggatctgtttacagacagtgtcgtggaggaaaggcatagcaacgtggtagtgctattgaatgtaatatggaaaggcagttttcagatgtaggtaacattaaagtagaagtgtttgagaacagaattggtaagtctgagatattctatacctagatttttcataaacatgctcacaatttttcagggcctccttttgactgcatagtttttagtcatattcaagtttttttattatctggctcttgtcttacttgtctttattttcagctattctcttttacataggcattatatagttatagcacactacaagttcttatcccacatatgcttggcacttgcccatattatgcctttgctacttaaatgctgcatcttctacctaggattgatttctttctttctttctttcttgtttctttctttctttctttctttctttctttctttctttctttctttctttctttctttcttttctttctttctctttctctctttctcactttctctctctctctttctctctttctttctttcttttttttgagacaagtcttgcttgctctgtttcccaggcttaagtgcagtggagcgatctccgctcactccagcctctgcctcccaggttcaaacgattctcctgcctcagtctcccaagtagctgggactacaggcatcctccagcacggctggctaatttttgtagtttcttttttttgttgttgagacaggggcttactctgttgcccaggctggagtgcagtggtgcgatcttggctcactacaacctccgcctcccacctccaagcgattctcccacctcagcctcctgagtagctggaagtacaggcatgtgccaccacgcctggctaatttttgtgtttttagtagagacagggtttcacctttttggccaggctggtctccaactcctggcctcaagttatccatctgcctcagcctcccaatgtgctggggttacaggcgtgagccaccatgcccggctaattttatttatttatttatttatttattcttattcttcttcttattatttttttgagacagagtctcgctctgtcgcccaggctggagtgcagtggcgccatctcggctcactgcaagctctgcctcctgagttcacaccattcttctgcctcagcctcccgagtagctgggattacaggcacccgccaccacgcccggctaatttttttgtatttttagtagaggtggggtttcactgtgttagccaggatgatctcaatcacctgaccttgtgatccacccgcctcggcccctcaaagtgctgggattacaggtatgagccacgaggccccagcttctacctaggatttcttatctacctcctacggagatctttctgagcctttaaaaccaacccagcatcacttactcaggaaaacctccttatagtttctattccccaccccatttaggatcttgtgttcctcttttctgcattcccacatatttaaatgtttattcttctttaatgttttgggaattcatagttgtatcctctacaacattataaacttcatgagagcagagactatgagttttatttttctttcttctttccctcttagtctccctgtctcctttccttcctttcttttttttttgtgtaaatatccaaaagtatttattggattgaaatagaaatggcaaaggtaggtacagaaatatgagaatcatcagcattcagcttctttattaataatttttttatttgcacttacttgaaacctggactttatttttcagttttgtatatatgcatatttctgtgcacacatgtgcacgtgtctcttgctttgagaaggagaaagtgatttcaaaataaatataaaaacatttcatcaacaaatctgtttttcaaaatataaagaaatgaatcttctatttatggaggactagaagagaaaggcttttcatcaaaaaagacctattcttaagtcaatgagtcgcttttctttaatcagtgagtttttactgtattatattttagtaactagcagctaaactacattcttggaaacataaatgactatcacaaagtgtatttcacatttataaataatgatctttaagaatgattagtcttcttttagtgggaatttaattttagtaattcttacagctctctgctgttaaattttggctgataaattagccagatgttatgagaattataaccatattcatcaaatgtaagttagtaagattctgtcattcatttagataaaggtggaaattaaatacatactttcatactagtaaatacatacactaaccccaagaaatgaccttcagtcgatgaaattcaggccaagaaggaaatgatttctttcatcagatcccctcacataataaaaaatcctgcaagactccagttagccaccaggaaaatctaaaactaactaaataaaaacctaatgattttgtttgctagtcttaaaattgttaacagcctaacttttcatattgagaagaaaaaagtgttctactacttctcttactttttctttatctgacattagtttggattaatctgaatattaggagaaaaattactttgaattggtaaatataaatatacttaatatcacatcatgtcttatgtattaaactgatttaatttggattattttaagtgtaacttttatttcagcctcttgagcttttccctagtctttgaatggtggcttatgtgcccactctataattcatattgtactttgttaagtataaaggaacataaatataaggcaatcatcctaacatattttcttacaggaaaatcatagaaatatgaaattatatggctttttgacttctgtatgtttatgtcactaactcatctgaaaatacttgtcttaaaagtttttatttttattccagtgtttgtggattttttccaaaaacctaagaaaacccttttcctatagaaacacaggttcccatatgattataaaacattcaaatactagctcaaatattgaatgggatacaggttgaatatccttagtccaaaaatctgaaatcatttcaaaatccaaaactacttgagcactggcatgatgttcagaggaaatgctttgagaagtgctcatttcagacttcaaatgttaaggatgctaagtttaatgcaaatatccccaaatcagaaacattgctgttccaagaagtataagctgaattataaataggatgatcatataatttatcattgaaaacaggatacttttgagaatgaaagcaggcactggatgtctccattaaaaatgcactaatttataatgtaaaacattttataaatggttgtaataaaagtataaaaatacctttggaataaaactataacagaaaactaggcaaggtgttttacccagaattttttaaaagactaaaactgagccgggcgtgatggctcatgccagtaatcccaggactttgggaggctgaggcgagtggatcacctaaggtcaggagtttgtgaccagcctggccaacatggtgaaacccgtccctactaaaaatacagtaaaattagccacatgtagtggcaggtgcctgtaatcccaactactcgggaggctgaggcagaagaatcactagaacccaggaggcagaggttgcagtgagccatcgcaccactgcactccaacttgggtgacagagcgggactctgtctgaaaaaaaaaaaaaaagactaaaactgtttgttttaagaaagactccttagggaaactcagtggtagagatcaccctctttcctctgaagagccatagcagctgtctctttcacagccttgagctgtagactgcccctgaagatttactattgtgatgaaacaaggacttccaaatggttgtaaaagctcttgggaatgtgtataaagaatgaggcctggtgcagtggctcacacttgtaatcccggcactttgggaggccgagtcttgagcccaggagtttgagaccagcctgggcaacatggagaaacaccatccctacaacaacaacaacaaaaattagccaagcatggtggtgcacgctgaggtgggaggatggcttgagcctggaggtcaaggctgcagtgagctgaggttgcaccactgcactccctcctgggcaacagagcgagaccctgtctcaagaggaaaaaaaagaaggcactggaataattttaaaaactcaaaggttatacatatatatgtatatttccttcttgtgatctctgatattttcactttaagatagggggagtgaaggagttttttcagtagctaagtgttgtctcaccctgaacatctcttgttttctttggaattccccatctcttctgcctggtctcttgtgttccgtggttagtgactctcctgacatacccaaatgtgtgatttttaatatgtggggctgtacgtcttttttaatcaaagtcttgtgtttgtttttttgtttttttgtttttgagatagagtcttgctctgtcacccaggctggagtgcagccgtgtgatctcagcccaccgcaacctctgtgcccctgggttcaagcagttctcctgcctcagcctccagagtagctgggattataagcatgcgccaccacgcctggctatttttttgcatttttagtggggacaggattgctccaagttggccaggctgctctcgaactcctgacctcaagtgatccacccgcttcagcctccccaagtgctgggattacaggcatgaaccaccgcgccggcccaaagtttgtttttgtttttaaggctatagaacaggaatttccttgtgggggtctgacctcatcttattctgctgccattttaactcaggtgtgcaccatatcaaagccagccattttcactcttccccaagtgcatcaagtgctttcatgtccctaaatgtctgcagtgctcttggttgctttaagattcagctcaaatgggccgggcgcagtggctcacgcctgtaatcccagcactttgggaggccgaggcaggtgaatcatgaggtcaggagttcaagaccagcctggccaagagagtgaaaccccgtctctactaaaaatagaaaaattagctgggcatggtggtggccacctgtaatcccagctactcgggaggttgaggcagagaattgcttgaacctgggaggtggaggttacagtgagccgagatcacgccgccacgctccagcctaggtgacagagcgagactccatctcaaaaaaaaaaaaaaaaaaagattcagctcaaatgggaaatctccctgaccgtttctcttcacacagaataagtaccatgtccaccaaactccagctacactttttaaaataaaccattactcacattttgctttttattttacctttattacttttgtttctgtctgtgctagattgtgagccccttgaggtcagggactgtatcttgttcatcttcattctaacagctttatgttcagttaacactagtagagcaaccaaagatgagcattttaaagttaaggatttatagttacaccttggttaatgaatctccagaattgatactcttttttagttagctttgtttaaaattcaaattataagtcctgagaagcagtattggcatgtgatggtgtttctacaaagccttacagctttgcaggataaaaatacctcagcacacagtttctctttgttcactcacagttgaaaatcaacagggttaaccttaggcaaaactatgaagtatggaaagtttgtctttattatccaggcatctcctgtttttactttttccccttagcaatgtctgtctttaggtgtctactttttatcttgttctgatcttttctagcctgtcaattctggatatattttaagaatgaatgggcataagtcaaactgggtatttggttttaaaccttttattactaagtgtgaaataaaagccattagattacctgttcaagtaatttgagtaggcagatttttttctccccatgggaaagaaagagaactcactgaaattaaaccatttatagattggccccaaacacaaaattaaggaatcgttttagtttgctggaggatttgtcaccaggacaaccatctctgcttcgtgggccaaatgggcagatctgacctagctgcatttgttagagatctgttctgaggatttaaaatgggtgctgaaggtgacccacagaagtgaccaaattcccttaggcaggagcaggacagtcactgactagcccatatggcatctttgtacgtattagaaaaaggtgctccttcctcaagtgtttttatttttatctgtcagaaaattgtggtaatttacagattttgttaaacaagaaattactgccatctgtcagaaaattgacacgataattgccatctctcatgtgaatgtgcccctttaacacaacgtcattgtgcactataaaacaggctgatctaggaaggggctgcaccctccagtttgctgcaggccaatgtgtcctattttcttaccagtttacttaaaatttaagtaatttcaaataaacttgcctgtccttgcaggcactggaattttcaattcttggtctttgatttttctgaaacatttgaaaatgcagaaaagataccacatgttctttgttcaagaaaaagggtctcatttagggaactgaattgatggggtgccgaatggtctgggattgttaaatgctgttaatcaagtctttagcttactattaggaagaactaatttagactttgggatgatcaggatttaaatattcctagtagtttgtcactgacagtacaggaacacctgactcctaagtgtgttacattctatctgtcttgcttgagactgtaatgcagttgccatgggatgtattgtaaagaaaacttgaattatttaaggaatctttgagtttctaagtagagaaagagaagatgttgggggtttttttgttttgttttgttttttttaaaaaaaaggctgctcaaaggaaatgactttcagctagaatggttcagcctgcatagtgggtccctcacttttatatggcttcatattttatgaattagaagttctttttagtgactatccttaaaaaaaaaaatctcatttcctttctcacaaaaaagaaaattgaatcacagaaaagttgcgatttgcccaaggtcatgatttgtaaatggcaaagctggaatttgaacccacatctgattgattccaaaggaatcagctgacaagctacctctttcagctttcagtttcaaaaggttgcctggcttattcgtaggaaaagagaaaggagcagctggtactgtctctctcctccctcttattgaatgaccttcaaagtcccacaacttaaaccaacattgttagtaccatggttccgttacattataaaataaatacaagattcatataagatgtaaaatggtctcattcttttagtttggaatttttatctaatttctgattttttaatttaaaagcgaactttgatagcatgattgaattgaatttcaaagctccatatttctgcaggagaggtaggacattaaatgattttacgagtctgtgaagtttacttttctgaagtttatgtgaaatctctaatgctgtgtgtgggtagttttaatgaactagtagttgtgctgttttgaagatctgctaatctataatgtaccccagatatttctattgtcatatattgtacacttttgtttttatgacttgaaagcctcaaaatgtctaaaacctttttcttttaatgtgttatatatttgaggaaatcccaaaggaaggaattaataatgttcaggcagaaacttttcaaactgaaaaatagtacatgtcagaaaaacgggaaaggatgacatatatgggcgtggtgaggttacataaaacaaaatatgccaatgagcagtattcccagtagaacgcggctccattagggcaaagaccttttttgtctgattcatttatgggtgtgtttctcatgaatagaagagtacctgacacctagtaggtgcgtgataaatacttgttaagtaaagaaaggaatgaaaagcatgtgatttggctttatgcatttgtgtcctacaagctgcccagggtttgatcacaatgactcattcttttttaagctattgcatgccaagttgatttatctgcttttgttacttccctatatttcatagcttcagagtgccatttattactcatttgtttaacagatgtttactgagcatctagtgtatactaagcagtgtaacattaaaaagcaaccagatcttatgtttcttggaaaattgatcatactaatttaatgtaactaataatttagggtattattttatgctgtgtgagaaattggcacaggcagtaaatactagatttcagaagtcaaacttcatcatataagtattttccatacttatactaccatataagtatcagtagactttgactagataaagagtggagggagggctcccaggcaggaatggcacagcccaaccaaggaagggataaaacaatagcagtgttctgggaaacttagtagaggtcaccctggtaaagccgagatggacagaaaaaggaatacatagaattgcctggtcggttgggctgatggtagtttattttgtgccagactgaacgggctagacttgatctagtaagagtcactgatcgagtgtattttactctgaggggggttcctaggtctccttcagggctctgtctttggtacaattcttctcctttggttactgaccttagtcatctttgtaggctcctacttaccgtctgaactttttgcctccgaccttatcttggtaagtgatcccatctgcttaaaatgtatgtgtgtgtgtgtgtgtgtgtgtgtgtgtgtctgtgtgtgtatatatatagagagagaaaccccagaatttgtatctctggcctagacccctctagacctctctcctgagctttacactcatgtacaccattccccttcagagctctacttggatgtctccttcgtgttttaacttcacatgcgtaaaattgaattcttggttgttagcccacctctaatgcagtgtcctccctgcccccagtcttacccattttttacgcagtttctcaggtaaaaaacctgggagttatccatgattcttcttttcttgacaagacacatctagtcaatgaccaagtcctgttagttgtaccaacacaatacaccctgaatcctactacactattctaagctgccatttttgctccagaatataagttcaggactgactatataatctgcaggacctagtgcaaaatgaaaatatggggccttttgttcatacattattaaaaatttcaaaaagaccactgagggacttatccatgtaaccaaaaaccatctgtaccccccaaaactatagaaattttaataaaaatgaaatcagtgacagtggagcattaaatcaagctcagggcccttccaagtggggtcccagtatgactgcacaggctccctcttcatgaagctggccctgcctccactactgcagtaacctcctaagtagtagctccttccttccccctatggaccatccctcacaggtcagactcattagtgtagatctagtcataccacttccctgcttattgcagttaaaataaaatgtacaaatcctgcatcatctggccttcagaactttgatctgatcctgaagcttttttaacctcttcttccactacacatctcattcattagacagcagccatagttgccaccttttatctgtcaaaaagaacaagtatagtcccatctcagggcccttctttctgtctaaacacatatctttcatcagatcttcagttggtagcccccttccaaccatgcagttctctcagtttatatggaacctcctcagatgggcctttctcgaccactgctgggtgaaatagtatagacttctccccaccgccgccactaccaccacctaattatgtgctatgacattactcaggtttattgtattcttaacacttaccattgtgtgactaccttaattaattaattatgacatactgactatatctccaccacctagcatagtgtctcatacataatagtgctcagtaagtattcattgcacgaatgaatgtttatcataacctttttagcctctttcattttaggagatttatctgaagttaacaatgtttttctgttaacaaaaggaatacatacaatacaaacaaaatcctttgggattttgtttatttgggaatttaacaagggcccttcccttgttaagttttttatttgttgagtccttataaaattgaattgacttttatttaatgtattccaagttaattttagaatctcaatgaaagaagcccccttctctttaaaatggcatgtctttagtataacatatcatgatacataaatgtactttagcttggataaggaattaaagatgtcatttcctgttagaactaaggttaatactataggatgagcacattttttttcccctcagaatcaatattgtaattccaagggttttacagcccaagcttcagaaatgcatgtaaacccattcagtaaaccttgaacatctattatataacagacactcaggaatgaaaagatgaataagacatttttcctgcccttgagttgttcactgtagataatttgttctttgacatgcaacatcctgtgtagtttcaaaaagataaatactaaacctgcttcgtgaactatggctagatcctttagcttttaagacttgattttggctgggcacggtggctcacgcctataattccagccctttgggagaccaaagcaagaggattgcttgagcccaggagttcaagaccattctgggctgacatgggagattacttctagaaaagtcatagtgcagtattctatcagttattttcatcttgaataattttatggagacttcatctctataaaaaccttaaaaaagcagctgagggtggtgtgtgcctatagtcccagctacgcctgtagtctcagctactcctgtagtctcagctactcctgaggctgaggtgggccaatcacttgagtccaggaggtgcaggaggttgcagtgagctgagatgatgccactgccctccagcctaggtaacagagggagaccttgtctcaataaaaaaaaaaaaaaaaaaaaaaagttgatttttataatccaaaatgatgcagttgtataggagaaacaaaacacgtgcgcatgcgtgcaccccttatgaggctaatacgaacaagaaatacataaaattaatttataaatctgttgtttaccaatcctgtcgggtacgcacaccaattttggagggagtgggggtggtgatggccaaatgctattgttcacagaattttcaattcttattacataattatattgaatgccatatggtgttttattgtagttcattaaattactagcagtttatacttctatttgtgttatcattaacgcatttcagtagcacattttttaaatacaaaactttagatattcctttttcataaaaaactattcaagatgaaaataactgatagaatactgcactatgacttttctagaagtaatcccccatgtcagctctaaatggtgaataaatgacagtactgtgctatacagtccttcaaatatataaaataagaattgttgctaagcatgttaacaaagaactaaaaatcttaaaggatgtcttgtcttgacaattatctctgttggtttggtacattaataccattttcccttcttgaaattctagaggagtaagttatttctagtagttgggttttcaaaatagttactaaactcctttaaaagtttgtaacttaaaatttttagttcactttaatgaatgaatatctttctaagctatattatatattaaactgtatccatacttcatgaagagtttgttgagcacataatctaactttctctgtaacttagtttttcatatgaaatacccattttttgattatatggcaaaatgccttcatacaccatcaagaagagtaggattatttgcccctttacaagatggccccagagtattatgctttgcaagtcctttgagagttatatgtagttcttcagtcccctcttatcaggtatcattttgtcatgttgattgtgttactgtctgttgcagcctctctcttccttctgatttagtgtttttaatttcctgtgagcaaagaatccagtttaaaaattccactagaatgaatagtgtgtgtaaaagaagactgaatagactctgagtgaaggtctgatgggcttgcctatgagtcaagtggtcagagctgtcatgtttggccctgtgacatctgttttggttgctgagatgcccttttttcccttcttcttttctgattctagttagggcagatgtcattgcatttaataaatcacaaaatagaaaatatgtagaatatctcattttagttggaggaacactccctttgggtcacttggtctttgttgttaatgtgatacacttgtaccatctatctgaaactcagatatataataaagtattgctaattaaatttcctgacatctttccaagtgttttgctgtgaaagtgaattatgcaagtaaatgaactctattaagctgttgattgccaaagcttgtttttctgatttttattcaaatctctatcatggatgaagcatgcagtttcagaatcagttcagtgttgacaacatatcaagatattctgcagtcaatctcaatgtatgttcatgaagcctccaacatattttgtgggataccatctttgtcaggcattgtgctaggcactgtccctgcagtgaataagaaagacaggatttctgtatttatggggcttagtaccaagttgttctcaaactttcatgtttgtgtatacaaatcagctgaggccttcactaaactacagattccatggcctggccctcagagattttgactcaacaggtctgagttgggactagaaatatgcattgctaataggcaccctgacaattccgatgtaggtggtccttagaacatattttgagaaatatattctgtagtctggcagataaagaattcttaacaaggaggtacaactttcggataatatatggacaagaacaatataatgtcatattcgacctgattgccgtttcatctgtaatttaaactatctcaaaaccctatttttgaaatcaatcacttaatgtttttccttatgaccctcatgttgagataaaatgactaaatactttggttgactttaaatatcatttcttatttcttaaacaccctaccaataattaatctttcctataagaataacgttggcctgttggccgggcatcatggcagcaggtgcctatagtcccagctactcagaggctgaggcaggagaattgcttgacatggagattgcaatgagcccagatagcgccattgcactccagccttgtgcaacaggagtgaagctctgtctcaaaaaaaaaaaaaaaaaaaagaatagccttggcctatgacaagctgtctcccaaagacaaccgtgattagaaagccagagcaaaggcaaaatatttccacccaagtacttctttaaaaatgaaatgtcatagaccatatcttcaaatgcatttaagaagtttcccagctatatcttgatattttgctacaatggattattgtcatataacccttaatattgggacagtggtgcctgttgtacttatttgtttcaataaattttgtttcctcattgtttgttacaggaagttcaatttgaatttcttcatcagcattataatcaatcttattgtaattaactcaacaagtatgaaagaattggcagattctgttggaattaggaaaaatgcatctgttttcttccttttatgggctgtgatagtaaaataaatggtgattatatccggaaaaaaaaaaaagcaatgtcatagaatatatcttgaagtatgcaccagaaattgggtcagtggttgtccccaaagagaaggtctgggtgggtaggggagacttatttataatcatgtatccttttgtgtgatacgaattcagtaccatgtgactgtattacctaaccaaaaggaaatttgaggctatatatcatgttgtaactatagctctaaacttacgctgttggttgtaatttgtgtagctacctcttaacttaactttctttttggtaactttccccatcagcatatcttagagggtgggcctttttctcttataagcactttatttgaataatcctttccttcagaggtttgagatggcactttaaaagtttcattcttatacatcatagggtctgtttctaagcagttttttccattctgtcattccaatcttatatcagagacatactattttgattattgtagcttaatatattttaatgccttagaatattatattccccattattgttcttctgtttaaatgtttttcttaattcttcttacctgtttggtcttccttgtccaaattttagaacacttttttttcccaggttcaaaaatctccagtaaaatttttttgctctaaatttataaaattagttgggaagaattcacttcttagaatatttaatcttcccattcaaaaacacagctgtctatttacgccttcttttatatctttcagttgcagtatatagttttcttctaagagggttgaacctttttctggtaagggttgtgtatttatagttttgttgctattgtaaatgtgtttctttaaaaaatacaagcctgggcaacatggtaagaccctgtctctacaaaaaatttaaaaataagctggtcatggtggtgcacacctatagtcccagctactggggagaaataggaggccaaggtgggagatctcttgaacctggaaggtcaaggctgcagtgagctgtgatcatgccactacactccagcctgggcaacagagtgagaccttgtctcaaaaataaaaaatattatatagctggattataggaaaattatttttgtatatttgtattatttcatttttcaattttttctttctctttaaggtatataattatattgcctgcaaaagtatgttgacattttaaaagtatttattagcatatgaaatttagaagagcatattgagttgtatatagatatatattttcatattcaattaaaaatgtaagatacagtttccaggttattgatcagagatagatagtaacttatatattctgcttcagtttatccacagggagagcaaaattcagcattgaagaacctaggttataaggctggacagtttttctaagaatagcaaatgatttcacagacatatacatatgtgaaaacatcaaattgtaccctttatctacagcttatatgtcacttatatctcaaaacttttttaaaaaacaaatatcgcaaaacttttgcttgagttaggctttctctgtgatagtcttgcctttatttgctttcattgaagaattctttaaaagtttttactaatgtattttaaaaggaatatagatcagtagttaacatagtccctgataggtgacagacattctgaatgtattaaatggaatgtaattaaatgacatattgggttatttttccttctttaacaccatgctggtgctcactttttaggaggctgtgggaatcctgagtcctctgcagtagagagatgagtaaagtgcatggggaaatggcacaaatgcccagggaataagggaaaaattttctggggaggtgatggcccaagggatgagtttgccatacaaagaagggggactgaaggctagaaaacaaggtgacaaatcctaggaattaccagtgaagaatcctttgacgttccagaagctctttcatttggttgctagtctgtcttgcccacccctcctgtaggttgtagctttttccttttcatttcttgagcagtacctgacattgggccagacttacattaggcctccagaaacctcttgagatcagtggcatttgtccgcttaccatgctcacacaccgttcttccctttaaccgacgggcactgagcagcttctcctcatcccttgggtattgttctccctaaacaccagtctctgcttatcctgcctcattttccttattgctgccagagttaatcttttttttttttttttggagacggagtttcactcttgttgccagaaaacaaggtgacaaattataggaattaccaatgaggaatcctttgacattccagaagctctttcatttaggtactagtctatcttgcccacccctccagtagcttgtagctttttccttttcatttctcgagcagtacctgacgctgggccagacttagattaggcccccagaaacctcttgagaccagtagcatttgtctgcttaccatgctcacacaccgttcttccctttaaccaatgggcactgagcagcttctcctcatcccttgggtattgttctccctaaacactagtctctgcttatctcgcctcattctccttattgctgccagagttaatcttttttttttttttttttgagacggagttttgctcttgttgcccaggctggagtgcaacggcatgatctcgtctcaccgcaacctccgcctcccgggttcaagcaattctcctgcctcatcctcccaagtagctgggattacaggcatgcgccaccacgcccagctaattttgtatttttagtagagacagggtttctccatgttggtcaggttggtctcgaacttccagcctcaggtgatctgcccttcatggcctcctgaagtgttgggattacaggcatgagccaccacacccaaccaatcctcatttttaaatgaaccctgcctcagcctctcgagtagctgagattacaggtgcctgccaccacatccggctaatttttgtagtttttagtagagacagggtttcatcatgttggccaggctggtcttgaactcctgacctcaggtgatctgcccacctcggcctcccgaagtgccgggattacaggaatgagccaccgcacctggctcttcccttcccctccactcccctcgctccctctttttctctctcactgtctcttcttgagcttctgtggattgcacacccttcctgaaatttaccacccttttttttgccccttacttccccccacctcccaccaccgccttctttgtacagcaaattcctagcaaggccatcacctccggaaaagcctccctatcctcctccaggcagctgccccctcttcccatgtgcttcacttgtctctccatggcagctcttcctacacactgtgattatacttatctctttaagctgttgggagatggtagaaatgtgatattggtttgaaattagaggctttttttggggatagaaggaggctcatgagaagatagtataaatatgtattaatatttaatagaaattagagaggttgtgaagaatccagtgtgaagaaaaaaggtaggaaaagaaaagaggtaggaaagatggtgaaggccagatgttagagagctgtcgacagaaaggaaacctggccagaagaaaaaatgtagtgatgtaaggatgtattttgtcatctcttacattttatttgagaaatattcagaacacttagaaggactaataggtacaggtcacaccctcctcttttctcctctcccctgcccccatactttcagtttaacaaggaaagtagaatacataaaaaaatagagtaaaagtttaataatggcaacctatgtgtggttagggtgcttaagtatggtaggagaggcctggtgcggtgactcacacctgtaatcccagcactttgggaggccaaggtgggcagatcgcttgaggtcaggagtttgagaccagcctggccaacatggtgaaaccttatctctactaaaaatagaaaaattagccggacgtggtggcacacacctgtaatcccagctactctggaggctgaggaaggagaatcgtttaaacccatgaggcggaggttacagtgagccaagatcgcaccactgcactccagccagggcaacagagcaagactccatctcaaaataaaaaaaaaaaattaacaaaaaggatggtaggagaggtaactccagtactaattggtatgtcttaagcactgctgatgagaaagccattcagatacaaagtactggaaaggcagagggtgtactggaaagtactggaaagggtggttggaggagaatcttttgtgtggtggtgtgcacaagttactggggtaaagtggacaggattacaaggactttagtaggagaaatatgggaggatacattgaggtacttggtaagcatggcttttcgtctcaaggtttacacatataaaagcaaggacaaaaacaaccatagcattgtcttgtatttactacaagtcagaaagttgagtatattgccagtctttttttaaaatagtctggtagttttatgaaaagtctaactaaaactagtactgcttatatattgtccattttgagataaaattgtttacagtgatatgttatacataactagctacatgtcatgtaattataactttactttgaactagggtttttatttatgtggcattgtaacatcaaaaggtcacaataccactaccatctactaaaatgtaagaatatcttttgttaattcctacacggtgtcagctaaaagttcttagtgacaatgtaaattcataaggataagacagaagtgtttaagtttgggttttttttagtttgcagcttttgtggggttttttttgcagcttttgttttttataagattggagtagaagtatgtagaatgctagataatttaacttcttcaggttcaattctagtattaattgtttgtcattgtatcacagaagttcatatccagcttttattttttaattttcattcttattcttctatttatttatttttttatttattatttatttattaattttgagacggagtctcgctctgtcacccaggctggagtgcagtggcacaatcttggcttactgcaacctctgcctcccaggttcaagcaattcttctccctcagcctcccgagtagctgggactacaggcgtatgctaccacgcccagctaatttttgtatttttagtagtgatggggtttcaccatattggccaggctggtcttgaactcctgacctcatgatctgcccacctcggcctcccagagtgctgggattacaggcatgagccactgtgccggcctattttcattcttgaatttaaagttaaattattcaaagttgaaatatgtacagaaattctctcacttctattcatcctctcaatggagagagagagaccatatggcctgaaaccacgtccacagagcaatgaatcaatagggagtcctcctttcctgttttgcagtcctaaatgatactcccaatggctttcactctttaatatcagtatcagcaccacaactggtcgtaaatgaaggtcttttccttgaaagggtgactactctttctctcattttttttttcctggcttgatttggctctagttagcacaagaaaacttcttaattttcaaacagcatattaaaaactaccttctcttttaagaatttttctctgaatcccagctcacattggtagccacatactgccaggtatttcccatctatttttctagcatttaaagtttcatggagtcactaatgaagtagccatttgctatatttacttagtcaccatagcaacattgtctcggttagtgtatgcctgggtagcttcctgcagtttgacatgatatgcagctaataattctgatttctactcagaggcaacaggaattttgcagaatagtatttttaaatttgctgaatagaagttatttgatcccaccattgtattccattggcacttatcacatagtcataggattacagaaattttaatttgaaaaaatgattcatacttacatatatcagagtagctggctggagaaacatggcctccatcatcataagcagcttattgaatttctaacctaaacatttttaggagttaaagaagttgatgatcagagggttagaagttgagatttcttaaccatcttgggtgcttagctttaaataaataattctggttttaagacttcagtttttagtataatgtgaaaattgaaaatacttcttggctgggcatgattgcttatgcctataatctcagcactttgggaggctgaggcaggaggatcacttgagcccaggaattcaagaccagcctgggtaacacagtgagatcttgtctccactaaaaataaaattttttttaaattagctgagtgtggtggcatgtacctatagtcccagctactcaggaggctgaggcaggaggatcgcttgagtccaggaggttgaggctacagtgacctatgatcacgccactgcactccagcctgggtgacgagcaagaccctgtctcagaaaaaaagaaatgaagaaaaacacttctcattatagtaatttttccagtctttattctgtaatttctgttaggtcagccttcttgaactgcattacctcattcccttctacccacccaccataagttcctttagtcattactgaaactaacagttacataaatatatttttactttttaaatgtatctccttcagatttcacatagtgtaagtgtgtactttgcagaaaatacattttctttgatagacattgtttggagaagttagtatagcctgttcatggttatagtgtttacagtttcaagaatctgatctaatcttaaatgatgtaaagatgatcacttgaccatctgttacaaaatttgtaaaggctcactttaaactaccaagttcgttttatatctaaattgcttttatgaaacgtactccatattttaagctctaccttgtatatgcattaaatccacaaagctgagtacagtggtacatgcctgtattctcagctactggggatgccgaggcttgagcccagaagtttgaggcagtaatatgctatgattgtgcctgcgaaaagccactgcattctagcctgggcagcatcgtgagaccccatctctgcaatataaaaaaacaatttaaaataagaatgaattaaatccatagaagtccacttccgtttagtcatctgtattctcattttgatctgtataaaaacacagcaggctcaaatccttcttaatttcataattaaccagaagaaacatgggcacgtgttcattccgatatgtatgtttcatttgttcctacctaactcagttgttgaatggctattactaggaaaccaaggctgtaggttcggttgccaattgagcatatcactgtagactgttccatggacacagattttgcccttgcctcagctagcaacactgtgaatgaacttttagccagtcatagaggaaacaggagaatacaacttattataaaacaattgctagctggatatggtggcccacacctataatcccagcactttgggaggccaaggcaggaggatcccttgagtctgggagtttgaggccagcctgggcaacatggcaaaccccatctctacaaaatatagaaaagtcagctgggtgtgatggtgtgcacctgtagtcccagctactcaagaggctgaggtgggaggatcacttgagcccaggaggccgaggttgcagtgaaccgagatcatgccaccgcactccagcctgggcaacagagcgcgtctctgtctcaaaaacaaaaatgaaaaacaaaaccattgccacagttggaaaaaaataatataggagtttatgttttcctactggtgaatcaacctcatcgtctcccactataaagatgtctaccaaagcaacatttgcaaagatggccataagcaacgcagatcatcatattaacagcttaaaaaaataaaacagattttgtccatcacttcttgaacatgcattatggctttaatagcctgtattataatttttaccatccatgcatgttgatgatgcagaaaacatttttatacatttgttttggtcctataataatagtcattctgtgactaaccagagctatgtgaagaatagtctgatatcccttgcattttgtagtttttataggatataaaataagtgactgaaacataaagctgtttgtaaatagagctagcagtgcacataaaataatatacagagtctagatttgtaaatcatcaactattttcacaagcatcttgttcacaaatctttttcctgtatgctaagttgaattgcttttgtactaagactagctttttaacaaaatctgtttgaatggaatcagatattttgtatatttaggaaaaaaactggcttaaacatttttataatgcctttttcctactaatagcaaaaatatttattttattaaagttataaaatgattattaagttcttaatctatccatgggttcaatataaaagaaaaacttgcatgttggccaggtaacttaatgtcagagttgcataattcctcatcagactataccagaccagaaacctatatatcagttagtaaatatgcactttgggcagcttacaaaaagatggtcatgccagtgcggtggctcatgcctgtaattccagcactttgggaggccaaggcaggcgaatcacctgaggttgagagtttgagaccagcctgaccaacatggagcaaccccgtctctactaaaaatacaaagttagccgggcatggtggcgcatgcctgtaatcccagctattcgggaggccgaggtgggagaatcgcctgaacccaggaggcagagcttgcagtgagccaagattgtgccattgcactccagcctgggcaacaagagcgggaaactcaaaaaaaaaaaaaaaaaaaaaaaaaaaaaaggtcatagttgaatgtttattgagaaggctaataacatgaactgacaacattgtgaaaacagaaaatcttacagtagtaattattgtcaacactttgtcaatatggtaaacttataaatattagtgtttctgttatgaaactgaattaatttattatattaccggtaatttccagcagtttctcttttaatttttaaacaattttatttaaaaattaatatttgtgagactaaattctcaaaaccaaacttcatccttaatgaatacatttcaattctttatgaaaaggaagagctgttaacgttttctgacaagtaatgcattatagttcatcattttggcacaggataggcttgagttttcttctgacttcttaaggacatatgtagtgggaggcacttatctttttttttttttctaatgtttgattagcagtttgaaatgctaatgaaattagcaaattaaatggagatttgatgaagtaaaatttgaaattatgtccatatgctttctttcctttttcttttttttttcctgagatagagtcccgctgtgttgcccaggctgcagtgcagtggcgtgatctcagctcattgcaatttccgcctcccaggttcaagtgattctcctgcctcagcctcccgagtagccaggattacaggcacccactaccacacctggcttttatttttttttatttattttttatttttagtagagacggggtttcaccatgttgaccgtgctggtctcgaactcctgacctcaggtgatcggcccccctcagcctcccaaagtgctgggattacagggatgagccaccgcacatggccagatactttattttctgtattaacctttgctgtaagtctttactatttaccacaaaaagtacaaaaaccaattacaaaaatagaaaagagggactgaaaggaggtcttattgtagtagtcttgtgcctgatgccactatctagatgcatttaattgttttctagagaaagaattcatttcccaagtatttctaatcaaaatgtatatgatgtgacttgagaatattcaagggcttggcagtcccaaatacatcacactggtctggcccactgtctatggcctgcagttcccctaaactgttcattcctctgagtcatacataccatcatgggactctgtggactcttgtagatggggagttggcaaggaaccaaaaggcaggaatgacttacttatctaaatgggagagtttaagcagtaggaggccctagaatttgtacttaggcataactgactttctatttatgaaaataatctgggagaagaaatggatagtgaaatctcctgagttgtgtatagtgaaatgatggtgtcaagaagattgctaagtgctctctaaattgattcctcaccccccgccacacatacacacacacacacacacacacacacacacacacacacaagtttatgaggctcagtgtagataagtgtggagtataaaaatctaatcttttgggattatgggaggaaaggtgcctaagtgttactgtttagtgttccctaaaagcattagcctatttgactgttgaggtaaaaataatgcatatgaaataatctagagctgtatagaaaatcaaccaaaagggtcgaggaagtgaaaaatggggatactagtctaagtaaaatagataattgtgatatgataaagagcagaagaggaataaaacagttactttttattcatttgcaccaactatgcagtttgtctgaaagtgaccctgtctcctgtgaagaaaattatataaccttcttgagtcatattttaatatgacgaggaatattgagaaaaataatttttgagactagttaaaaaaatggttatcatgagtaatctgtataatttcaggagatgttccaatgaaatgatttttttctacttttgttaaactcagacattctattcactactggttgaaagtcatatgacgaattgatttgagtaccctaaaagattaaatctaaaaaatattatacctaaagatcagtgaattctttgaatcagatatataagaaattacccaaagctgtaaactgccatatttttatgtttttcggtgctgtggttaaattataattgattataattagcacttccatgaacattgcatgttttacctgcagctgaatgacatttaggaagaaatttttttaatctttgaaaacatcagaagagatagtgctttctgatctaatatagctaaatatcccctatcagaatacataaaggatgaacacagattttacaagtcttgattctaaaatccaatatgtaaactaaataaatattaaaagttgtgcttattcaaataactcccatacatttctgttcaatatgggtactggagtgataataagatgtacaataatagctaaaatatactgaatacatactatgggacaggccatttactaagtgttttataaaggttatctcacttatttctgttataattctcattgttttccatgagagcaccaaaggactaaagaagttgaataacttgaccaaggtcacacctagggatggacctgtaacttaaaatcagagcttggtttcagacctgccataccatggtacattcttttactctaagtattatttaaggctattctgtatgccatgaatttgctttagtctctgatttttaatgcaaagttactggcatggatcaaaaacaaaagatacttcatttttgctctctttaatattgagttataaacattactggttcttctgatagaaaagctttcatccccactcctgggaaccatatcaaattatttaggcactttatttggagttagagtttgaaaaggtttctgtttgtttgtttgtttgtttttgagatgaagtctcactctgtagcccaggctggagtgcagtggcgtcatctcagctcaccgcaacctctgcttcccaggtacaagccattcgcctgcctcagcctccagagtagctgggattacaggtgcacaccgctgcactcggctgattttttgcatatttaatagagaagaggtttcaccatgttggccaggctggtcttaaactcccaacctcaggtaacccactcacttcagcctcccaaactgctaggattacaggcatgagccaccacgcccggcctgaaaagtttttaaagaatgaaactcaagtattttctcattcatcatccattggagtttaaggtgattttatttctatcatggaaagaatagccacttggtcatgtattgaggagtaataaatggtccctgatcagctcaacgttttttcccctcatatatttctgctttatgcctgtactaaaatagtgtctagagtgcgtgattaacaggaaaagcattagcagtaagtttcttctatcacatgctgtcccttatgcctcccctccctcttcccactcccttgttcctcttccctgtcacacacacatttattttggaatccgaactttcgagatgaaaagcagtttactttcataaagtagcatgacacatcatgcctgacttgaagtaaagaaaaaaaaaaaatagtcgggtgcagtggctcacgcctgtaatcccagcactttgggaggccgaggcaggcggatcacctgaggttgggagttcgagaccagcctgaccaacatggagaaacctcgtctctactaaaaatacaaaattagccgggtgtggtggcgcatgcctgtaatctcagctatttgggaggctgaggcaggagaatctcttgaacctgggaggcaaaggttgcggtgagccgagatggcgccattgcactccagtctgggcaataagagcgaaattccatctcgaaaaaaaaaaaaaaaggaaaaaaaggaaaagaaaaatatatattgcagtgaataaattgaaagtaatcaaaatgtataattatttggacaaaatctccaggcagtacagtcttaggtatcttgttgctcacagattcatgagaagcagttgttaggtgagctgcctgcctccctggcccctccccagtttgggcatctgtgtgcttgcttgcaaccagagtgctggtgacttagaagtaacgccactgcttaaggtaaaagtatcccctgaacataccttcaagttccagataaagagatttcaaaaggaaagaatctaagagataaggaaactacgtaagatagtagaaatgttctgatcataagttaagatatttatattttggactgtttagtggaaatcttgtgttgtctagctaacagaggtaatatagtgactctctggaatgctggtgatatactcttcctaaagaagtgatagttaggcagtggattgacagtcttacagtgtttctttgaaaaacagaagttgggcagtaatttaaaaaaataaaacaagacaggcacaaaaagactccattagtctgtcatctatttgaccttactcaacacataccaaaaacttgtgggtgcttgttgtttctaacagaaatcttggagaaaaccaagtccagtgtgaatcatcattccctcactgggcataggccctttcggaacacatttgaatcagatgtataagaaattacccaaaactgtaagctgccgtatttttatggcatataatggacatagtgtggacattatatattttcttaaatagctataaatattttaaattgggatagtatatatttaataagctttaaaatatgcctgcattgcttcattatatctaagatgcaattatgatacaggtgatgaacacaaaacaaggaatcttgaattttttcccccactctgccccttacaagctttatggtcatgggcatgtcacaattctgccaggacttaattagggatttgaattatatgagaatatagaagaattcaactcagtattaagtctttcactaagagggagctattaggttgaatcttatgaagatgctagttttatataccaaaaatgttccaatttctgtattatgtagagggattttttttttttttttttttttttttagttcttagcctgaacaccaactgccatgcactctcctaagaacaatctaggagagcccatcagccaactcatggattcaccttaggatgggagcatggggatggaagggaagggaattgcttttcctttcataagactgtagtcttgatgccagtggttatttcccacttgtgtcatgactttgctgcttctagtaataactctttgttgctgctttgtttaaaacaaaaaacccctggaatatagatatatatagatcaggacagccaactagtggcctggtgtagctagtgtatgtttttttggttttgaaagggttttctgttggtttggtttggtatgggagaattgctcattttaaaaattgaattagttagcaatatttgttaagtgatttcacagaaaattataattactggccgggcagagtggctcacacctgtaatcccagcactttgggaggccaaggtggttggatcacctgaggtcaggagtttgagaccagcctggccaacatggtgaaaccctgtctctaccaaaaatacaaaaattagtcaggcatggtggtgggcgcctgtaatcccagctactcaggaggctgaagcaggagaatcgcttgaacctgggatgcggaggttgcagtgagctgagatcgcaccgttgtactccagcctgggtgacaagaggaaaactacctctcaaaaaaaggaaagaaaattataaattcttgtctgagcatggtggctcatgcctgtaatcccagcactttgggaggcccaggtgggcggatcacttgagctcaggggtttgagaccagctgggcaacatggcaaaaccctgttattacaaaaaaaaaaaaaaaaaattagaaaaaattagtcgggtgtggtggcatgcatcttttatcccagccacaagggcagctgaggcaggaggatcaaatgagcccaggaggttgaggctgcagtgtgtcgtgatcataccacagaccactgcactctccaacctgggcaacagaatgagaccttgccttaaaaaaaagtaaataaatataaaatatatatatatatatatatatctgcattcttaaatagttagaagatctgataataaacactgtgcctacattcctacagggtgataaacagctagagctgagtacttgctacccacctggggtggagcatattctctattttctggttcactctagccccagcttctctctcttatgttctactgcactggacaggcccctgtagacatttgagtttgtgattctcttccaccatccaatagattttctgcaatggtagaagtgtgttatatctttgttgtccagtatgatagccactagctacatgtggcaattaagcacttgaaatgtggctagtgtccttgaggaggcgaattcttaattttatttatttttaattaatttaaatagacacggctagtggctaccatattggacagttcaagtcaataatggagtattttcctttattggctatttcctacagagtgaaaagcaagccttaatgcattttatatctattctcttaaatgctgaatctaaatgttagcatatattactgtaagccttatgatttgaaaaccaaataaccctctctgatgaaatggagcctgagacttttcttcttttttcctccttatttatttattcaacgcactgggttttacatgcctgttctgggccctaggcatatgatcatggtccctgttttcatgaagcttacagataattaataaatatttgtaagagatgcttgcccaagtaatttaatatttactatctgtaatcccttcagtagccctgccagataaggatataatacatttacttgttaattccaagccctaaaatttcctcattgccacttagattcacttctaatagattgacgtatacttactattgcagtcctctgaaaagcatcttactcccaaaatattgaaacttcctataaaggtgctgttttaaagctaggcttcttcatatctttttcatattagtaaatcagctcaaccctcaccctattacttcacctggcctttctcctggccttctgtctgccttccaagctgcgtcttctgctggcacttcttttttttttttttttttttttttaacttgactttgggccaagtatgtgtgctctcactcacgggcagtctcagtaactctactgctcttcctgcttcttgctgtgaaaacttttttcctcctttcaccctgcaaatgtcagcctccgtctccccctttcaaaaatgaaatacacatgtttagaaaatacacattcttttgtagaacctatcctttaaaaaataacaaattgcaatcaaatgcacaaaagatagatgaatgctggagtgatatatttatgtttttaaatgacttctacattgacagttgctggtggaaacatttgttgtttagtgtttttgtagttgtttaattccattgataacaagattagcaaggcagtattagggcttttgcttagacatgaaaatagtccacatgtattaaattaggcagaattatagtatttgttaatataggactcagcctttttctttgtgatctaattgtctaacaaaggtgtcatttattcatttgcttaaagaatatttattgagttgctattatgtgagaaatgctgtacttagaaatgagataaatggaggatttattgactaaaacttacagatttctcttccaaatctgccagcagtttagattgagagtttggcattttttcgtttagttaggtcttaccagtgttcatcctgtaaaatacttggaggatgtatatgctactattatttttattacatgaattttgtattttcagaatatacacagtaatttgcaaattaaattctcagtatagtacataacttttcacaaagtgtaataatgaagtacagttgtttctcggtatccccaggggattgattccaggactccgtcacataccaaaattctcagatgctcaagtcccttatataaaatggtgttgtatttgcatataacctacctccatccttctgtgtactttaaatcaggggttcctcaacgcctgggccgcatactggtccgtgcctgttaggaaccaggccaaacaggtggagtgagcagagggcaagtgaacattactgcctgagctccgcctcctgtctgatcagcagtggcattagattctcaaaggagcatgagccctattgtaaactgcaactccgagagatctaggttgcgtgctccttatgggaatctaactaatgcctgatgatctgggatggaacagtttcatttgccacaccctccacgctgttggtggaaaaattgtcttccacaaaaccagtccctggtgccaaaaaggttgtgggaccgatatgttaaatcatctcttgattactttacaatacctaacacaatgtaaatgctgtttaagtagtggttttactgtttttttttaaatccattttgttttattgttgtttttgggttttttgtttgttttttgagacggagtctcgctttgtcacccaggctggagtgcagtggcacaatcttggctcactgcagcctccacctcctgggttcaaacgattcttctgcctcagcctcctgagtaggtgggattacaggcagctgccaccacacccagctaatttttgtatttttagtagacacacagtttcaccatgttggccaggctggtctcaaactcctgacctcaagtgatccacccaccttggcctcccaaagtgctgggattacaggcgtgagccactgcgccctgccagttttttgtttttttaaacaaatattttctatccacagttggttgaatctgcaggtacccaatatgcatatacagtggcccaactgtaattttgacaagggtgattatgaaccatggttatgtcgcaatgacttagtgacactgagttactaggagtcttttttttcagtgttataaaggagaatgtgctttttctgtgtgtgtatagaattgtattagttgtagggaggctgatgactgtcaaggagaaattactttgaactaagttcgtgaagtttttattagagattttattctgttatatgaccttttatgggaccatatagagttaggattaatagcatgaaccctagattgaaaagagaaaaatccaattttgttttgtttttgcttactatgaggaaaaaatgatattgagatgatataggaaaagttcttaccacagtttccagcacatagtaagtgttctttaaatgttttatttttgttacagttgtcattttattcttgttgtatttctatgctaggtagcccttgagctttgtttttttgatgggaaaaaatatgagcttaaacttactctttagataataataatagaaagactagtaattcaagaagttgatcttgactgtttccttataatagtaacaaagctatttaattttatatgaccaaggttatacaatgatagtcattgttagtcattatttctttctctttttttgagacagagtctcactctgttgcccaggctggcgtgcagtggcacaatcttggctcactgcaacctccgcttcctgggttcaagcgattctcctgcctcagcatcctgagtagctgggattacagatgtgagccaccatgcctggctaattttttgtatttttagtagaaacggagtttcatcatgttggccagactggtctcgagctcctaacctcaagtgattcggcctcccaaaatgctgggattacaggcatgagccaccgtgcccagctggtccttatttcttgtccggagaaatgagttgctcttgaagctttctacatcagatgtttgtatctattttaatataagtgtgagacagaaagagaaactgatatcttcatgtaaaacattaagaattcaaaatagaaggtggtaatttttcttctcttattttcaactggaatagtttttctacatctgaaaatggaacacataatttacaaattttcaagtaaaatgtggtgaatcccataggaaacagttttacagagatgtagtctgtctaccctgcgtaggttatagttgctgaagccagaaatctgagcccagttattctttaaaattttttttttttaatttttagtaggtttttgaggaacaggtggtgtttggttacatgtataatttcttcagtggtgatttgtgagattttgatgcacccatcacccaaatagtgtacactgtacccaatgtatagtctttacgcctcatcctccctttccttacctctcccaccaccacatccccaaaagtcattgtatcattctcatgcgtttgcatagtttagctcccacttacaagtgagaacatacaatgtttggtttcccattcttgagatacttcacttagaataacggtctccaactccacccaggttgctgcaagtgccattattttcttcctttttatggctgagtagtattccatggtgtgaatatatatatatatatatatatatatatatatatacatatacatacacacacacacacaccacattttgtttatccactcttttttgtatccactcttttttgtatctactaaaaatacaaaaaattagccgggcgtggtggcaggtgcctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaagctattctgttagacagatacctggtttttttgtttgtttgttttgtttttgagatggagtctctgtcacccaggctggagtgcagtggccggatctcagctcactgcaacctccgcctcctggcttcaagcaattctcctgcctcagcctcccaagtagctgggagtacaggtgtgtgccaccacacccagctaattttttgtattttcaatagagacagggtttcaccgagttggccaggatggtctcgatctgacctcatgatccacctgcctcagcttcccaaagtgctagggttacaggcatgagccactgtgcccggccacctgtatcctgtattttatttttagtgtttttgatgttataactcaggcaaataatttagggactactttcaagcttcaccaacttgaatttccaagaataccattctgaagttacctaaaattaaaattgcagtttttgttgttgttgttgtttgtctgttcatttgtttttgagatggaatctcgctctgttgcccaggcatgagtgcagtggagacatctcagctcaccacaacctctaccttctgggttcaagcaattctcctgcctcagcctcctgagtaggtgtgattacaggcgtgcatcaccacacctggctaatttttgtatttttaatagaaacggggtttcaccatgttggccaggctggtctcgaactcctgacctcatgatctgcccacctcagcctcccaaagtgctgagattacaggcgtgagccaccgtgcctggcctgatttttttaaataaatggagttttatttcattagaatgaatactagttcaagcttgactaaatttgttacttgatacttaatagtcttacattgtgacaaatagatatgcgtgatttatgactagaatagcaattattttatagatgtactgtatgtttccaagcactttctctatgtctatggggaacaccagaaggcatggttagtcctggcatttgaagaatatatatttatattctgaatttgcaccaagttttttttgtgtttttttgttttgttttgttttttgtttttttgtttttgtttttgtgtgttttgtttttttggtttttgttttttgtttttgagacggagtttcgctcttgttgcccagactggagtgcaatggcgcgatctcagctcactgcaacctctgcctcctgggttcaagcaattttcctgcctcagcctcctgagtagctgggattacaggcgcctgccaccatgcccggctgatttttttgtatttttagtagagactgggtttcgccatgttgggcaagctggtcttgaactcctgacctcaggtgatccacctgtctctgcctcccaaagtgctgggattacaggcgtgagccaccactcccagccagcaccaagtatttttttaatggtttacaaaacaaagtaaaatgtagcctggctgtatctaagtgatcagccattatttttctatttgtttcctgaaaacaacactgtatttttaaattttctgaaaaagtggagactcattttttaaaatggtcagggtagccttttagcttgctcccaagtcagcctaatacctctgtgtagtttgtttggaaatatgtggtgctttacgaaccacatatttccaaattatattattttgtacaaacctagataaaccttaccttgactttgaaagcatatcaaggtcagtaatgtttaatttagtacattgttcagtgatgaaatggagttgccagttgttcttgtcacttcatgagatagtgttaaatgaattatttagtgttaaggaccctgctaaattattttaaacgattcaaagcgagttaaagtattttaagatttagttctttgttatattttcagttcatacattaacctttttagttttgaatcataagttgtcctcttttaattaaaacccttgtggttgccttttaaatgtatgatagaacagttaaatttttaaaatgagtttatttttaaaaaaaaaatcagtgttttcctttatgtaaaaggttaaatgctttgaggataaaaactgcatgacactgtatgagtgatgaaattggcttttagaattgtagaattaaaattgaaaggaaagtatgctgcataaacctgagtctggatgcagtggctacaaataaattcaagtgtaagagtgtgaccagaataagctaccgtttataaagaagcacttcactaaacaaactgaaaccctgaggaattttcaaattgtgaagtaatgggaacaatcatttaatatggaaggaaggagctagtgcatgcctccttccttggatgtctcataagatcaaatcgtggagatgactgaaacagggaagataatttagcggcaacataacagattaccatttagagaggccaaacccctgagagctgattgcattagaggaggatggggggccaagattaggacacaggtgtgttcagaaacaggctgacacttacttgtgtttcccacccactcccatcccccaccaagttaacacatttagctgtcccgacactttgtaaacattcctatatctgtcttcaatcttttttctctctctaaaggtttatctcttagaagctttgacataactttccttggaggaatcatttccacctaatctttttgccttatctctttttttttttttttttttttttgagacagtctctctctgtcacccaggctggagtgcagtgacacgatgttggctcactgcatcctccaccttctgggttcaagcgattctcgagcctcagcctcctgactagctgggattgcaggtatgcactaccatgcccagttcatttttgtattgttaatagagacagggtttcaccatgttgcccaggctggtcttgaactcctgacctcaagtaatctgcctgcctccacctcccaaattacaggtgtgagccactacacccagcctgccttatttcttataagcatgagcagctctgctccagtttactctcaaaatgcacaccttgggattaatattttctttttatcagtatgcagtcagttgtcctaccatccctccatcacccttgttcatcttcagtactgcagttaattatagtattaaatgcttgtcttccactagagcaagtctttactgctatgtctccaacctctaacccagtgcctggcagaagtgggtacccagtaaacacttgctggataattgacagcaagaggctccttccagagtctggctgtggcacagctgcagccagaggcagatacaggagaatggtaaggagaactggagagatacgcagggactagatcccaaagagtcttaaagtcctatgaaggaacttgtgctgcaccccgagaatagtaagaggccatcgaagaatcattaatctaaatccatccttgggttgcacatctcccttctagactctagctagttgatttctcagtcttagcaagaaaatttaatccttgttcatagaaactctgtgtggcacatgaaaagcaaagtataattgtaagtattatttatggttacatatccagtaagtttctaaagacacttccagagaactttttgtactttataaagtaaatcatcttgtgtatttaaaggataagcatggatttatatgtaactggaataatttaaatatttacatttccatacagaaatgagtatactgaatttggggatcttggtaaaaacaaaacctatggcatttttagatttcaaattgaaaaggcaattggtaaatatcttatatcttctcagcaatttgatagtatatacctgaaaataagcagaagtaaatagagaattatcttcatccaaggaattaaataataggaatgttatacagacaccttttatacttaattctgcttttgaaggaatttaaaatggaaattgtttttaatttctattttattgaaccaaagaatttaaagtcccattcaaataaaataatacataatgttaaacttgtattattttttaatagccagcatttttgtggttttcaaatgaaccatccaaggaattatagtatttcttctctttttaagaaagtgtacttcttcaggttataaaagtagtaaatacttattgcagaacatttagaaaacaaacttaaaatgcatccagtctgatctcttccttcccatctttcatgttagtttcaccatttaaaaaaactgccttttttttttaattaaaggcaattttctaacatcgttttcaatttttttgctgtaaccattgcatctcactgcttcctattggattcattttccttcttactgaaataaattcttgagtagtttctcagtgaggatctataaataataaacataagcttttgtccaaaaatgcttatgttttacacttactcttcaattgtaatctaactagatatgttaggcaattttcttaaaaaactgcaatcttatattttgatatcttgctgatgagtttaaaaggtacagtgataacttttgcatcattaaaaatagttggcttagaaagctgtacttttccttccttaaaacagttttttaaatttactgtgctgatataccaagtgaattaattttctaaataagtaaatgattataagccttgctatacttaatataaaacaaaatatcctaagatagctacttaaatatacatgtactagtcagctattgttttataatatactatacatggtggcatatattttcaaaagcagtgttttgagttatattttattttctgagacatggtctctctctgttgcccaggctggagtgcagtggcacagtcacagctcactgtggcctcgacctcccaggctcaagtgatcctaccacctcagcctcctgagtaactaggactacaggcactgtgcctggctaatttttttttttcttaattttttgtagagacaggatcagtttagatggtgtcctgcagtagttctagagcagtgctgtctaatagaggtttctgtgatgatagaaatgttctctctctgtgctgttcagtaaaccttgagtgttgatgtattctctttttatttacctttatcttttatcagctgagtagacattttgaattaataacttgattgattttagaccatgtaatttaagatgatttatttttacatgaagattttttcccccagaaatttaaggctgattagcttcttggttttagtggttaagatttgcctatataataagcgggtgaaaagtacattgtggcattataatgagttagtttgtatatttagcttgtgtactggtttctgcattatagtcacgtatattcagtgcatttttaaagtattaaggctagtgtatcctctgaggttacctttttatatattagttttcattgaataagaattatagaaataataactcttcatatttcactctgctaaacaagagtgttaataatgccttatattttttttcagattgcaaatagaagagtcttccaaaccagtgaggctatcacaacagctggacaaagttgtaacaaccaattacaaacctgttgctaatcatcaatacaatgtaagtcttctgcttgtctcttttcattcttttatatcttcattcttttctgtatcatagagtcttaggtttccaaagaacctgagaatttacacaccttgccatcaggtgcttgaattacagtacctgatctggacttagtaaggaatatgacaatttgctaaaagtacagaaaagatgttcactctacattgcaagttatatcatggcaaaaagaaggcaaccactgtttaaagtacccttgataaatttttacaaagaagtaaaacacttcaattctcaatgttgcaatgttgctgatgttttaaattacaatgtactaactaaatattagttttactatttttaaaaattattctatacctttgtgatgaaccataagaaagtttttaatgtgttaaaaaattttaaaggtcatggaacagcagtaatttttctcattgattattaagatcactttgcctgatttcagctttcacaggcattttaatggtctcatactaccatgcaaagtgaggaccatctgtacagtagtactcccttgtccacaattttaaaactttatgcagtttcagtgacccacagtcaactacagtcaaaaatattgaatggaaaattccagatgtaaacaattcataagttgtaagttgtgcaaccttctgagtagtatgatgaaacctagcaccatcttgctccatcccatccatgatgtgagtcattcctttgtccagtatatccacattgtatatgctacccacccattagtcacttagtagccctcttggttaacagatctattgacacatgataaaaagaaagaagaggctgggcgcggtggctcacgcctgtaatcccagcactttgggaggccgaggcaggcggttcacaaggtcaggagatcgagaccatcctggctaacacagtgaaccccgtctctactaaaaatacaaaaattagtcgggcatggcggtgtgtgcctgtagtcccagctgctggggaggctgaggcaggagaatgggaggcggagcttgcagtgagccgagatcacgccactgcactgcagcctgagtgacagagtgacagagcgagactccgtctcaaaaaaaaaaaaaaaaagaaagaagaagagtgagtacagaacaccaagatattttgagagagtgagagagagagagaccacattcacagactgttattacagtatattgttagggttattctattttattatgggttatttttgttaatctcttactgtgcctaatttataaattgaactttatcagagatatgtatgtataggaaaaaccataatatatagagtttggtactatccacaatttcaggcaccaagtggggcagggaggtgtcttgcaacatatctcctgccaataaggggaaagtattgtatatttatatttcaagacttttttattgttgtgtatcttatatgtactatatgtattatacaatatacacatttattgcatacatattatgtatactttgtgccaggtattggtctgagtgcttcgtaagtaatgacacttaatcttcataccaaccctatgaagaaactacaacagataaggtaacaggcagagagactggcttacctgaggtggtgcagccagtaatttatcagtccaggtgttgaacttaggcagtctagcttaggagccatactgttaaccactgtgtatgttgccgctggtgattagcagttgctaaaagggctaagggttttgggttttgaaatatctgtaatgtaataagtgtgatggtttcctgaaaataaaatacctaagttaagtcaaatagcaattaacagttggaattttgtatcccactttgttgtttaagattacctttgatactgagtttaggaagaaaattttctttaagactagccttggcagagtgcggtggctcacgcctgtaatcccagcactttgggaggccaaggcaggtggatcacctgaggtcaggagttcaagaccagcctggccaacatggtgaaaccccatctctactaaaaatacaaaaattagccaggagtggtggcaggcacctgtaattccagccactcgggaggtgaggcaggagaatcgcctgaacccaggaggcagaagttgcagtgagccgagatcacaccattgcactccagcctgggggacaagagtgagactttgtctcaaaaaaaaaaaaaaaaaaaaaaaagactagcctttagtatcaacatttattaagtgacacaggatagcatctaccaaactactactttatgatatttgaatggttattttatatgaaagtagcaaatgccactagggctaagtagatatcttaaatgagtggaacaatgaaatttaagaaagtcagtgttagagactgtgtgaactggagtgcacatgacccatataaatacattcacattttgaaattgctacactatgtgagttaaacaaaccaggtaaaagttcaactgcattcagccaagctttcattttatagcctctggttatgctttaggaggaaaataaactaaaggacaggtaaggtttcagatgatccagaagaggtatttttctgttgttttctgacttagataaatagattaaagtccacatctttgttctcttccattgtagtcttttctactgttggatgggaatacacacagttttctgagagctacgtgtaaatagagattctattctactttgtaaaacagtatagatcttagttgtttttgcctttcttcctcattggtgtgctgcttctgtagctcctgactcaccttttttatccttttatgggccaggcttctctgtgatttctacccttgtgtatatttttattacagtgggtacaagaaagactgcactttcataggctgtaaagagttgttacctttctagagggaagtttggtaatttatgtcaaatgcactataaaaggatatatcctttgacctagcagttttgtgtctaggaatttattatagtgagaccagtgctcaatgatatatatacaataatgcttctctctattatttaagataggaaaagattggaaacaagtgtcccaaattggggattcattaaataaatattttaagtcattatttttggatggtaggatctacgtgattttatcctaattttcttttttataaaatcttctccaattgttgaaattgtcacagtgagcacgtattgcctgaattgttggtaagcaataaagttatgttgggaaggggaagattggaaaggaaagaaagccagggaagaaagccataatagtaccttactgattgtctaagatttaccttctttaaacaagtactttttaaatatctgcttcgtgtctgagatacatacccctggtgaataaagtaagtacaaacatgttatattctgaactccttagtatataaagctatagcaccctctataaagataattaacattaagtgacattttagttcaagatatcaacctttgttaaggttgtcatagtgaaaatgagtcattatagtaatgaatctttgattaagatttttacatccaaacaaagattgactataatctaccacattgcatttgaatgtttaatcattatttcttttgggagtaaaccaggataggcacctgcatagctttaaaaaacatattcagtattgtagtgtaataccaactatagaaagagtataacatttttgttatttattagaagaggacattgacttttaaaagactgagaaacataaacgaacacaggtcagcaagaatgatttagaggaagcataataaagacttttaataaaaaattttaactcgatataatgttgaaatgttttgaaagtcttgccagataaagttatataaacatgaagctcagtgtttcattctaacagttgagcttctttgaatgcaattttcagaataaaaattcaaaaaaaatttgtacaaaaaagtgaaagagggactgggaaattgcatatgtatttgaaaaacaatgttcctacatttggtcagaaagaaactaccttgcatttacccacagttttttcacccacctatggcaaatagatgaatttacctgtatatatgtaaagaaaatatccaattttgttcttggagctattctaagaattaaattcagatttatctttttagttcacaaactatctgggtataatgtctgtcatacttgccattcagaaaccatctactgggccaaaaagaattatatgattatttttatctcttagaatactccattgaaatcgcacccctgaaaaccatcttcttactaggatatgacatgtcaggttttttttccctaagtggcatttcctgtaccttaaatcttcattgagtgtctgaaacttgaatcagttcatgtaggtcagcattttccacagtaaattttttgtaacattaactaggtgagatggtcacataaaaaggattctgtgtttaaaaaacttgtagtttctgattatatcctcctcttaaattgacacttcactttaatatactcaagattagtaagctttaggaatttgtttaatcctgcacttacaaacatttgaacatcaaatttccccccattgtttgaagtagtgaaaacagacattgggaaataatggagatgtcaaagtatggtttacaagagggcccactgggtgagggggaaaattattatatttatattattataaaacttacatgtatcttgtttggcacctagtaaaggaaagaaactgagctttagaaatactatgtagattgaccctggcatctttttgcagctcctgtgctagtcggtcgtttttcagcagaagagcggaaatgggacaggacagaggggttgagcgttgtgccttcatgttttcatttgctttcagctttttagcattggtgctcaattcagagatttacagattatagtatctatttttaactaaactcagtctcaacaaatgatttctgcagagaaactgtcaattagagataatactaataaaccaagcatatgtgaacaagaaagtgaaaaactgaacttctcttgcttctaaaaatggtttatcagtcaatctttgaggtgacaaacagtgatgatgtaatcagatctgaaaagaacttggcccttccaaaaaggaaattatcagtatcattttaaatatggcttgtcatgccctgtctttaatgatgactcagttagtgtctatggtggaatcaaaaacaactctagatattccaagcagaaaagaatgtaatgtagggagttagttacaaatgatttaggaataccaaatggatgggctggagttgcaaaaggaagaagagatcaggaagctgctgcagaggtgctcctgcaatacaaaaaaaaaaaaagaagaaaaatctccctccctcccactttcattctcctattggcagaaccccagctggaaacccgctagcaagggaatcttggaaatgtagcctgcagacctcttgccaccccacccttaccaccaaggctagagttgaagacttgttgcaaaataactggcaaagtggcccttgacctttgtgagtgttgtaccttgttatattagcttagctattgctgatacaaagctatcacggtgttcaatgtatttaaaaactaagcatacagaacatgaatgcaaatcactgtattttgagagcaaaacgaaaacgtattttgtagttttgacaaaacttactcttaaaattatactctttcatccctttaaaattttttatcttgtgtatgcttatatctatttataaatacagtagtacgtttgtccagtttataaagatatatgcatagctcatgcttttaattttttgctcacaaaggtgtataatcaaagttatagagtcagctgatgcgtaaggttctttgcaactccctccaactttgaatccaagtaagggcgactctgtgtgttctggttgactttgtgaacatcgtatctagcctatgtaaatttcatagcattcttttatgtatttcatggcctcttataaactttctcataaggaattccttttcttctcataaggaatcatgtcctctgttgtctagacatttgttttcggtgttgctgtatactagaatcacctgggaagcttttaaagaagaaaaataggccgggtgcggtggctcacacctgtaatcccagcactttgggaggccaaggcaggtggattacctgaggtcagaagttcgagaccagcctgaccaacctggtaaaaccccgtctctactaaaagtacaaaattagctgggtattgtggcacatgcctgtaatcccagctacttgggaggctgaggcaggagaattgcttgaacccgggaggcggaggttgcagtgagccaaggtcatgccactgcactccagtctgggcaacaagagcgaaactccatctcaaaaaaaacaaaacaaaacagaaaaataccctcagaaactgatttggttaatctaatggggaggccagccatcttaagtttttaagcttcttgggtaattctagtatgcagccactgaaccaaagagatgagaactttttatagttctgccatctcctgttgagggtggggtgttcagtaatggtacttagaaggaaacctctttctcgcaaacctagaacttttttttttttttttttttttttttgtgagacagagtctcgccctgttgcccaggctggagtgcagtggcacaatctcggctcactgcaagctccgcctcccggattcatgccattctcctgcctcagcctcccaagtagctgggactacaggcgcccgccaccacacctggccaatgtgatccacccatctcggcctcccaaagtgttgggattataggcgtgagccactgcgcctggccaaacctagaacttttaaaaagaattaatatttcttttctttgttagaatttctgccccacagtttgaaaaaataagttttctctctctcatttttttttttcttatttctggtaaaagctcttggccagaaagaactcgaaaaccttaactgtgctcagatgggtaagagaaaaaaaagaaaagcttacttagtaaactggttgttgaggtaaacccccaggaactagaaaggaaattcatttttatgcatatatgctctgttcccttcagtgtggcagccgactgtgttagtctgcagaactaagatttggggtttgagtggttgatcttttaaagttctatgcataaatttgaattttcctaaataaaaaggatgtttgtaggactatatcatgagggcttttcagtaatatttgcctgttataatacatagtataagtatactacatgctttgtccatttgaatttgcacacaaaggactgaccaattctaaagaaataatttcctcccaagagataatgacacactaggcagaaatagaagcattagttgaggggagggggaataatatctcataaggatttaacatgcagaaccatgatattcaaagctgtcatgctcacttcaaaagttaaaaggctttacaaagactgccttgacaaaacacagtatttctgcaaacaataatctagaagtttatagatgtctgtattataaattttaattggtagtgggtggcatttataattttagtcagtgattacagcttcagtaatgatggttgaacatatatataccaaatccacaaaggattgtcaacatttggttgcattttagtcaagaataggctgggcgtggtggttcacacctgtaatcccagcactttcggaggctgaggcgggtggatcacttgagtttgagaccagccttgagtttgagaccagcctgggcagtatagccagacctacctcttcaaaaaaattttaaaaattggctgggtatggtggcatgcccctgtagttcctggagttcgagaccagcctggccaacgtggtgaaaccctgtctctaataaaaatacaaaaattagccaggcatggttgcacacgcctgtaatctcagctattcaagaggctgaggcaggagaatcacttgaacacgggagacggaggctgcagtgaggtgagattgcgccactgcactccagcctaagcaacagagtgagaccccatctcaaaaaagaaaaggtttgggggccgggtgcagtggctcaagccagtaatcccagcactttgggaagccgcagtgggcggatcatgagatcaggagatcaagaccatcctggctaacacggtgaaaccctttctttactgaaaatacaaaaaattagctgggtgtggtggcacgcgcctgtagtcccagctactcgggaggctgaggcaggagaatcacttgaacccgggaggctgaggttgcagtgagctgagatagcatcactgtactccagcctgggggacagagcaagactccatctcaaaaaaaaaaaaaaaaaaagaataatttgtgttctgttgtgaaaattaattgtatatgatggattttttggtaaaaatttgtaactgaagactaaagtactttctgaattgacatttatttctatatagtcagttgcgcagtgatctgtgatcattggatagaagattggtaattaaaattcacacaatataaaagctgtttctactccagtcttactaagagttgtagtggctgccaacaagttagatatctgactgctttaatatcatttccttacagtgcctgagctccactgagaaacaaaatgcccaaaaggcaaggagctaaaaagagaagaaataacattatctcaaaactgtaatcttctcctaaatagaatagttcatatcattggtagtttatttgtacagttaattttatttgtagtgtcaagttgtgaatatagtattaagattaccatttctgcactgtttagttttaaaaaattacctcagtgaccttggttttgtcctaactataagttattaataacttaatggccatggaaattatttaaatccccttcgataattacacatacactggaactacttatctgataccacagagcagaatttggattatgagcctgtcttagacattatcaaaaaaaaaaatttaactggctgggtgcagtggctcatgcctgtaattccagcactttaggatgtcaaggttagaagatcacttgaagccaggagtttgagaccaacctcggcagtatagccagaccctatctcttcaaaaaaattttaaaaattgactgggtatggtgtcatgcccctgtagttccagctacttgggaggctgaggcaggagaataatttgatcccaggaggttgagactgcgatgagctatgatcacaccactgcactctagtctgggcgacagagtgagatcccatctctaaaattagttaactaattaaaacaataatatttttgtagtacagtattagttaaatctttaatttatttttgagacggtgtctcactccgttgcccaggttggagtgcattggtgcattctcagctcactgcagcccctgcctcctgggctcaagtgatcctcccacctcagcctcccaaggagcttggactacaggtgagtgccaccacacccagctaatttttgtagaggctgggttttgccatgttccccaggctggtctcgaactcctaagctcaagcgatccgcccaccccagcctcccaaagtgctgagataacaggtgtgagccactgcgcccggcctaatctttattttgttatttatttatttatttattgtcttagagacagaatctcactctgttgcctaggctggagtgcatgagtggcatgatcatagctcactgcagcctcaacttcttgggctcaagtaatcctcctgccttagcctcctgagtggctgggactacaggctcgttcatggctaattttgtagagatgggtctcactttattgcccagactggtctcaaactcttggtctcaagtgatcctccccccttggcctcccagagcactaggattacaggtgtgagccaccatgtgtggccataaattttgttttaaaacaatcttctataaattatcccgtagttaaacagtccctgaggacattaaagagatgttctgtttttatttttaaataaatttaaataaatgtaggattaaatttaaagtacttaaatttctctagtgaggaatgtttctgttttgttcttgctatcgttattttgtatgtctgggttttcagactaaattttttttttttttgagacggagtctcactctgtcacccaggctagagtgcagtggcgcgatctcggctcactgcaagctccgcctcccaaggttcacaccattctcctgcctcagcctcccgagtagctgagacttcaggcgcccgccaccatgcccggctaattttttgtatttttagtagagacagggtttcaccatgttagccaggatggtcttgatctcctgacctcgtgatctgcccacctcggcctcccaaagtgctgggattacaggcgtgagccaccgcacctggcttacagacaacatttttaagagtttttgtttactacagattatgtagtcaggataccttgaaactatgcttccaggtggctatcctcaagctttgggctcgaataaactatatagttaattttattttctgaatctcattacttaagattgacatatgcctgtcaaggacaataactaccatggtttccagtgctttgatgaaaccaaacgccatgcatctgaggttttatgttgttggagcattcattgcatccctgggggttgcagctctctgtaagtttgctgtgctgaagcaagaaataaggcatatgcagatttcttcagaaattaggattccatgaaagatattgaggagatgaggaaggctggtatctttcagagtgcaaagtggtttgggaatataaagaatttgcttggattgaatcacatggaagtttgtcactgacttgtgttcgtgaactatgaaacacgaatatctaggctgagaaagagttcgtcttgataagtaaacaattaacaaatatttcggacaggaagaaaaaaaacagtttttgttcactaggcaaatgtagaggtaggctgcagtgcccccaggaactaaaccagtgatatacatgttaacacagaaagataagcatatatttttagtctgtttttctaattttaaagagaaagcaccaacattaacttcaatttgagattgaagcatgtaaaccaagattttttttttattttttattttttatttttatttttttatttttttatttttttgagacagagtcactctgttgctgagagtggagtgtagtggcacgatcttggctcactgcaacctctgtctcctggcttcaagcgattctgctgcctcagcctccctagtagctggagatacaggcgtgtgccaccacgcccagctaatttttttgtatttttagcagagacttggccgtgctggtcttgaactcctgacctcaaatgatccgcccactttgtcctcccaaagttgctgggattacaggcgtgagccactgcgcctggccccatgatttttgaaaaatctgggtagaattcggtaattttcttactactcattaatgttactaattacaacttaatccgacccttactcttatccctagtgttgattttaaagttcttttctaatttattaatttttacctttgattcaggtcctcttgcatctgacatgtgactctgggttgggacaacttgataacaacacttaagttttctctccacagccaactagaatgtgcgccctctgtaaagtaggttatcttactttaccagtgggcttatttgaaaacatttttcatgttaaacttcctagcttctccaatcattttacacaagaaacagcctactgaaggtggaaactgagtataccatcacttctctgctatttcctgaatttaacttgagactgaggccaggcgtggtggctcacgcctgtaatcctagcactttgggaggccgaggcgggcggatcacgaggttaggagttcgagaccagcctggccaacatagtgaaaccctgtctctactaaaaatacaaaaattagctgggcatggtggtgcgcacctgtaatcccagctactcgggaggctgaggcaggaaaatcacttgaacccaggaggtggaggttgtggtgagccgagattgcaccactgcactccagcctgggcaatagagtgagacaccatttcaaaaaaaaaaaaaaattgagactggctggatttcagtcttccctaacaatacaatctgtgtcattcatttgcattttttttaagcatggtgatcttgtcctaggtagctctttgtccattactgcatttaaaatgctcaaggccctcccctctctaatcattttaatccatttaaagccgttttagaaagaaaaagctgtcttactctccccatatcttagcgcaatgcctagcatatagtcatgcttaatctgctgaagctcagtggagtttgagttttactcccagttcgtacatatcaaaaaatgaagatgattgagtcctttccctttgtctcactcccaactttatttaattgaaaagtagatactcaaggttttcagttaccttttaccactaatttgacagtctctcataagacatatttttagttttaatatcaataaatcaatagaaactaaattttatccttttataacaaatctttattgttaaaatagagtaagctaactacctgaggctatttgtggaataatttatttgtaagtttttaaatgtatcccattgttttcgaagctagtccccagattataattattccagctgacccacaggacattcttctctggcagtttccacccaacctactgatgctttcttcaccaggttggccccttcaacaagtttctgatggtttatacaagtgaagtgttcctaaaaagaaacaaacaaatatctcaattaactaagtaatagaacagaacttgcatattttaagtaaaaagggtgatgttttacaattgaacagtcccaggatggtaacagtaggagggaacttcttcattgtgttagtgccactgctttttaagctggcatgcatggaggtacacaaaactgcagaataaacataacacatggtcctgaagtgtcatttttatttggatagtagatactgtattttttacttcatgttaaaaaataaagatgtattatacaggtgaatttagaggtcacatgaagttttaaatgggaatttcagaaaaatggtttgcttgtgtctgagatgataagtatataattacccctttctcttgttaaactaacttttattgtatgggaagagaaacaggttcaaggaggttgcacagggtcaggatgagaaaaggtccatgtcctttcctttttaccaatgcttcccaaacttttcactccgtaaagaacccgttttataatctgcctgcctccaagaaccccacatttgaaagatgttacctatgaaactgcatctgttagataaactgttttactgttaatcaaaaacaaaagcactacacgttagagttttcgatcaacacaagataaccagttaaccgcactgaattgatacagttttggcaaaaggcctttttggggggaaatgtacacattatgcattacataaagctttaggggataatgaaagtgactggaattattactaacttagagccttaaagatacggggaccccaggagtaacaggtcccaggttctgaactactgttcagaggcctgctgcctcgaaacttacgatctagtcgttaatggatgactcaaaagagaatgcctgggcaagcacggtggctcacacctgttatcccgacactttgggaggctgaggcaggtggatcacctgaggtcaggagttccaggccagcctggccaacatggtgaaaccccgtctctaccaaaaatacaaaaaattagccaggcgtagtggcgggcacctgtaatcccagctactcgggaggctgaggcaggagaatcacttgaacccaggaggtgggggttgcagtgagctgagatcatgccactgcactccagcctgggcaacaagagcaaaactctgtctcaaaaaaaaaaaaaagagaatgcctgtgttttagagtgagcatgttgaattgatgcttttatttcctttgctgtttgcatatagatcgaatatgaaaggaaaaagaaagaagacggaaagcgagctcgagctgataaacaacatgttttagacatgctattttcagcctttgagaaacatcaatactataatcttaaggacttggtggacatcacaaagcaacctgtggtatgtatatgttcatactgatcctttgaatatgccctccttcattaacacgacattactgaaagtgtgtcatacatgatttagttcacatttacctatgctaatgactaattttatgacaacactcagaaaagatgtcttaatgcagccatttttggtaacatcagcttttattttacattttagtactcttaataattatttatgaagaaaagaaattatcctcatgttcatttattcttgacattaagcctgaaatctgttgataccatttctggtctttattttgtttccctatcttcctctgagaaagtttaactccttccctttttttggaaaacatgcctcatagaaaaatcgcattctttaaagaattatactgttttgtcattgtgggagggtttatccctgtcttgtgaattgttttctgtggattttttttttttttttttttaattagaatctgtgtaggtccttttaaacctgaactgaactgcactttcaaattatgcttgcagagattgtgattaggttggcctgttccccatttttaaggacaaatttaacaaattcgtattttagaaagtttatgtttgttttatagtcatttttatctcttctctaggcttttgtgcatttactagtaatttgcattaataatccatttaaaatgatgataacaataagaaattcaaattctttttctagtctttgagtcacattgttttccatttaactttctccaccacatgtcaccaaagtatcagactgagtatttacttataggtttaagaaaattgaatggaaacccttttatctcatttcctttaccattttgtctactctgccggtatactcaagaatctgttgattcttgctgctccatttattggattcagaatatgtaacaataaccaattttaaaaaacatcttaacataaccaaataacctatttgtgaaaggacttgattttttttatttatacaaagctttaggaaatgatttatgaaattttaatgttcattatacagtttctcctgcagatatttctttactattatacatcaacccttgccttttgttaagaaattaatttgaattccaaaagatttactttttaataagaagaaagtgctcatggtggagtattatcaattcatcccaatgacttcactccctttggcatcaaagccttagaaacagcattctaagctagattaaaaattttttttgaaatagaataaataactcattagctaagctgtgtttcttctggttttaatgaaatttatctttgtatttatatatataaatatatctgtatgaaaagacccttccagaaactctgaaaacagacgagattctcatggaattaaacacaaaaaattagatatggaaaataatcacttgtagaggggcattcagatgatactagggaaagcagtttctttgccttcacatgggatataaggtttattcattttgcatcaaagaacaagtattactagtgtgtcttttggttttggttcttaagatattttttatatggtagtactcagtgaatctcttacaacagagcttcttaattcctaaccagtggatggacttaaggggatccattaacttcctgaaaatctgcaaaaatgtatgaattgttctggggaacatatcatccatagtttgtatcagattctcatagaagccgctgatctcaaaactaactttttaaataatagttttattatttagagactaaattgcctcaataagcataagattcctgaaggcagagttgtatgctattcctatccctaaatattcatataccccatagtgtaaaagatggtaaaaattcagcaaatatctcatgaattgatttgaaaaaagaaaatcctcagtctccaagggccaccatattttcttcagatggattttggcaggcctctcacgtcatttatagtgaggttggggcaaagagccagtgccaagaaagtgtggaatgccttccccaggctgggggtaggccagaggtagttacctcctcctagaggagagggcaggaagtggtcagcatggattccagtccattgactgggaaagaaagttgccaaagtctagctctcccccaagtaggcaactatccccctttaaaaggattcgaggacataagtgaatctgtactaatggtcatcagtacccaagagacttgaggaatctattctagcatgaagatcaatggtccaggaaagggggtgttctggtataatggaaagaacctggatttggagtatgagatcctagttcaagtcccagctctaccatttagccaaatagtcctggacaaggtacttaaatacatttaatacattacttatatttagttcacttaacatatgtaataatataaaatttaccaatatgttcaaattataatttattttgggggtggggtgttttgtttgtttgtttttgagatggagttttgctcttgttgcccaggctggagtgcaatggcacaatctctgctcactgcaacctccacctcccgagttcaagcgattctcctgcctcagcctcctgagtagctgggattataggcgcccaccaccacacctggctaatttttggatttttagtagagatgaggtttcaccatgttgacaaggctggtcttgaactcctgacctcaggtgatctacatgcctcagcctcccgaagtgctgagattacacgtgagctaccgttcctggccaaaaccttcatttctataagtaaaattattggctagagaaactttgcttagggcccgtctttttctcttgtttgccagtatgtgacttacataagcaactagaaagagtgaaagttactcatcaaggaggccaagctttggtaactgatataaagtcggggacatagtatccatttaaagatatattatcttagtctgttttttgttacttataacagaatacctgaagctgggcaatttttaaagcaaaataatttgtttcttaaaattttggaggctgagaagtccaggatcaaagggccacgtctggtaagaggctttttacatcgcttagtgaggaggctgagcgtgctagctcaggtctctcttcctctccctctttttataaagccaccaatttcactcccatgataacccattaatctatgaatgggcagaacccccatgacctagtcacctctcaaaggcccaattcttactactgccacattgagaattaagtttaacatgagtgttagaagggacagatatacaaaccacagcaggtatttttatatggtttaacttctggatttttcccccctcaaaaatagaaaattacaggaggcctattatttctccctgatactctgatttttaaccttgaatgagttatttctagcttttttcatattttatctgtcaaatagaagcatatatagtgtttcctttgaagatataaaccattaaaaactttatctaattgctccctttgaaacaccaaactgccaataccactctgaacttcaacactctgttttctatctaacagcgttcatttaccagtgttcctgtacagcatacttgtattaaaaagtgtcattgaaaactagtccctgattggccgggcgcggtggctcatgcctgtaatcccagcactttgggaggctgaggcgggcagatcacgaggtcaggagatcgagactatcctggctaacacggtgaaaccccatctctactaaaaatataaaaaattagccaggcgtggtggccagcccctgtagtcccagctactcaggagctgaggcaggagaatggtgtgaacccgggaggcggaggttgcagtgagcggagattgcgccactgcactccagcctgagcgacagaaaaaagaaaaaaagggtaccgaggtcgaattacgtataaaattgcatagttttccaatcannnnnnnnnnnnnnnnnnnnaaaaaagaaaaaaaaaaagaaaactagcgctgattataactggacctcttaatttccttttgcaccacctacccaatttcaagtcaggattcagagaagtttatttttattttattttattttatttttgagacagtcttgctctgtcacccaggctagagtgcagtggtgcaatctcggatcactgcaacctccacctcctagttcaagcgattcttctgcctcatccttctgagtagctgggattacaggcgcccaccaccacacccagctaattttttttttctttctttcttgagacagagtcttgctctgtcctcagacttgagtgcagtgacacgatctcagctcactacaacctccacctcccgggttcaagaaattctcctgcctcagccccccgagtagctaggactacaggcaggcaccaccatgcctggctaatatttgtatttttagtagagatggggttttgccatgttggccaggctggtctcaaactcctgacctcaggtgatctgcccgtcagacaggctgctttctgatttctatattattaagaatcatcatcattaatcctaagccaggtatgtagagagtagaatttaagctttatcttagttcagtttctactccaaaaggaaaaataggtatttttaatgtttgaagcttattcccaaatttactactacttaataactgctgtttttattataatgctttccactgacatatattcacttggttccttttttcatcttttcatttttcctataactggaaatttttatttttaaatttttatatttttatattttaaatataaattttttatattttaaaaaaaagacaatttcccaacagagcatattgacagccctctttaagacttctcttttaagaaataattatttgctaacttatgaaatagagccttaattaaaagttttagaatatgaaatgtgatgtaaaataaactattaactatgttgactataagtgggtgaaatttaaacacatttataaaattttaatactttctttttgaatagtgattctaatagaaggaccaatgatctactaccaactttattatggaacagtaacattttcccttttaactttttatatggttttgttttggctctttaaaaaaaaaaaaaaaacaaaaaaaaaaaacagggtctgaacaggtgagtggttcacgtgagtaatcccagcactttgagaggccaaggtgagaggattgcttgagctcaggagttcaagaccagcctggacaacatggtgaaaccccaactctacaaaaaaatacaaaaattagctgggagtggtggtgcacacctgtagtcccagctactctggaggctgaggttgggagaattgcttgaacccaggaggtggaggttgcagtaagccaagattgtgtcactctactccacctgggtgacagagcgagctcgtgtctcaaataaataataaagagacaaggtctctgtaagccacccaggctggagtgctcaaagctccatagctcatagcatgatcatagctcgctgtcacttcaatctttagacccaagcagttctcccacctcagcctcttgagtagttaggactacaggcatgccccaccacacctggctaattttttttttttttttttttttgagacggagtctcactctgttgcccaggctggagtgcagtggcgcaatctcggctcactgcaacctccgcctcccgagttcaagcagttctctgcctcagcctcccgagtagctggaattacgggcgcccgccaccacgcctggctaattttcgtatttttttagtagagacggggtttcaccatcttggccaggctggtcctgaactcctgacctcatgatccacccgcctctgcctcccaaagtgctgggattacaggtgtgagccaccgtgcccagcccacacctggctaattttttaaaattttttttgtggagacaggatcttactatgttgcttgctgtggtcttgaactcctggcctcaagcagtcctcctgcctcagcctccagaagtgctgagattgcaagcatgagccacagcatttggcccttgtttgttttttacctcatcctgaatgaggtgaaatttggggtgaatttagtaatataaacaaatgagtcagaattttacgtaaggtattacatggataagagcaatatctgggataggtacccagtaaacaaaatttggtatttatttatatagaatttacgttgaaattttaattaagcaataggccacaaaaattatattttctgaaaaatgcccttaccaataaaatctccataccatccttccagtcccacttgattttaaagagtggtaaaatttttttttttttttttgagacggagtcttgttctgtggcccaggctggagtgcaatggcgcgatctcggctcactgcaacctccacctccctggttcaagcgattctcctgcctcagcctcctgagtagctgggattacaggtgcccgccaccatgcccagctaaaatttttaagcttattaactgtctgctgctggtttcttcatttagttcctgaacacgctagaaagacttggttttgggcttgccatctctatggaaataatttccctcgggaaagaaataattttctttgtgttgggctctgcgtttaagaaaacattattctgtggtgttggatcggtgttcgaagcctcccatttctctgagcaggtggattcagataccagaggataaaccaactggcagaggaccttgtactgccagcactggccttcttcacttcggtattgcagcattacagagccatttctttctttttcaaatgtcccaagacagcgagttcaattatacattaacatgcagagccagccactgtttattggatatattacattacccagataattggataataaaaatagtcatcttaatttgttttataagctgaagcagcctccctttttcctctcaatttaaaaccttttatttttagtacaaattatactttttttttttttttttttttgagatggagtctcgctctgtcacccaggctggagtgcagtgacgcagtcttggctcactgcaacgtccgcctcccaggttcaggcaattctcctgcctcagcctcccgagtagctgggattacaggcacatgccaccacacctagctaatttttttgtataattttagtagataccgggtttcactgtattagccaggattatctcaatctcctgacctcgtgatccgcccaccttgaccacctaaagtgttgggattacaggcatgagccaccacgcccgaccaaattatactttcttaaagtgtgtagttcaggccagatgtgttggctcatacctataacccccagcactttgggaagctaaagcaggcagatcacttgagtcaaggagttcgagaccagccctgggcaacatggcaaaatcctgtctccacaaaaaacacaaaaattagccaggcatggtggcatgtgcctgtagttcccggctacttgggaggcagaggttgtagtgagcccagatcgtgccactgtaccccagcctgaatgacagagggagaccctgtctcaaaaaaaaaaaagtgtagttcagtggactttagtatattcatagagttgtgcaaccaacaccataatcaattttagaacatttccattgccctaaaaagaaacttcatacccattactagtcactcctgtcttttccccatttcctttctctcccctacagggaaccactaatgttactttctgtctctgtagattttctctggatattaatatatatggatatgtgatttcttacacctggcttctttaacttagacataatatttttatgttttatccatgttgtggcacacatcagtacagctgtcctcagtatgagagattggctccaggaccttctgcaaataccaaaatccaagtatgatcaagttctggatataaaatggtgtttattattattattattattatttaagttctagggtacatgtgcacaatgtgcaggtttgttacatatgtttacatgtgccatgttgttgtgctgcacccattaactcatcatttacattaggtgtatctcctaatgctatccctctcccctccccccaccccacgacaggccctagtgtgtgatattccccttcctgtgtccaagggttctcattgttcaattcccacctatgagtgagaacatgcggtatttggttttctgtccttgagatagtttgctcagaatgatggtttccagcttcatccatgtccctacaaaggacatgaactcatccttttttatggctgcagagtattccatggtgtatatgtgccacattttcttaatccagtctatcattgatggacatttgggttggttccaagtctttgctattgtgaatagtgctgcagtaaacatacgtgtgcatgtgtctttataacagcatgatttataatcctttgggtatatacccagtaatgggatcactgggtcaaatggtatttctagttctagatccttgaggaatcgccacactgtcttccacaatggttgaactagtttacagtcccaccaacagggtaaaagtgttcctatttctccacatcctctccagcatctttttttatacataacctacatgcatcctccagtatactttaaatctttagattacttatataatataatgtaaatgctatgtaaataattgttatactatattgctgagggaatagtgacccaaaaaagtttgtgtatgttcagtacaaatgcattaagaaaagaatcagaagatttttgatctgccattagttgaatccatggacttgtaacgcaagaatatggaaggctgattgtacttcatttctttttatttgcaaatatatatcatagtgtgtatataccatattttgtttatacattggtacatttgggttggacatttgcattgtttctacgttgggactattatgaataaggctgctatgaacatttgcctacaaattttcatatgaatatatgttttcatttctcttgggagtggaattgttcggtcacatggtaactttgtttagccttctgaggaactgctagacttttttttttttttgagatggagtctcgctcttaccacccatcctggggtgcaatggcatgatctcggctcactgcaacctctgcctcccgagttcaagtgattctcctgcctcagcttcccaagtagctgggactacaggtgcctgacaccatgcctggccaatcttttgtattttttttagtagagaagggatttcgccatgttggccaggctggtctcgagctcctgacctcaggtgatccacctgcctcggcctcccaaagtgctgggattacaggcatgagccaccgcgcccggcctaatacagtttagaagcatgtctttaaacaaagttaaaaggtttagcctaaagaaagtaaattttgtttacctgaaatattcaagcatgtgaagcatttgtcagtgctggatagaggagatgttactaaagtgagataatttaccagcacacaaatattaacgcaataattgctttttcaaggtttggattaagcagtaaagtagggctgggggaaggtggagtagggtttgcaccttgaccatttcatcacccatctgtgtgctgcttagagtttttacagggaggaatggagaccctgagtggaagataggaggcgggatctagtggggaagaggaagtgaaaccaggagaaaagaagaaaaatgcagaaatggtctgtgtttcagagaagtttcctagcatcgcctttcctctaaatgagggaaaatgtctgttgcattttctgtattaggccattcttgcattgctctaacaaaatacctgagactgggtaatttataaagaagagatttaattggctcatggttctgcaggctgtacgggaagtatgatgctggcatctgctcagcttctgggtaggccacaggaaactcacagtcatggtggaagcatgtcacatggcaaaagcaggagtgagagagtgaggcaggacatgctacacacttttaaacgactagatggcaagagaactcactcactatctcgaggatagtacccagagggatggtgctaattcatgagagttccgtccccatgatccaatcacctctccccaggcctcacctccaacactggggattacatttcaatatgatattttcatgaggacacacatccaaactatatcacgtttgatcacagtttcttcctaatgtgtagtttatattttaacagaagaatgttttgccttgaagtcactaacatcttcatcagtaagttttcattctgttgatatctcttaaaggagttgcagtcattcacacaaaaatcatgtaaagatgaaatgatactttgaaattatcacagaatcgataatgcccttcttgtggttggatcactttataaaaagcatatagtgcattttcctttgtcagctgcattaatcagtgccatcatcagtgtaagtttgcatattgaatattcagtctcaccattttgggaagattttgtgactggaagactaacagggtcatattgttaacttacttaaagcattagtagttggtgatcatctccctgtcaaaggtgtatgtttttaatgaacatctacaaatttagatataattgatttattattatgcttatcactgaaatgcatgataagatgaaatgcagattaagtcctccatttgtttgacagagcaggagaagaaaagatgatatgagaaatggtagggggtggagggacggaaggaaggagcaaaagactaaaataataggctactgtgccttatgactataggtttgtctcagtcttgggggccaattaggatgttgatccatggacttctggctttttgcccaccgcagttttaacttgacccacaaatgcaaacaaacatcctaatcacttgacctctttgatcaagtatgtgccttgccatttccttccaagaaagctgtgatgttctatcccttatttctctgcattcagacttgccgtaaattctctcccacacatccttttgatgaagaattgctggacctgagccagtttattcagatcttgtgctgcagcttggcacatagtctgtaataagacatatccccaatcctatgtgacataaaagtgatctactcagttctagaatcctctgtttcaaatacaggtggttagacaaaagatttaattggaaagtcactcagtgtttaagtaagaggaggagaactcctttctctagatctctacacagaattgctgttcaaatcgaatgatcaaatatctatcctcaaagaacctaacatctctatgcgggctgtgttaggtgcccccttctcagtggtctcataataccctgtacacatgcctctgttatattttctgattacctgccaatttgcctttttctttttctttttttttttttttttttttttttgaggtggaatcttgctctgttgcccatgctggagtacagtggtgcgatctcagctcactacaacctccacctcctgggtttaagtgattatcctgcctcagcctcctgaatagctgggactacaggggcctgccaccacgcccagctaatttttgtaattttggtagagacgaggtttctccatgttggccggctggtcttgaattcctgacctcaggtgatccacccgcctcagcctcccaaagtgctgggattacaggcgtgagccatcacacccggcgtaatatgcctttttctttgcccccatcctctgcactaatcttaaactgtgaactctgagaggaagactgagtgtctaccattccacctggcacattgtaggtgctggaataaatgtttgagtgaatatatgaatgttaaaaagagaaataagattaccaagtaattttcaatcctggtagaacctttaaaacctcttcttcagttggctctgtcaccaacaatattttagcactaaaatgcagattttagtaataagtgacattcaaattcacgtagtacagtttagtcagtaaactttgtttctcaaactagatcactgcttgagttctaaaactgaactagaatttgaatggtctatttttatggaccttcttagtgatatccccaccaccacccagcagtcctcttagctgccttgttagtcttaagcacgccttattcactttgcataagtacactgagtctctgtgatgtgcacgcaggcactataacaggagcatgtggccgggcgcggtggctcatgcctgtaatcctagcgctttgggaggccgaggcgggtggatcacgaggtcagcagttcaagaccagcctggccaacatggagaaactccgtctctcctaaaaatacaaaattagccaggcgtggtgtcacatgcctgtaatcccagctactcgggaggctgaggcaggcgaatcacttgaacccagtaggcaaaagttgcagtgagccaagatcatgccattgcactccagcctgggcaacgagagtgaaactctgttcccaccgtccccccgccccccccaaaaaaggagcatgtgatttaagaggagagcaaggcatataaataaaggattataatataataagagctaccatcgaaggttgtgcggtgtgaaatgtaaatctaaggtaaggctgttagagaaagtttctctgagaaagtaacatttgagcctagtcttaaagaatgaggggtccagatttgaggaaaggagataaacgttacaaggaagggaaacaacatatgggaaaaacccagaagcacgcagatgcagaaatgggaagcatgcgtgagggggagtgttggaagatgaggctaaagggagaaggcagacctgagtggatgcctacaaaggcgtttggaatttaatgtgtagcccaaacggggaagtcattagaatattttagacagaggaaggacatgtgctctttctgttctctgtccatgtcttccctttagagattttcccttcagagaccttgtttttccctatcgtcactactactttctctgctaatgttttatacctacttccctgccaagctaatttatttgattagagtaaaatggtcttaggttgcagtttagaacatcctaaaaatcaggaagtttgtgtcccctaccccctgatcacagtacattgtgaccctgattgcattttgttgcttgagaaattgactgactatggtcatctcattccattcttattgttacaaggaaaaaagaatgacaccttcgtttataaaaagaattccatatgttctactagattgccaaaatgagggtggacatgaaaacaactgaatttgtacacttcagactttattaatattttttgtttaaccctttttaggattttcattttctgggcctagattataaatgggcacactagacttgaagtcaggagagcttcttttctatggagctactaaaatgctcctggcaattgttcttttcatttttgacccattgcagtgcatccacaattgtatggttgtttgtgcaacatcgtcttagccagtctcataataaaccattctttggaattttacaaagatgtcattcttggcacctaaacagagaatcatttgtgcctaaccaatcattttccatttatgaatcctgttcaattagaaagtagtttatgaacagtgtcctgttttttaaatgtaatttgaaatagcaggtggcagacttgcattttatattacctagatatctcaagcctttatgcttactcattcacacgggtctgctagtgaagccaactgtataaggtgtgggaggtaggcaagcctcgggggaacccagggctcatttggttcattgctgccatctgctggggcttggctgctggcatgggaaggctgcccacgagagagctgagccatcctgaaggaacctctgtatacttccagtactaatcagctattatgtttctaggtgacaacctacccctaactaaaaggactttatgaactctagagcattatatcagtcagtgtaaagtggcattagattatgttggtaacacgtactctacagcaaacatgaggctcagagaacgaagcaacacactaaggactcaaagatcctagagtatcagaactggaagaaccttaagccagatgtggtggaactttagtatatagttacatgagtcgcctaggcacttgttaaaatgcagattcctgggcctagcccaagagactttgattcagtaggcccaagctgtgtctcatttaacaagctccccacagggttctgatgcaggtggtctagcaccatgctagagaaaagcactaccttaaatatacagacaagagcttctcagccatttttcttattaatgcctcacttcaatcaataagaaaaattacatcttccatcaatgggatgagtcatcatcataccgtaactagttctttgaagcacacgcacacaaattattgttggattgctttgttctgcaacaacaacaaaagagtcgcttttaaataattatcttggctgggtgcagtggctcaggcctgtaatcccagcactttgggaggccgaagtgggtggatcacctgaggacaggagttcgagaccagcctggccaacatggtgaaaccccatctctactaaaaatacaaaaaatttagctgggcgtggtggcatgcgcctgtaatcccagctacttgggaggaggcaggagaatcgcttgaacctgggaggcgaaggttgcagagagccgagatcatgccactgcactccagcttgggcaacaagagcaaaactccatctcaaaataataatgataataataattaatattattatctttcctttcttctccaagaaggaaattctgtaatttatattggtcagcttattgtggaatgctttttggccttcagcattggcaagcaaaggtctagtttcatattacacttaacatagccatcatttccatgaccatagtaatcatttagtaaatgtttattgaatttttagggacctaaaacaccataatatgactcttttctttggagaagccaaacacaaggctgcatccctgatagttttaggggatgtcttcttatcactttatttatttatttgttttttgagacagagtttcactgttgttgcccaggctagagtgcaatggcacagtctcagctcactgcaacctctgcctcctgggttcaagtgattctcctgcctcagtctctctagtagctgggattacaggttcccaccaccatgcctggctaatttttgtatttttagtagagacggggtttcaccatgttggccaggctggtctcgaactcctgaccttaggtgatctgcccacttcagcctcccaaagtgttgggattacaggcgtgagccaccaagcccggccttattatcacttcttactcccttatctgtgttggcaagcttggctaaagtacaaatagtagtaaatacaaataacaactctccttctcacataggaaaaaataagtgggtggcctaaaaacaaatttgagaactcaccttagaactgagaattctgaatacctgtcatatgcctgcttgatagaatattctcaaaaatgttgctcattttttttatatgctactgctcctgaaactactggtttcaatctgtgaactgagtcccatgaggccactgaactcaagggcagattacccttggtgtaccgtgtcacactgagtgaggaccagtaattttttcgtgtatttcatgtagtgttttttgtgttttttttgtttgtttgttttagcttttaagttgttggcattcaggactttcaactcctttaatgcacatgatcatatatttagtgcagttaccatgtcgcacatgtagaatcaaaaggcagtttattgaacctccttatagagaaatcttgctgagcttttaggatcataatttttatggcttgcatatgtgctttggcatatcatcttattttaagttttgtcccctgcatttataatctcatttgttaggggttttgtttttgttttaggtgtacctgaaggaaatcttaaaagaaattggtgttcagaatgtaaaagggatccacaaaaacacatgggagctgaagccagagtacagacactatcaaggagaagaaaagagtgactaagaagactcctagccagcatgctagtgaaacgactagcagcgatgctatgcaaaaggcgctgatactggaaggcttgaacaccgtatgttaataggggttaagtgacagtactttgatttctctcggtaaattttttaaacctgtaattcttgtaaagtttcttaactgtttttttgaggagaaagaacagatttatttatagacttaacttgtattaaaccagattattcacagtaggaataggggttggaggattaagagggtttttcttaaatattagcttttaatgtgtacaattaggaaatttttttaagtgaggactctctacccttgccgtatctaaggagctgaggtaatacagatccaaggagaattgtatagcaagaaaaaaacagtcaactacagaaactcttaaaaggaataaaaacccaaagttccttattttgaaattgtcaaagaacaaagcggtgtttttcttttaaacaggtgatcacgtttcgtgttcatactcaacgttaataaaaggagagagtttgtagtgaaatggcagtgttcatcattggcttattttaccgtagtgatgctgagatgagaaatgtgcaggatcatggtcagttgatgtttcttttatttgcttttaagataattagaaattaaatatctttccaaaatttgaagatatgtctcccccagtcagattataagcttctcaaaactggcttgcccccagaattttactgcttacccagcagacatgtattgaccatcacatggcaaatgatatcagcaaatcaaaagatgggcgtaggggtccagccgagacagaaaacgttagtttcaattcctggggcattaaaatgttgcttttctctttctctttaattaatttttaaatgaaaacaatacatgtatatgttagttttttctagcacaacacaatattatatattaagcgatccaaaatcatactgtcaagaccatcaaacaaaacaaagaagcttaagtgaactaagcacagggaaaagttgttttttcactcgttcattttgtcatctgcttctagatgctgcaatcaagaagtagcaaatgcccaagttgccatagtgtttgcaggaaaaaaagagaaaaaataataaaaataaggaaggagcaatgccaaaaattgaagaaaatattatataattaaagcaagaagatatctatccattgagaaaaacaatttttatattatttgcttttagcagcaaagcattagaattctgagattgttatagcactaagaagatttttattctgtgtacacactgaaaaataaaattctgagtaaagaaagtgttcccattccccactccacctcagattttcttatgtacaggcaccaaatgtggtatgcccatcaccttctagttcctgatgactggaagctctgtgtcaggaagcccgtggataatggtctgataaatctatatagaactgaggattctggatacctgccatgtgcttggttcatagcatgtatcttccccaaaaccttgtttttttatatatttggtactgccctgaaacagactgtgtctcctctgctgatgtcttttgttttggggacagtgcctgccatattgaacgaggtggctgtgccacaagagttcccagggcagagctgtgtcttatttgaagctgtgctttggtttttttgtaaactggttttttctgcttcttttagttgcctgttacctcagcacacctgattgcatgagcttgagtctcttaaacacttatctcttcagtaggatacataatttaggtgctagactgatgctgtttctgattacgtttttgtttgtttgtttgtttgtttgtttttgagacagagtcttgctctctgttgcccaggctggagtgcggtggtggtgtgatcttggctcactgccacctctgtctcccaggttcaagcgattcttctgcctcagcctcccaagcagctgggattacaggcgcatgccaccacacccggctaatgttcgcatttttagtagagacggggtttcaccttgttggccaggctggtcttgaactcctgacctcaagtgatctgcccacctcagcctcccaaagtgctgggattacaggtgtgagccaccgcacctggcttaaattgctttcttatttaatgttaaaatgtgggtgctggccatggaggaggttttcccttccacccaggttcccttattcttttatttcaggactctcttactctgacaaacagacttttgacaaagatcaataagtaggaatcctaaacccttataaactgtgagagtgaaaggaagacagataaagaagatgcacacttctggtaagatgtcacatcataagacaggaaggccatatttttttcttttttgagacagattctcgctctgtcgcccaggctggagtgcagtggtgtgatctgggctcactgcaagctccgcctcctgggttcacgccattctcctgcctcagcctccgttgtaactgggactacatgcgcccgccacc

SEQ ID NO: 15778 - DNA, 14246 bp, Human
atatatatttttttttttttttttttctgaggcaaggtctcattctgtcacccaggctggagtgcaatggcatgatcacagctctctgcagccttgacctcctgggttcaggtgatcttcctacctcagcctcccaagtagctgggactataggctcatgccaccatgcctggctagtttttgtatctttttgtatagacggggtttcactatgttgcccaagctggtcttgaattccttagctcaagtgatccatccaccttggcctcccgaaaggctgggattaccaaaggtgtgagccaccatgcccagccccaaaatattctttaaacatgtaatcatacaaaattatatgagatattaatattctttttttatactaagtcttcaaaacctgatgtgtattttacaacacatcttaattcataccagtcacatttcaagtattcaacggccacttatgactagtagctacaatattagacagtgcaactatagaccacgtttactctccatttttttagcaactcccaaaccagctttatacgtattgtaataaacatagaaaacatttggaagggtacacaagaaatgactaaaaatgatttttttatataaaatgagaatgcagggagggaaggtgatcagggtttaattcacgtacatctctatttgaatttattatataaggatatatcatatttactaaaaatgtaaaagagaaatgcttattctttgcaacacagtccttgtatagaaatctgtcttaaggaaataatcaaatatgtaaactaacatttatgacaaggatgcccttggcccaagacgtgaataattttttctagtgtatccatgctatagacgttacctgccattactgtataagaaaaaacatagtgtacctagggctcagtactacccatggtttcagacatccataatttcaggcatccactggaggtcttggagtgtgctccctgtggataaggggggactactgtattcaaccccactggaggcttgactccctgaaaagtgaatggagaagaacaaactgatgtgaaaaatctttgtcttccaacaaataaacagacaggatctgagccctggggagatcactgaggcttctcttaacccttcagtgggtggtattttccatctgctcacaggaatgttgagattttggctgtggaccttgtgttttgcttagcaaagttgttttgtgtggatcgcacctgacattttaaattcttccaacaaccataggaggtaaatgaagaattcatgcacagtgcaaggataaaactgcacaggtttcagctgccttggacaccctgtgcttttcagctatttgttgaatggaacttaagtgcccaatttgttctgattggagcaaaactttgtggactgacaaggatgggcgtccaagatgtaggaagttaaaaaaaaaatgttgccaaacaaggtgtagagcacgatcctatctgtgttttgaaatctatgaaattatgtatctatgcacctatatgtaatgtatctatctctgaatggagggaaagagcctgaccattaccaccctctacccctgggagtgagaatgaagtgtacagggagcaggtgcaaggaagaatgctcacttcttactttatatatttctgtactgttaaaattttaacaggctgttttgtaaaaaaaatttaataaaagctatcaactgtaaccagaagtactttctgacagtagatgttctcaaaccatctcaccaagtgcccagaaagagttaacacaggagaattccagatgtttgaagtgaggacaaattcctgctttgagggtgggaggtgggcttagggatgagaggcaatgacgggggagaggaggaaagaagctgaggggagagctggctgctgagttgtcattccaaccaatggcatgaaagtttcaagcccaacgcccatttgtggagactatttcaggagttaggatttgcatctgagttcattgcccctgtaacctgtcaaagaagagctaagggagctttcggggttggcttcttggaggctgctttctcctttacttggaaggtaaaaatctcaagcccaagctgatcaggcagtggtgactgattgagctgttaatttttttctttttggtgtattgatttctttttccagctagggctgtaacatgcttatgggataaggttttacttttactaacaatgatatttacatggaacttctaacaagatggagtggttcttcctggtcctctgcagatgacaagaagcattaggtagattttcttggataggctcgcatggaaaggaaggagaacctatgctttgactgatgaacaattttcatcttattccttcttggtttcacatagagcatggttaagctttgacaggaattgcagatgcgtgtagcaaatcctacttaagtagaatgggttcttgctttattttccatctcagtaaaaactcttaaaactcccccattcatagtaaagctactttacaacagaaagtagaaaaaaaaataaagagagagtttggaaagacacttttagtgaagtcacccaatgtttaggtccaaatgtagctcctctgtcccccagcgctatgttatcaacatcacagggaacttctttcccctcgcaggcttcgctagtgatggacccatacatgattcagatgagcagcaaaggcaacctcccctcaattctggacgtgcatgtcaacgttggtgggagaagctctgtgccgggaaaaatgaaaggcagaaaggccaggtggtctgtgaggccctcagacatggccaagaaaactttcaaccccatccgagccattgtggacaacatgaaggtgaaaccaaatccaaacaaaaccatgatttccctgtccattggtgagttggggacactactgaggggctgtcattgtcctcctctactctcatgttcacaggctggttggagaagatggcagttgggggtgagtctgagtactgaacatgggagaataacctcttggctccttttgtgttttcctcccataaaaaggggaccctactgtgtttggaaacctgcctacagaccctgaagttacccaggcaatgaaagatgccctggactcgggcaaatataatggctatgccccatccatcggtaagctcctcctgagactccatacctggtgactgccaaatctttagtgctcttataacaggactaaatgtctagcaatcctcttcactttcctgatgcacaattcctaaggagaggctaagattacatggtcctttggatttgggaaccgggtctcgggatgcttaaatacaaggcatcaaggtccaacttctttcctggctttctttgacatatgggcacttcccctctaggctcccaaacatacttatttgtcaagtaaagctcctatcctatcattactaattctaatctgaaggccttgagtctggcaggagctttgtgtttgctgagcctctaggtcctaaatggatttacttattgctctgtgtatatagctcctttgcttcatttctgcttctctatgtattgaaggcctattttcattatggtcctgagcacattgaaatgcaattgttaccgtttatgactaacgggtttaaacaaacaaataaacaaacacccaagaacaacaaaaaatgggctgtcaaactgaaggatagaaggttgtttctgatagattgaaattactcctttttaggtttctctccatctattaaaaatttctaccctgaatattttggtaaagtacatgattccttgactttcagtattgaacattttttttccttatgtgtacatagaaacacattcttaatgcagaataaaaccccagtttcatgataaaatcaaattttaaaaacactttaaagagttatatcggggacttcgtggtttttcggttgattacttacattttataaagtttcatacaacaaaaataaaagcaaaatcaagaccaaaagttgttataaaaaaagtttctaatgactttaacatccaaatattaggaaactgatttaacctgaaaaaccaaaaccaagtctccatttgacaaatgttcaaaggttctgaacatttcatttcaaaggagatacaggtgttaatatatgtctaaaaaagtgttcttcctcattagtaattaaggaagtgctgatttgtataactttgagacacccatctatacctattaaattagtaaacattatgaaatagtgcctctagccttgctaagttgtctttttgaacataaattttgcaaaatattatgatgggcatgaaactgctgatacttcaagcttgtaagccaacatttggaaatattgtacaaaaataatttgaaataaaaatttgtacaaaaatactgataagaatattacataacataaaaaacttaaaatggaccacatgaattgaatgcactgattacaacttctttttttttttttttttttttttttgagacgaagttttcgctcttgttgcccaggcggagtgcagtggcgtgatcttggctcaccgcaacctccgcctcccgggttcaagtgattctcctgtctcagcctcctgagtagctcggattacaggcacgcgccacaatgcccagctaatttttgtatttttagtagagatgagatttctccatgttggtcagactggtctcaatctcccgacctcaggtgatccacccaccttggcctcccaaagtgctgggattacaggcgtgagccaccgcgcctggcgattacaacttcttaaaaaatacagtccctaaaaaagatttgggaataatagaaatccttgtattacacagaataaaatataatcacagaaatcaagatggtgcagagtatttggggagctcttccttgttatcatttatacattcgtgcttatactaaaattgtaaaacataaaatgtgaagtgaatctcctttatccacaatggctgagagctgaactaaatagaatgccctctgagcaggggcagaggcagcctgaagcccatgctgggcctccagggcatagccgtcagttgagggatgaaaacttcatcttcttgccaggcacagtggctcacccctgtaatcccagcactttcaggaggctgaggtgggaggagcccctgagcccaggagtgtgaaatcagcctgggcaacagagggagattctgtctctacaaaaaaaacaaacaaaaacaaaacaaaacaaacaaacaaaaaacaaaacaaaaaaattcaaaaattagctgaatgtgggggagcacgactatagtcccagctactcaggaggctaaggtgggaggatcccttgagcccaggaatttgaggccgcagtgagctatggctgtgtcactgcactccaagtccgggtgacagagtgagacacagtctctaaaaaccaaaaaagctccactttccactcttttctttcaggcttcctatccagtcgggaggagattgcttcttattaccactgtcctgaggcacccctagaagctaaggtgagccttatacaagacaccagctctgaagcaatttagggcaaactatccctttttccttgtttctgttccacaagaagtacgggtgtcagagggggaaaagctgagaacaatttccctttagcaattagaagacttctcatatagttggggtcactaatcagtgattatagttaatgtcattacagtgtgataatgaccatcccatacaacttaatgtggtgtctgtctcaaggaggccgaaaggatccagagagcacctatatttgattgtctgtaaaagatcatttgagaacaactcataaacactaaaaaattattttaaaaaattttaccaataggatctttcttttttaaaaaaaattgtagcttttctcatttactgtaaggtcatttagagagaaagatagaagtaccaggacatactgaattgatggcagtgccaagtttaaatgatgtccttccctctatagtctactgtgtggggtcagcattttctaacataatgtgtgtctgtcacctgtatgtcagcgaagagccaggcttcaaatctctggccaaaagtaaataaataaccaagcgaaaaaggtccaaggccagcatgctctctcatggaagtctgctgagtcacagccaacctatcctttttaaagtgatttaagtggccaacatttcaacaatagttatcaacatatataaatttcttttggttttggcttagtacatttcctactacttacaacttgttaaaggaagttcacaattgctcccaactcacccacctgacaacttcttttctcctgttgctgttggaacccctaatgaaattaaccttttatttccttcacaggacgtcattctgacaagtggctgcagccaagctattgacctttgtttagctgtgttggccaacccagggcaaaacatcctggttccaagacctggtttctctctctacaagactctggctgagtctatgggaattgaggtcaaactctacaatttgttggtaaatgactttttaatcttagactcaaatgctcagttactaacctgtaaaaaatatatgaacattacttcagcagaggaaggtctcaaagtggtggttgaagccagagacagactttattgcttacattggacccttgagataagtgaggattccccctaaatgtttcagaatcatcttagtctcatcctttctttctctccagccagagaaatcttgggaaattgacctgaaacaactggaatatctaattgatgaaaagacagcttgtctcattgtcaataatccatcaaacccctgtgggtcagtgttcagcaaacgtcatcttcagaagattctggcaggtacgtccagcagacttcacagaggacgaggtggggacagaatccttcagctgttgtgtgaaatgacaaaaaccagtcattccctaagttccaagcctggggtggaggtggggagctccactgatgtctctcatcaatactgtgccataggagtggtaggcctggcctaaaagaagaaaaagaagaaatacttgtctcttcatcactcccaggagaaaaagaaatagtacttgcctcttcatcactcccatcacgttgaagatagggtctgaaatatctagttacttaaatggtgaattcaggctctgcactctggaagagtatgttaagaatttacagttcttaaataggaagacaaaacacacaaacatgaaatgcaaatcacactttgcttgtgctttttgtctttctctttaagaattgtaacttcttaatattacgggatagggaaattacatgatattatgtgactattacatgataaagcaattcacattaaaactgatttcagcatgttttattttcagtggctgcacggcagtgtgtccccatcttagctgatgagatctatggagacatggtgagtcttgatcaggatatatcactacagtaatctcaaattattttatgggaactttagaagtggaataatcagaaacaactcctaatcgtttcattacagcaaatcagcatccctgcactttttacaaatatatagacccacaactccttagccagttttctgaaacccaaagaactttggaaatccaaagattcctggaattcatttggttacaaaacctgatttgacctgatatttgtagatttttatttttcccacttgtggatctatatatttgttaagagtgtggggaaaatggcagaaatgttaatattcttgattaggggtactatcctagacagctctgggagtgttacataacgtatggtaagtgtgctacatggcctttctgaagcccaaaccattttgcattatgaaaatacctggccccaggaatttcagataagggattgtggacttatattttaaatctgtaactcctatagacagtaatttcatagagccagcttcatggagttgtaaatattactgggctagggtcagtttcctcattttaggcttcctttaatccagtccagacaccaaattaaatgtctttgtgtagtccccttcaaagcctcttgcaatcccagtcatgcttcagggtagggatgatcccattaatccaaggacctgtccctagtgatagaaggaaatgggtgggagccacgggatctgggattgcagtgagaagtagacaagaaaacaaccataacaagtgcctcttctcaggtgttttcggattgcaaatatgaaccactggccaccctcagcaccgatgtccccatcctgtcctgtggagggctggccaagcgctggctggttcctggctggaggttgggctggatcctcattcatgaccgaagagacatttttggcaatgaggtgataatatggtgaaagagtatgtgtaatttagggtatatatttatttcatgagcacagtggggacaagggaggcttttttcttttctttctccttgtcagtcaagcagcatgtgtgtggcagagctgggctacgaacccagagggtctgatctaagaatgccactagacaccatcactttccaagattaaaaacctgatagaaaggtcagaacaagaaactctaagacagagatgcttaagaaaagctaaacaacatgtttcttgtgggtgtcttttagatccgagatgggctggtgaagctgagtcagcgcattttgggaccctgtaccattgtccagggagctctgaaaagcatcctatgtcgcaccccgggagagttttaccacaacactctgagcttcctcaaggtaagggcagctcctgccctccactttgggagtttgggagtcagagaatgccgcccgtggaattaggaataattggttctcctttctggagccatgttccaatattaggagacggcatcggtgtaagcatccacacacacgtttctcacttccggccattctctctgcccctggtgaaaagcttcaagtaatagagctttttctttttcactccttatgccagaacatcacacctacgttcccactcttcaatgagggggctatttttaatgacttggcttttcttttacttaaattttgatccttgatttctccttgcctcttcttgtagtccaatgctgatctctgttatggggcgttggctgccatccctggactccggccagtccgcccttctggggctatgtacctcatggtgagtatgtgggtggcaggcactaggtcaatgcatgttgtaaggcaaagggcagtcattcagcagaattgccacaggcagtcacgcagggtacaaagacaaccagctggcctcctaagccaagcagtttaggagttgtcttattctgaattgtcccactgaggtaatttagcctctatcagttctcataaaactctttaaatgacttaattaggcagggcatggtggctcacgcctgcaatgccagcactttgggaggccaaggtggacggatcacttgagcgcaggagttagagaccagcctgggcaacatggtgaaactctattgtctctacaagaaataaaaaaaatgagctgggcgtggtggcacactcctgtagtcctagctccttgggaggctgagatggaagaatgacttgagccttggaggttgaggctgtagtgagccataatcgtgccactgtactcccgtctgggagacagagtgagaccccatccgaaaagaaaaaaaaaaaagatttaatttttcagtacagagaatcattttatatatgtagatacagggaagatttaaaacacaaataagaggcttttcataccattgtaattctcaactgggagtgatactggttccctaagggtatctgggaatgtatgggaattttgtttgttttcagaatgactaggggctgccattttgtgggtcagggatgttaaatatcctgcaaggggtgggctagtctcatgccataaagagttgcctggccctaatgccagtagtgtctcttttgagacatactagcattctatttccagcttttatttatcagcatcagggaaggaactctttaatatttattaataaaaatatatcctgtcttccctgagaaaaattccataaatattagccctcttatttatcagtgatcagtagcacagttccaagatatcttttaaagtagcccctaccttaatttctggcacaggaaattggcctgttctccctccttctgataagttggcctctccctcctgttggtataggttggaattgagatggaacatttcccagaatttgagaacgatgtggagttcacggagcggttagttgctgagcagtctgtccactgcctcccagcaacggtgggtgcctgtgtccctcaggacattctcaacagtttctagagccccagaagcaagttctgagctggtttttagcctgatcttttctcctccaacaaaatgtcttctcatttgataagattcaaactgatgtgtctcatggatcctatttaaaatttgcttctcccccccatcataatcccatccatactgggaagaaaagttgtaaacaaacgttctaggtgagaggaaattgatcctgtcccacaagtcattttaagatgaatgaactcagttgctgacttagcatcccagtcatgggagctgaatgaactgatggccctgatgaaatggtaccacttcttgtggatcagggtcctgaccattttagggtggtccagtaccagactcaattgctctgaaagtaacagactcttctttttgcagtgctttgagtacccgaatttcatccgagtggtcatcacagtccccgaggtgatgatgctggaggcgtgcagccggatccaggagttctgtgagcagcactaccattgtgctgaaggcagccaggaggagtgtgataaataggcctgcatccattctcctgaggatgtgtcccatctagggaaggctggactaggccttgcggctcctcagggactcaggtggccctactgggagaggggcctcaaatgcaccatgtcaagggttcaagattgttcctgcttttccccaagtacaaccacacccacactcagatcctcctcattcacatcgcagattctcccttgctctgcgctgctagagtgactcactaattcattaatctgcctccctctcgtaagatttccttctttttttcttgaaagtaccaggtgaacaaagtttaccagaaagcagttgagacaagaaaataagagctcaggatgagggaaaagaaaaagattgagagaatttgtgcccccaaccatttcctcagactctaagaaagaacacgctctctccaggcaggtctgaagctcaactctcttattgcctcacttcaggtatacctcactttacacaatagaattataactggaaagaagttggggacacatgtatttggtgattacattttaaacacattaggaaaagttgctatttgaactttttattgatttttggggggagtaaagaattattttgtgatgcaaataaatatcctttaattgatcgacttgccaaatttagatttgtgtgcatcaggctttcttttttttctttttttagagaagttcaatataagcttttcttttctttgtttctttctttctttattttgagatggagtcttgctctgtcgcccatgctggagtgcagtggcgcgatctcggctcactgcaacctccacctcctgggttcaagcgattctcttgcctcaacctcccaagcagttgggactacaggcgtgagccaccatgcccggctaatttttgtatttttagtagagacagggtttcaccatgttagccaggctggtctcaaactcctgacctcaggcaatctgcccgcctgggtctcctaaagtactgggattacaggcgtgagccacctcgcccagcggcatcaggctttcttaaagtgagagcacgcctgtactagagcaagcaggaatcagagaccttccagaaatactactgtgtaagggccagaaatatcttcacttgtcattgttatataatcattattacttttgctgtaatgttaatattgatttattaatatatattatcttttcatacattttctaagaaacatttatattgataagatcttttattttgccaagggcataaattattgtttttctttttttttttttaataaatttcaccaagtatggctcttctgtgatgtgtttttttctccgtttgggaatttctaatcccaggcactcctcagtctcattgtttcattacctatgaggtttcatttacttctttgtaaatgtactgacttttggagttacttaagaaccacagttcctaaaacattttatttgggagctcaacttctggcttcctacttaccaagaggcagtaagttataacctctggcctttgtctttacattttcaactttctggatccctaacctctggtcccaagttactacccttgcctatatccactaaccactcactaggtcacaaagttgatggctctggcttgacccagtgaatgagaagtgtcctagatgtttttttttttttttttttttcgcaaatcttcataggcacagttgcctgtttaattttttcttcagcccttcccttagaggagggagccttaagttacctttcaaggttgggggttaggaatctatcataactagtctagagatttctcaccaagggaaattttccttatctaaaagaggaacttcaggtctcaaccctgccagtcacacccaattaatgtccttcacaaaaataaacagcatatgttccctttcaatttgagttcagtgagctcacagcaaaatttaccttttaattttcttcagcaaatccaagacgaatatacaaaggatgagattagataaagatttcagtttcccgtatgccaccgctgccgccaattttccaaaaaagcctggctcctcttttcctgttcctccatccaagcccccaaagatctctaaccagaaataaacaggaagactcagtgatttacaaaagacattttagttttacacgtacagaaaattctacccagcattacagaattcttagacttcttaaattcctgattttccttggtatttacattttgataagggagccaatggttcttcaaacatttgaaaagaacacatacacactggacaatttcaaacgatacaaacaaacgcaactgtccttctttctcattcctgtccttcagccacccagtttcttctcccctgagggaatcagttatcatttgctggtcatacttccagattatcctgtgcctatgtaagtgtgtgtgtgtgtgtgtgtgtgtgcacttttcattttttcaaataaagtattactcaactttgtaattctgcgcgctctggaggtcaaaggagggatggcattgctggggtgtcccccacatcctgagtgtctctagataaaaaggagctaccgggcggcggctgctttccacacaagcttaaaattgccaagagtcaactgccagttgctttgggtggtggcgtcagagtgtcttcagataacacgaagaatgcgtgtaaagatcggagacggccgggcgcggtggctcacgcctgtaatcccggcactttgggaggccgaggcgggcggatcacgaggtcagaagtttgagaccatcttgaccaacttggtgaaacctcggctctactaaaaatacaaaaattagccgagcgtggtgacgcgcgcctgtaatcctagctacttagaaggctgaggcaggagaatcgcttgaacaccggaggcagagcttgcagtgagccgagatggcgccactgcactccagcctgggtgacagagcgagactccatctcaaaaaaaaaaaaaaaaggaccggaaacaagggctctcagctgcgaattcaccttttctttgtgtccgagccccgcctaccgggtaactggagagtatcaggactgggtgctaccaagcgcctcacagcagcccccagccgacaccaacatcccaaccctgggcgacccgcggctgcgcaggcgcggatgcatgtttagggggctgcgctagtcagtgcgcatgcgccgtcgctaggcaacaggacacagctccgggcgccggcgtagaatctgagctgcaggtgagggttagttcctttattcggcctctgcgttctcttaggatgt

SEQ ID NO: 15779 - DNA, 265038 bp, Human
  misc_feature (1)...(265038): n = A,T,C or G
acgttgcttgcggtcctgctagcatacgtcatcttcatgtcttattcatagtcactttttcaattaaattattaattgttttctttaaggtgttctcaacttatatggccaatataaataacagtgtgttttgaaaacaccacctgttcttgggcctgaagtcaggtggtctggaagcagctctgcagtgaccatagtctggtttgcaaactcatcctccaccttccctgttggctcttaactccccccacccggcccccgtgctctcacgtgtgactgaattgggcttgtgccctcctttgtccctaatcggacatgattccctggaggcagtcttttctcccagggccttagctgaaataaataaataaataaataaatttccccagaatctattctggactaaaatgtagaaaggggctgtctgtacccaacaggttagatacttacattaatctgaacccaacttacattgtgcaaaaagccttctatacggggatgtgatggttttcaccagctaagcatccctttttctcccgagtcagtgtgtgcctcatgctaatacaattccatacatactgctcttcgcctcatgagctgattatatttctaacacttgcatggttcattattgtgcccgaggaaaagactctccaggctgtaaggccagcctgggtgggtggttttcagaaagggtaaaagcaggtgcctttctgtgctgtgagaatcgggagtaaattcagactgagggtgggattctgacagggaggacagaggacttccggtgagatttctttggggctggctttcagatgagaatggaaaaaggtggacttggggagatagaaggcgcccagcaatcgctttgaccaactggaaaaggtgaacttggggagatagaaaggcgcccagcaatcactttgaccaactggggtggccgctttaaatcttaccctggcggtaggaactccctgggaaagggcacgatctttgctatctctgcggtgatgtggctttataaggtgaggctaaggagcctggaggcttacatggtagactgcatctccttttcttcccacttcttttcttcctatctttctagtgatctctccttttctctttctctggcctcaaaaactatccttaaactctcaacggagagcagggggatgtttttataagtttctgcaactgaaaaacagaagtgctctgtaaagcagttaataggatgggtgtgtgtttccaataaattcctgtccacattggctcctgtccccatgcttgagtggcctggctgtgacgtggacggggcccagggagcgatggctccggttcggaggcctcaggctccttttagtggccgagggcgcgtccctttcttctcgcccgattctaggccggcccctgacctttgatgagcgaggggtcagcgcctccgggagggcctgggctttgttcccgccggggccggttcccggggcggcgcaggccgagcggcgagggttcctggccccaggcgggtgcgcgggacccccggcctgccccaaggcccgcgccccaagcggagcgagcgcagctgagcgcccgggtcccgcgcgtccctgtgcgtccccgggtccctgcgggcgggcgggcgcggtcgccgccgagcaacccggcctgcgcccggcacgactgtagatgtcaggctttgcccggggagccgagcggcagcggggctgtgagtttcaaattaaccttccgctttgttgctgtgtaatgtggatccccgaaggccccccgccccgcccgccccccttccccgggcggtgcgcgctgcaaactgcgagttgggcttcatttacataaagcgattccgggcgggcggcggcagaggaggaggcggcggcggcgggcaggccggggacccggacgccagcgccgcgccccgtgggtgaatccccgccgcgtcccggggacctccctccggggacgggccgaccgccagccctgccgccaccatgagctcccctcccctgtctccgggccccctgctcctgaccagagccacctccgagtcctggggccagcgggaggtggggagcatgccgcctggggtgggtgagctcggggctcgggtgccactggaatttcccgttgttgcgcatggcggcgcggcccccggacctgcaagtgccgcctccctccggaggtgcgcggaggcttggtgtgccaggtgagtgcagcctccctccgggtccgcgcagccggcctggagccgcgggcaggtgctgcgagtcttggctgaacttcccattctcttggggcgtgtgggggaagggcaggctggatgcacttgaactcccagactccagttgccacctacctagggtgagagcgcctaaattctgctgggcacacagtaaagctcttccttcctccttccttcccttccctctgtcctcccctccctcctcctttcctgagtctgcttttggattagttcctgccttctgaatacttgtggtactggtgtcatttagaagtttgggtgcctccgcctaaaaatgcacccttttcagccctggagaagtcgctggtcagttcgaaacaatgtgaagaatgcgcttgtggagtaattaaagggagaatcagagttttggagctggagggcacctttggagatcatcttgtccaccctctaattttagttttttcgcactcttggaaaagtcagagcatttatttccttgggcaggggcggggtggggagctgatgcaaaggagagagtcaagatttttatcctgttaggaggaggaatgcctatgtttaggtcagtagcagaaaaacaataacaacaaaaagaagcattgtaggcttggagggaaacgaaccttctggaaaatgttcttttctgccttggacacacctgtgttatgataggaaaaggcctggagggcaaagactgcagctcacgcatggtgtgtgctaagagggaattgcgtggcacagtggtacctcctgtgttaaactggcttaagtgaaagccgtgagcaggtgaatccaggagggtcatccctccccccaccctctgtgtcatttaacagtccttgaagactccctaaagccactgacagaaaaccccagagagaacagatggctctgcctgggcacagaaggaaggcctctccttcatactgggtcctgcttgtcagaatgcaccagggcaaagccttgaaggtagattgtgagaaagttacacatcatcttatttctctctatgctttgagatccttggagacaagtcactaaataaatagtgtataatttaaagctcaccctagctggggaaactctgtttccttgccgtcaagcagcaggtgcgagtttgtagagttggcccctcgagttccctcattcctgaattcaggaggtgtcaaatcttcacgttcagttaatggctgtggtttctggataggtttcaagggaaaccctgaaaatcacgagttccaggaggctgggctggaggaggacacgagagtgctgtggtggggactgcattgggtaggaaaacatacaccttccaaggtaacctgatcaagaaaggccgtagcaagaaacatgagtctgctccttgttatcagaacagccactggcagcctgagattctgaatccctcttgctactcaaacatgaaaaacaatgaaggcaaaagtgaggtgtgagggaagtcaggagaccacggttccaaataattgaagggtttcaagaatggggtcttcacagagaggtacatacctggatgtttgcacgcctgtatttgtgttcattctgttttgcagagaccctgcaggcaccctttcagagagtgtgtagctatgatggccaaaagaaactttttctctctccctttgctaaattacaggactaaggagttctcctcatggtgtttccagcatagttttcagaaagcatgtaaagtgcctctcagagtgggctggggtcacagttggctcttttatttaattacacaagtgttatttaacaacatggagcagatgcagaagcgagcacttttagactttaaaaacagccctttcagaatcacaaggaattaagtgacttggagaccttctgtctttatgacatgggtcacttccctctctcaacaacccccccccacttttttttttttttttgaaatggctgtactttctatgaaatagagctactgttttccatttctcctgaaaacagtgttgatgaacagggaactattgagaaacacttgctaactattcaataataataataataataataataataataataataataataatgtaaatccatgctgcttccccaaccacctgaaacttaattttggttccttttcttccattttttgtttgcacaaatgaatgttaagggagggttggaaaggcccatctaaaacggtgccctccacaggcccctgcctggctcttcccaccaggacagtgaagtgcctgccttcttgctgctttgaggttgaatttaactgctgtgtcaactcagtgccaattggacagcccagtggcaaggagctaaaataagcgagatttagttttcatcattatgactttaaatgatgcttgctagacactcccaggaccggcctggctcatcttcggtgacccaaaagtggttagttcattagaataaatctgtgattacagactgctggaaaagtatttctagggctagtggtgatgtggcttagttctagcatccaggaaacatgtccttattgtcactgtgtgcagttgttcctttttggtgtatctttcaggggtaggagctttttttcttccacctacaaagtatcagtaagaatctggaaatgcttcagggctcagagcagacccttacttaagaaattatttttattgcagagttgtaacagtgtcatcttaaaaagtaaatatttaagtgactaagcaacattttgtaaaagtgtagggaactggcttgaattatttaaaggggaagaaagtgagctgtctttataaaactcaccttttggccaggcatggtggctcatgcctgtaatcccagcactttgggaggctgaggcaggcagatcacttgaggttgggagttcgagaccagcctgatcaacatggagaaaccccgtctctactaaaaatacaaaattagccgagtgtgatggtgcattcctgtaactccagctactcaggaggccgaggcaggagaatcgcttgaatctgggagggggaggttgcagtgagctgagattgggccattgcattctagcctgggcaacaagagcgaaactccgaaactccatctcaaagcaaacaaacaaacaaacaaacaaacactcaccttttaagagtaactcacttgtttctcagctctaaggatttagccttgacttacaagtaggcagcaatgattctggtctgaacaaacttatataaactccatctcaccctcactcgtactgcacactgaagatgcctgtcagtaacctgaagaagtacagtatgtgctgtggtttatgctttcatttgttattaaaatgattgcttgctgttagcctggcctatttctgtgatgtttgggcctgttggcttgctctggttcctaaggctggtgcaattaaccaggatgggggcgttactgtaaaaacacaacaggaaggcagattccattacagtgaacctcataggggtatccaaatgctctggtatgagaatttggtggtaatggttattattagaaatcacagcacagctcagaaccaccgtcctctgcctgagttaaaaaactatggtcaggggaaatgggaacccagttttaatagaatctaggcaagggaattccttggcaggagctagtttaaatcataaagggcgcctgttctgtccaaagcacagtgtcctgtgtcctcaggccactcagattgagaaaggagcacacagaagctacggttgtgtcaaaccgccccgagggagagacccaggcagaaatcttggctcattggcaagccactttgaaaatccagattaaagagaagcactacaaaatcaacaactgtcagagggcttttctctatgatttaaagttgactgccagattgatctctttgaacatgtgcaaagtggcaatcagatgttggagggcttctttgggctaatatggtaaatgactttgatatggacagaaactgaggacagaggtgcagagcaaggcttagtgccgattgacagcagcactgagctgaagcttcagaagtagggaaacgactggaatgtttctggttttcattctttgggccaggggacaggtgggtgaggacaaggccgtggtctaggcagtgatgggggtgtctctagagagttatttgcccaaggaaagtactttggcttttaacatttaaaggggattttttctttctttgacgtttctgcctttcagccttcattcatggagtttcttgcttttacaagaataagggctcaaataaaaacagggagggagacatagaaagtttgcgagatggcaaattcagccccattttgaagcaagacttctgttttgttggttttaactccagcccgggcctcttagcaaaatgcctgggcttcatctgccttttgggtgaccccctctccctgtccatcagagggtcaccacagcagtctcaacatgaggattactgtgtggggggtttgatgtgtacctttccagaggggccttagctggcttgctgtgtcctggaggtcttaggtggttctgctgtgtgttctttgagctttggtattaacacatgtgctgcctctgagatttgtccatccttttccctccctggagtcaggtctaaagcttccagtgaggcgggcaaaacatctgccgcactcccacccctactcctggctgctggtggtttgggatgaagccactgaaactcccttgcaaggccacaccttgagaagatgggccggtgctgggatgcctctcactttctattctgcttggtttctgggaggaagctaatcacataaggggcctaaaggctttcttaactggtgacctggagtttaattgtaagtgggtctttcggggcagcagttaggaatgtatggatcaccttcagtcatctgcagggagacttggactggaagtgggagaactggctccactggactctgaaaaaggctgtggagttttcatctgctgctgatttcatccactgtcccaaaagttatcttggccacaaacctttgatctgggagtgagacccctcgcccgatgcttctagggcaggagtcagtgactgcctatacccgctgttctgtgtagatgggagagggtgttagttattgagtagggctgagtacttggggtgatttggggtggttaggcatgattggggcttacacactggaggggtcatgtgtaggcttcttgatggggttctttcaggaaggaggaggcaaaagaacagttttgcttgtttcttggttgttcctgactccatccaggagtgtgactggagaaaaattcttctgagtgtatcggttaggctggcttttggatagatggtccccggtgcccatttctatcataggctctgcatttcagtaggaagattctagttcagaggcgactgcctctgtcttctcatttgaatctccttagtggagaggcaggaggcagattagccgagtgcagaaagaccaaggggcttaatctgatagttgatctcagccctgcatcccctgaaaaagtcatataagtgcctgttcaaatatggaagtctgtctcccttcagtatgcaaacatcgcttttcagaagcatttaaactcctgaaagtctataaaaaccacatatgtgtagacatgaactgagctgctccccatgcttccagtctcctgagtggcctatttctgatgacttctcccttcccaacatctttgtcccgtggaagttgctgaagaacacatgggtgcctttcttctccatctcccaacttctcttttttctttttttaaacaattgttcttaactactcaagaagcaatgcaagcctcttccaccatttaaggccctgcttcctaaaatgctctttggctcaaggccttggttcttaatgtacatttggccttgactggaggaatggtttctgcttcccttttaacagctccgcttttttttgtggagtatctgcatcagcgttaaagtgtcaggtcaacttttggacactttagaagaggctcatggatttcagtgtgtgcggcaggaggttggtgtcactactcaagcgactgcttttaaatgccatctctgttctgatggaatcttgaatagtgtccccttatgttatttgataacgtaattgagatgggcattgatgaagactttcagtctgtgtaactgactatatgaatgtgtgttacctgggcccctgttggtttgtttttcataagatagtattttgcccacttaaaaaatgttgttcaagtaaagaatggcagaaatgacggtagtagggtcacctcagccctgcacaccctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggccctgcacacccttttttaacggaggcagtcgaagctggtttttccttcaacagataggaaatccagaggtatatttggggaaagcagagaacttttacaccttgtgggaaaggactgtcaatatattttgcccttgctggtgaaactataaaaattgtccagacagtggaaaaattgggtgacagaggaaatcctggtgcggactcccagatgtgtaactggagggaggtgtggtcttcctcattgtttgtttgaaggtaggaaataattacagaataaaacagggcagggtctggctgaggaccagagcactgcttgtgaatccccttcaaatggggactcaacagtgaatgggagaagcaaaggtgaatcaaaaaagcccactctttggaaaggtggcctctgctctttcctctgctatgggccttacaccctctgctgaggccatcagtgttacaccctctggtgaggcctgagctgtgtgactttggaccagtaatttaacctctttgggcctcacttctttcgtctgtaaaatgggcctaatgcataccttacatttgtagtgggaagtaaatgaaataggaatcagggcttcataccacttcacatactgaaaagcttctccggatattggctgccatctccacgcccttttcatttctttctttgctactgatggcctctgctacctttcgtttcttaccaccttggaagaaataaactaaaaggtccagcaattctcttcttccccatggggtggaaatagagccaactccttttgacatctttgcaaccgtgttcagaagtgaaagagtctgaaatagttacagtgtcccccatccaccccagccctccccttctgtccccctccccaggctggcaggcggccctccaagtgagcagcctactcaatgacccacctagagaggccttccccggctggcttgtgtatgctaataggcctgacttgtcctggcttgtttgtagtgatttgtggaggcatttatatgcaaatactatcaacttgcagagttaattatcatgtgcctcccctctaccccctcctgctcggcctcccagcctggctgggctgttctcattcagcaccacgctcttcctgtcttggcctcgcctgtcccttgccctgtccccttcctatacctgcaggccccatcacagctcctttgctgctccgttgcctgtcacaggcacccaggcctagcctgtgtggtcaggcatggtgaactgggcatgccagtgactcccccagttcagactctctgttagaggcctactcttgcttgtgggggagcctgccttatgttgctttgagttttaagccccatgtttacctactagcttgaaaaacagagctgcccagacataatcaacccttgacactcaacccagtctggcgacaaagcgattatagtttttaaattattagtagtattttcatttcctcacattgcttataccgctcaaacttatgaccagttctgagctctggagagaagccattttgcaaagggatgtcccctcctgctcctggatatctgagtattaaaaatttgcttgggttgtgcatggtggctcatgcctgtaatcccagcactttggtaggcctaggcaggattgcctgacctcaggagtttgagatcagcttgggcaacgtggtgaaactccatctctactaaaaataaaaaaataaaaaaagagatacttgggtggatctcaggcctggtcacttcctggttgtgtgttggcactgttgatgtttggggataattgtttttggggggagtgggccaccttgtgcattgtaggacatttagtatccctggcatctccccactagatgccagtagcaccttcttcccttgatgtgacaatcaaaaatgtctgcaggaattgcccactgtcccttggggaggcaaaatcgcctccagttaagaacacctgaaatagaggttacatttgcttctcctggtctaaaacaatggcaggttcccggccactccccccatttagacaccttcactgcagcctgggagttgagcagcctctgcgtatgtgattccacctgataccagatgatgctgtttgctcaattttacactggtctttttggcatttaaaaatgaagaatctgggctgggtgtggtggctcaagcctgtaatctcagcactttgggaggcagaggcaggcggattgcttgagctcaggggcttgagacctgcctgggcaacatagggagaccctgtctctacaaactttttttttttttttttaattagctaggctcggtggcatgtgcctgtagtcccagccactcaagaggctgaggcaggaggatctcttgagcccagaggtttgagcccaggggttcgaggccagccttagcaacatggcaagaccttgtctctacaaaaaaaatacaaaaattagccgggcgtggtggtgcacgcctgtattcctagctactcgggaggctgaggtgggtggattgcttgagcccaggaagtagaggctgcattgagccgtgattgtgccactgcactccagcctgggtgacagagtgacatcccgactcaataataataataataataataataatagtaataaaaaggaagagtctttccttttagagcatggtaatgtgctagcacttgaggtggtaacatttgcacctctctagtgctgtccaatagagagagagagagagagagtacaagcttatatgtaattgtacatttcctagtagtcattcataaaaagtaaaaagaaacaggtggaattaactttaaaacagatattttcagcaacccacgatttcaccatgatgttctggtctcaacgctcagaaccagccccatgtccagtgctcagaagccgcgtgcagttgtggccgtcatattggatggcttagttctcagatgattctgggcctttgcagccatgacgtcaggtcgttttctactgttactgagtcagggaggaagtttttttcttctgtttattctctgaaaggtaaggccttccttggctgcacagctgcagctgagaagcggattctgaaggggcagggtctctaatctctagggaagctcccccagcctccacagtggggaagccctctagacaggattttgggctgagcctggatagttgggggggtgggggagtcaatatcccgagggccccgtggactctcgcaccacacagactaatgcttcaggttaattttgtgtacaaggtcccttttgttggacaaggggatgaaagtccacagctgtgactggaaagaggggaaggaccctctgggatgaccttgttttggaaagtctaaatggaatactaatggccgagatctaagaagggtgatgtatgtgtgtgtttgactgggcttaaagataaggtgaagagtattttaaaagttggtgtgcagcttcccagataaccgtatgcctggggccagttacgatttatggcaagctggtagtcatggctgtgtgttggtctcactttatcttttgaatcctggctctatagcttaaccggtggtgctctgtttgtttattttatcttttttgggtgggtgggggacatgggggtcagccaggttttacagtgaagcatagcagcattttataacacacgaagggctgttcatatttctgctcctgggtgccctgggctgtgtcactttttactgtccctaatgatagcacatgccagggtgttgcattctagagtttccaggagcctgaagtgcaggcccccatcttgtacagtgccacaagcttgccagagctgtgagccggggaggaggtgtggaggccttaatatagctccaagccccaggtttctttcatctctgaggtcagctttttcctgttgcctcttgacttattgaaactgtcgccgggctggccagcacacccagcagactttcctagtaaacagaacagccctgggtggcaggttcttcgctttttctagacgacagatgagcagtgggatcttatgtcactcagtgggacatttcatctctcctctgagtcattccctaaaaaccgcttttcttagaacttaaagagatgcagaattttacagtaaccatgaaatttcatggatgcatttgaatagcaaccggatatttgaatacctccttaccccagtattcctaaggaagaactttacactgaaaaatactcccaaactttgtgtttggaaaacgtatgttcttgagctagtttggactccgcttttaatagtcgggttgtgatatacgggtgtatcttaaatctggggttctcttgtatttgtactttgacaaggtatagttgatgggagggtggggtgagggtcttttatttgcgcagcagtaaggatgaaatgggcagttcttctgatttttggatgttgtctacaaaaataacttctctcacaataaattggcataggaagtttgcgggtgtgtttttttggagggtgagagatgtggtctgacttccctcagactcttcgcttcacctcttgagtaggccacggccatctgctttaacaattttattttttttcattttaaatcctcaaagacaaagggacctggaagttcagacctgtcctgccacattcctgagtaatttggttttgattaacccaaggagaaaagttggtttctcctagcgaccgaccgaggggatcaaagcgccgggaggggcagttcccctgatacacccagtccccctcctccctctctcctgccggcccctctcccctcctcttcctctaccctctacctccacctccctcctcctccctgcgccttttcaacctccccctctttagaagctgagcaggagttatttccactttctgactctcacagaagtggaagcgtatcatagagctttgggtggacagaccagggagaaatacatccccccacccatccctttcttcctaaactccttttccccccacaaagctgcagagcgcattcctgtgctaatccggctgctggaggaatgcaaatggctgtaattgtgtgcctctggaccggccttccgcatctgtgcagcttttcttctttgaggaggtggctaaaaagttcatttacatagagaaatgagactggccttgtgatccctagtggcagaatagggactttctaataggaaaggggccacatctgtgctgcctgcaccttcctcccgcagccctccccagttgtagagagagagagagacagagagagagagagtctgtctatgcgcgcgcacgcgtgtgctgtgtggtatgtgtgtatggggtgggggagaaggtggacaccaggcccctgctgggcatattttacagaagggcagttaaaagggagaagtcttctcttgatagtaagaaatcaggctggagtaggagacggcttacttttggacaagcctcgtgggtagtcctggtattaaaccacagtaaatgacttatttttattttgtttttgagacagggtctcactctgtctcccaggctggaatccagtggcacaatctcagctcactgtgccttcctcctcctgggttcaagcagtcctcctgcctcagcctcccgagtagctgggactaccagcgtgggctggttttccaccatgcccggctaatttttgttttgttttgtatttttagtagagacggggttttgccatgttggccaggctagtctcgaactcctgagctcaagtgatccacctgcctcggcctcccaaagtgctaggattacaggtgtgagccacaatgcctggcctattattattttttaaaagcacgctgtgggtcccagaagtgatttattttttcttagtttatacttgagtttggcagtgagttgttggatactaagattgttcagcccatttaaaagtatcatttgggagccagtacattgtagctttagggagatgttcaagacagacaagagaagtctgtctcagtcatatccgagaacacttagaatcccgcctgaatctgaagttgaaagacaggcagaggttctgaaacaggaccatccagtagaaatacagtgtaagccacgtaggtaattttagattttctattagtcacattaaacaatgagaaacaggtggaatgaattttcataatacatttagcccagtatatccaaaaggttatcatttccacaggtaatcaatattaataaaactattaatgagatattttacatcccttttttttgtaccaaatctttggagtcctgtatttttataccttcagcacatctctatcgagacaagccacatgtcacaggctcggtagtgacaagggtcggtggctacctagtggatggtgcagctctggaataaaagattgctgccctgtgctcttctgagacattctgttgatggagccaagtcagccatcacccctgtgaccagctgcttgcatttactggggaatgggtgcaggctcagtctgcacacagcgggtttggtcagaaatgcctggctcccccgacatgctcatgagattgttaggagatagaactgtgacattggggtgccagtgttctgtaaactgcttcctggcgtacaggtgggggtgctcacctgactgtgaaaaccttcccagaggcagaagaccagcagtggcagcaaggcacgggccacctcctcaggggacagccccactctcattcattcctgtgagtgctagtgtgtttgttacaacagacttactgcttcatgtatattactgaaatcacagacagggctgcagggagcctctagaaatgctcgtttcaccctctccgtggtgggttgctagtttggggcaggaggaaggcatgaatctagaaccttctacctgtaggtaattggtgtggtttttctgacttcacagtcatttctagcaccacacacacaggcttccggtttggctagtccagggactgtgtggtgcattgcttggaggggactttctcttagaggctctagtgccccccaagatgagagttgtaggagctgccactgttgggagggtcaccgattccagcaagaaacttcccctcgccttcttctcttagtgtttatttggatttctgctttcttgccttatcttgatgccgcggaatggaaaccttccctagtcgaggaccagtgggcgtctcccattggaggaggagaaatggagggacagagggtgacatggaaaactcagaaacaaccttgtccatgagaatcaggggtgtaatggaggcaagcagtcccatcctagacttttttttttttttaagttcgttacagtttttcttgttcacccagaagtgacttcttttcaaaactaaatgatttcagccttggtaccattacagctcttctcagtgaaatagcaaggagaactgtctgctggcttctagcagaaagcgccactgtgaaatgtaccctagagaagatgctgctttcagatgctttcagagcggccgggaagtcctggagtcttctcactgttgaccttagcgttccttggtcaatacatgtgacaacaacaattttcctttgccattgctgttcccagagcacccagccagcctcctacgatttgaggctctcctctaggatgccagtgggatttgtgcccctggtaagctgagaagcgggtgtggatttgggtttggagggagggaggtatcgaattcctttaacaggctggcctcctggcaggcaggaaaaaaactgtgaaagtgtgaggtggaaggggccccggcgctggcctctgctggggacagagcatcgcagctgtctgaccccgggtgaaaagttcaaatctgcatttaaaaggagtgccagtccccccccaccccccgcctgccccctttccccccagtcaagttgaaactgttcacgttttagaggatatgatcaggccctgtgctgggacaccaggcagccccgcttcacttctgtcaagacccagtgctggggggcggcgggggagctgctcagctaagacgcagttcttgaataacaatagtagttgaggacgaaccctcggaggcgcctggaagggaggggaagtttctccctcagtcagacactgggcatttaacccctttttctccaggtgctttgcaaggccgttcctcttctgtcctcctctccaggtcattggtgggttatgtgggggtgctggcagggctccagggtactgggggtagggggtaaggaggtgtctggcagctgaggtcacctgtccatggagggtggtggagctcaggcctggaagggctgctcccctgtcgcgtggggtcaaggagggcccaggcttggggagaaactcgagtgggttgggatgagagcctggcttctgttttccatgcatctaccttcttccttccccatcctgctcctgctgcctggcacccagtggggtctggccgcagccctgcctgaaaccccctccactggggctctgatttgtttactggagcattaggtgaatgtaaacagttcaacctctccggttttatatgcttaaagggtctgagtgtgaatacaaatgggtattaggcccctgtggttccaatgactgtcctccacccgctctcgttgctaactagcaggtctttaacctgctggggggaggaggaggaagagaaagtcctttgcaagcgtgtggactctgggatgtctctactttttttttttcctgttctttttttaaatgctgagctttaaaaagtgatgttgggaggcccccatctgtaggactgaaagttgaagagcactgaagaggaaagctgcccgctctggggaaggctagttattttggtctctttttggggacgaagagaagttttctaggttcctgttactttgtcgcatgcgctcgtgaagtctgactatggcgttgagaaatcctttagcactgggcaggtggtcgagtatacctctggtttttttgttctttctgaatcttctttttaaaagggtagttaggaatggatgccttgtatgactgtggtcactaggaaagggtctttagccaggtttttgtttttgtttttttgttttgcttttgtttgtgttttttgagacagggtcttgttcagtcgcccaggctggagtgtagtgatacaatcatggttcactacaacctccatctcctgggctcaagcgatcctcccacctcagtcccgcaacccgagtagctcggactgtaggcatgcatcaccacgtctggctaattttttaattttttgtagagacaggatctccctgtctcctcggcatcccaaagtgctgcaattacaggcgtgagccactgcgcccagcctatttggccagttttaacacatcttcttattttctccctactagagtaggacacattttttttttctttaggggctctcaggagctcataaagttttgaggcaatgccaggccacttactcttataaggttctagaatgtgcattctattggggtgctgccttccctctgaaatctcagtgccttcaccccccttccccactctaactcctcccattctctccacacctctgccctctccttctagcaagggtcacagtgggccttcttttcagccagagggcccgtggtgacctgcagagaaaggagcagaggatcttccgccctgcacgcccgcgttctggttcatgcattcaaggcccagctcgttctgtttgctgtggtggctctgagtccagtcacgccatcatgggggcattttaattagcagtgccttagtcattagtgagttattgtttttgtctggaaacacttaagtactgtttactcgatgtctccacgaaatgcaaaacagcaattaagcagaaatttgttgtatgaggcagggaccaaaatggatcatcaaaagcaggttgtggttcctccaaaccaaggaaaatcgcttttccctttggcctcctgatacctggaatgctccaaaccctctctttcttccccgacctgccccctagagttactggctagaaacactcgggaacttcgtgttttcctgcgtccttccttccttcgctggtgtgaacatttgggtttggtgaagtgtgaatgtttacttccccccccgccgccaggcttttttggtcggctacctgggatatttcaaaacattttcaaacgaagattaattatttgtgaaaacatttgtgatgatttatagaacttgagttcgttttctttacgcttcttgagaccaagtgccattgttagtctgatagatccttgtgacctcttgggagtattgggatgctgagataaatatcctatttacctaaaaagaaatctttttatggattggtaagaaagaagccaaggctaggaattctggctgcagtagaatggagaggtagcaggaaaccacacaaggggtggagaagtgtggatcttctgtaacttggacgagtatggctgaacctaaggaaggaattgctccttgctaagacacaacacaaaacaaaaatcccagaccagcttcagtaggattcaccccctccccagggtacaaggtttatggaaaatggaatccctgagaaggctgagaggggcgtgcaagggaggcaggttaactccaaatgtatcatattagccttctttgcaggagacacattggtacgaaactcttggtagcaagttggtcattggggaccctagtttctaactgctctagctctggactcatgcttcctgtttcttcttctttttttttttctcttttcccttcaaacaatatcttctgacttccagatttctgataaattgataagaggcattgcgtgagtcaatagagctgtagacactttgccaatataaccccggctctattgatctgccagtaaattaaagtcttacttagaggctgccgatatttctaatctcctgcctcaccaattacatcctcccagctacctggaaagaggacttgagccttctaacctttttgtggtctgctctccttccatggaactgggggcacttgccttgcttatctggtaggtgaaggggcagcgtggaggagaatgaacctgcttaactccttatatgggatctgtctccgtgctatgagattcattagtaaaaatgtctggcaaagcaattccattgtggtggtcacatacattttatagcgagtctccaggccactcttgcccttgggtgggctccaagattggaggtagagaaagttgagagtagccggtcttggggattatcctggcatattttatggctgtcttccacttttaaaaaatttgtgaatagcctttcctttgccctgggaggagaatgggtgtttggattagatgttgggttattagtatttatcacttattaaaacaaaacatgcctaagagtttgtggaaaattagaggatcaaagaggagtcccaagatacattaggaaggattcaagtgtgtttatgtgcatgctgctttttttggaatttgttttgttgacattttgcattctccttattggagcagagacatgacagagaaagaactcattttttgtccattgtaatttttgccaatgtctcccctctgccacttcccaggccagcctctctgtcgttggcatgaagttgagtaatgacaacagccacctaaagatgtccacgcaggaacagtggggctgatcgagttccctgctgggattcccacttgggcgatggccttgtgagcaaatcgtttgtccgataagctcttttcaagtcccgtttatgtggttggctttgggaagaaatctccagataaatgctgttttctctctaatactccagagcgaaaaatcaatgggagggataattccttccgtcgtccaacacacacttcttgtgtgtttctacctgtggcatcactcacaaaaagtttttaaataaaatatccagtcctgaggtctcagcttttctccagcatttcagggaagggagctttaggaggctcttgtgtcccctttagtagaaggagcagcatggaccctgtgaccaaggagcgtttctcattttcctctttttcactctccttacctgtcaagaggctgaaggtgatggcgaacccaggtgaggaaatgtgggaaacacgccagtgtggttcatcgatgctagctgcatttgggaggtgatagaaggggccttggggtcccaggagcaggtgggagccattgaaaggactcctgttcctagcagagactttccgaactgcccctgggcagccaagatggccccatgttgaggcagtggagagggtctacctttggtgaggtcttctctgctgctgggcttgaggaaggtgcacttggctcccctgggctgagtgagtgaagaagatgttagacaagcagaaacctcaggaggctgggattgactttcccctttgtttggattgcattgtattgtaggaggtgttgaaatcttgttcacacctgtcgaggctgaagcctggctttcagagcagtttgtaacaagacttctgttgttgttgccgaaaaggtttccctgctcacaacagaggaactttattgtagcaacttgttaatgttcaattaggcaaattttgggtgccccggggctgtgggagggcccctgctcactttttctgggcggcccactgccccctttcccagggatgggcccggagaagcaaagcctgtaccatgggcttcttggagagccaccagtgggggtcttggcagagcttgagaatccctccgagcggttgaggttattggagatggaattctgtgtcttgagttctaacaatcgtcccctgtctgttggtgctttggggctctccccacccttgggtgtggccaaggctgtgcctgatgcatccttagcctgtgggttggcaggaggagcgaccaaccccaaacccggtgtgtggcagccccagcatcacactgccccgggctctggagccctgttcttcttggggatctgagcctgcctggccacacctgggcatgttctctggctttcttcctggcaggacttctcccgaacaactgtccggcaccttgatggatggtgttttccacctcccggtggactgaggtcttgagaccttggaaggggaaaaacaggaagctcatttctctaaataggaggtctgactcggaggtgcttatgttttcccacatgaacatggctgacagttgtcttcatggtggaaaaaaggggaatcttgggactgaagctctgtccccacactcccccaaaaaaaggagaagccgcagggtcccggaggggccgtgtcctatcctgccctgccctgacccgacccactgtctcggtgcagctgggacctggcggcctgggaggaggtgggaggtgggtgctggctccccttgactctgggaggcgtctgtgctgggaaggcccggctctgtgaaatatggtccccgtggcagcctctctctgcagtgctgagcgatgaggagtgcaaggcacccggcagtgtattaaacactagttgagcacaggaggggcagtatatcacaggagagagataagcaaagttctctgatagtggatcaataaaggttagtgacatcatatctcaaagtgagggaacctgctttctgcacagccatttatcagatcccagcctggaagggcattaacccctttctggccagatttcttcttactgaacacagacccaaattccttcttggtggtgggggcagtggggaggatagagggtgtcattttccctaacgctgtatttaaggaggactcttcacatgctgctttcggaaatgccttctgcagttagcatatgaaaccagctgtggctagagcatgcgttgtgtatttatggaaagtttcttaacttgaaattttgtgcaaaaattcccataaaaaggcattcccataaaaaggcattgttttctagagaagtttgaacaccccgcctgcatgcgcaagctgtattgctgtcagatacctggagcctgggttacgtttggtgtttgctaggcaagcaattttgactggactggagagttaaaattgtaataagcctgggaatgatcacggtttgtctttttttggctttgtggtattctattagtagatattgagaagtctcccagcaatctgggattggcaaactctagtctgcgggccagttccgacccaacacatgttggcatggcctgccaaccaagaatggcttttacatttgtaaatggctggtggagaatcagaagatgaatacgattatgggacatctgacaatatgtgacatttatatttgtgttcctaaatgttcattggcaaacagcagcacttgcttgtttgtgttttgtctgtgaccactttcatgctatcatgtggtgtaggtgagtagttgcagtgagaatgcgtggcctgcaaggcctgaaatagttacatggctctttatgggaaaagtttgccaaccctagtctaggctctagctccaaatctactgctaactagctgtgtgaccttgggtaagtcacgttagttctcctttacctgtgtttcactggtctctggaataaaatcttctcccccagcgattccagggtgtgctgggagtcaaataaaaatggatgagaaatggttttgaaacatagcttgcatttgcaaagtgtttactattaaatgagcagaccctttactatgtgttttttttttttttttttttttgaggcagttttgctcttgttgccgggctagagtgcaatggcatggcacaatctcggctcactgcaacctccacctcccaggttcaagtagttctcctgcctcagccttccaagtagctgggattacaggtgcctgccaccatgcctagctaattttttgtatttagtagagacagggtttcaccatgttggtcaggctggtctcgaactcctaacctcaggtgatccacccgccttggcctcccaaagtgttgggattacaggcgtgagccactatgactggcctttctgtttttgtttttgagacagagtcttgctctgccccccagcctggagtgcagtggtgtgatctcggctcactgcaacctccgcctcctgggttcaagcagttctcctgcctcagcctccctcccaagttgctgggattacaggcgcctgccaccacacctggcttttttttttttttttttttttttttttttgtattttttgtagagatggggttttgccatgttggccaggctattctcgaactcctgacctcatgggatccacccacctctgcttccctaagtgctcggattacaagcgtgagccactgtgcccagcagaccctctactatttcagcctatcggagactgccaagacatgggtgtgttccttttgggaagcatcgaatctggcgtgagaggttgagctttgtggaggtcacataacttgtctcaatcctgtgtcacattgggtgaagtttgagtctcagtctgtctgaaaacttgaaggcatgcatcttcccggagagaacatctttcgctttgcaagggaacatcaattttcctcagtgactgctgtgatttttatcctgaaagagttggatcacttttctttccttcccaccagtgatttatagacagggagagcaggccttttcctgtaggtctctgactgtttatctttttcggttgggccctgacaatactctggctgggatgttcatgttggctggggtgtcagggggccagatgccagacctgcagcccaggggtgcctgggggagggataaggaggccagagattccagcccaaagctaatgggctgatgtccaagtggaaagtgtattttcattgaggaagtgtaggcattagaggaccctggattactgtgtgattgtgctgtcaatactgctgtatcgagtccgtgagggctccacaatacggggaaacacttaactcactgctgctgcttattgagaagccaatagcaatttacttgctgacacttgacatcaaatccattcccagaggtggagctctgcaaaccaccatggtgtccctccccttcccgggccccctctcttaacttgggtgtctgcccatgtgtgagtcctgcatgggctggtggctgccgccgcattgggaaggacttggggcagggcggtgcagggcggtcgttgtggggaggggaacgttcctgtttaactttcatagctgacatgacattttcttctcctcccaattgctctcatactcatcttctttcaacaagtgctaaatgaccctcccttcgttccccctgcggtgtaagtcttctgcatgtgggaactttctcctctccataaaaaagttagatccttataatggatacatgcggagatcatatgtgggagagggctgaggaatgtctcgtctccaggaggcaggcggtgtctaaggggcagtcaaggccgaggggtattgtgttggggagtagagagcttcccatacaaggtgcagggccttcctgggcccaccttctgggggacatgtagccgctgagctgtgggatccggcacagccagaccctctggtcctcctgtaattcttcgtggagtggagtctctctgcaaagtgtctggctgcttgattgactgtgtttttacatagccaacctgttgagatactttcagaccctggagtcttctagaataatcagctcacaaatcagggtaacccgcttctgggaggcggaacccgactgacacatggcggtttaggggtgaccagcccaaggctgccattggatctggctttactgagtgctggtgagatttcgttttatcattgcattcccagtcctcgagaaccagtgccctgatcctttcagtgcaactcacgtgggcttatttgcagctaccacttggagatcagggacaggaagaattgggcttgggtagtcaatggtgcatgatctcagactcagtcttcatgggtggtgcctcctgcccgtggctgggggaaggaaggggagtggagactttgcctgcggggcatgatgaggcttggtggagactggccatcaattcagtggcgtctgctgcctcccatctggaagtttctccccagctgggagatggggctgcctcttctcttctttcgcccctcccttcccccatctctccttgctcacctgcctcttcgtttctttgccaaaacactccagctatttcatttctttcaggaggagcaaagctgtgtggatgtgagatgagggggctctgtggactttaccttgtctccagtgaccttgattcgatgcagactatggagcaagtgggtgaggcagcctctgtctctgctgtttatttagcgccactggcatgtgcatgttgtttaatggtaatactgcacgtgccttgtttccaggacgtccttctctgggaagacagagcgctcaaaagaagcccttctacccagtctacagatagggtgggaggagctggtgtcctccccgtaagcctgtcctgaaacggaagtgtccctcggagctcccttgcattttgttgccgtggatggagccacgtggcctttgggctgacgtcgtggtgtgtgtggtcgttgcagcctttctcttcgttactctaggctcaaggattggcgtgggtggtggcaagatgacatgaagcctttgaggttatggatttgagctctgattccagccgtcttcaaaatactcactttaagccttttctaagcgctggttttctgcaaagcagagggtcctacctgaaggatgcattaggggtcttccggctcctaggtgtgtgacctgcgtaagcacagtgctgcctgtagcgcatcgtgggagggagccgggggcattggctgttgctttggccctcgtggcttatgattacagtgtgcacacttgtcttgctgtgcttatcttattcaccttaagagtttctgggatccagcctttcctccctccgccccttaccctcacaggcctgctccaggccccttgtgtctagatgacagcaggctcctaaggggggtttccctccagccccttccacctccaggcagtctctgtgcggaggttgcacagtcttagcttgtaggcaaaacctagcctgtagatgtgttttgttcagcaaatactatattttattttatttatttatttattcttgagacagagtcttgctctgtcgccaggctggagtgcagcagtgcgatctcagctcactgcagcctctgcctccgaggttcaagcgattctcctgcctgaggctcctgagtagctggaatcataggcatgggccaccacgccaggctaattttttatttttagtagagatggggttttgccatgttggccaggttggcctcgaactcctgacctcaagtgatctgcccgcctcggccttccagagtgctgggattacaggcgtgagacactgcacctggccacatactatgttttaaacatgggcacatttcacagaaaaatcagtattaaaaccttctcttgaaaaaaaaaatcgggggatttggccattttgggtcttcagggcaaaacctggctagaacagggtggtgactgccccttgtggaaggaacatctactttttaggttgccagagctcactgttgcttaccagctcttaccctaccacgtcctgtttcccagccaacttcgctcatttgtgttacctgcttggccctgtgctgtctgggatcgtggcatgtgggccgtcattggactgaaactcagtttcagcggttctccgtagggggtgattttgcttcctccccccaagatttggcagtctggagacattcttggttgtcacactttggggagaggatgctactggcatccagtgtagaggccagggatgctcctaaacatcctgcgatgcccaggacagccaccctcatccccaacgaagaatgacacagcctgaatatcagtggtgctgccctcaaactcccggctccgtattcttcttgttctgctgaccaggggcctgcagtggctcctctccctcctgcctttcaccatctgcctgcctggcttgcaggcctgactcagggagacgggcttctcccagcctggctttctcagcgagagcttccagccttggggcttccctgggctgcccttgaccttttgtttgagagtcccatgtgtgccagacactgttgttggtgccggtgatactccaatgggggcaaaaaaagagagaaatgcttgtctgcttggagcttatactacctcatctccctcactggacatcattactaagtgcattatagtattttggatgatgttaaatgctgtggagaggaggcgggacgagggcagggggtgagcagtagttggcaggttcggtggacacagtgaagaaaggctttcggagaaggtgacatttgagtaaagactcattccttagcttggagctgtgtcactccagcctctgcctcccgtctacacgtggctgtcttccttgtgtgcatttctgtgtgttccctcctcttctaagggtaccagtcattgatttttttttttttttttttttttgagatggagtctcgctttgtcacccaggctggagtgcagtggcatgatcttggctcactgcaacctccacctcccaggttcaagtgattctcctgcctcagcctcctgagtagccgggattataggtgcccgccaccacacctggctaatttttgtatttttagtagagacagggtttcactatgttggccaggctggtctcaaactcctgacctcaggtgatctacccacctcagcctcccaaagtgatggtattataggtgtgagccaccacacctggctcagtcattgatttaaggcctaccccgatctagtctgagctcaatttagttataaattacttcaaagactctatttccaaataaggccatgttctgaggttcttggtagacatgagttctaggagggatgctattcgatctgctccaggtgcttatcctctggatagattttgaagggagatatgggacaagacaggacatagagtcaagggtgactgcaagatttttaacttgagtgactggaaggactgtatccctgtggccttggctgggctggccagctcagcaggccctcgtcccagaacctcgagccccgtttcctcgattgtctttcctcgctgctctaaaccccttcagtctttccttttattgagccactatatgtctacttagcatcacaattaggcctctgagttagctgctcaaatctttaattatgagtaaaagggtaaggtgccaagtctgtctgaggacatcgggaaaataatttaaggagcttcatttttcaaagtccttgggcctataccctttcaactaatccttgcaggtgctctatacggtatgcagagtggggacacatctcattttgtagatgagaaaagctcagagactaaatggctttgggggatcatcgagcagttggttcagatctgcatttgaacccctatggaagagtattgggggggcgggatgaagtggattatataggaagacatcctgctgcataacgttttactcagttcagccagatttgaataggataagacagaaaaggtccaacaaccatgcccgtgcctccctgactttacccttaaaccagtaaatatttaaatggagaatttcaggaagaccaggggcattgaagaatcgttgagtcaaactcaacattggaggtctgaactgatcagttccacttgatttcagtttcgatgactattgctgagtcatggtcgacaagcactgccaaagtcaacaccacgggcctggccggggcagctggctacacagtggtttgtcccatgggtcccgcgttgcccgttttctgtgtatttcagaagctgtcccatatggtgaggccattcttggcccttacactctgtgtgggggatgtttttctttcggaatctaagacagagagcttttgttgggaaatttcttgtgagaaatcagaagtatgtctttactttttgatagtgtgatagcaacatcacccctcttcgtggtttccttgggcagtttgctatttgatctgatcagaaatttgctcatgatcctaagggagtgttctgccaatgtaaagtttgcgtatgtgattcattaaatgtatttttaaaaaattaaaatcaggcctcccggtgcctctgtagagtaattgatgcagggctcttgctggtgcctcttgtcctggtgacagtggcctttcccacagtcatggtgcttcctttttcttgcatagtcagctctcaaaccaagaatgtgaaggatctgtgtgagatgttgcagggtacagtggattttgtctttcagcgatgataacgaatggtgatagttcccatggaatgtctccatggcgcttgcaggaggttaaagggctcagtacgggacccagacagagttggaacagacattttttaaaaacgtgtttatgcccagccaggaatgccagcccgctctctcatttttcttaccagtgggctaaacaaataaacagttccagttgtgggcagatggatgaggagatcttgaagaagccatagagaaagggaagggggcgggtgagccctgattgctctacgtgggatgaggggtgagagagcggagaaggctctctaggaacgggctcagggtttggactgagacgttgcttcctgcgcgtcgtgatgactcacaatctccaggttcatgccctttagagcagacagtctgtgcatctcagggtgaaggtggggatagcagagcggggtcacccagtagccagggcaggtttggggaggcaaagtgctgttccctcgatgctgcagtgtggctgggagggctgcaggggtccaggcaggggtttccggtgggcaccttggtaaggaagtgtatgtgtgttcacacttggtggaagggttgtggtggcctgtaaaccaggcagcccatgtgcactcaggtgcgcgtgcagacacacacacgcacacgcacacacacacacacacacacacacgcacagacacacacacgcacacgctggtggaggattcagaggcccttctggggcttggcgtcatgtcctgagagccaccttcctgagactataaagtgggagtgaggctcacgtccactggcagctggcagtttcaacagcatcaggccactttctgaaacgaactggccactcggtccttgcctcgtagtgatagcttttgaaagtcacaagtggctttaatcccaactcttttgacttgagccaggatgaaaaggtgccggatgttttgctgttttattctttcatccagtgacagccttgaggattctgggaatgatgcatcgagggatgtgacaatgagtgtgtgatacagcggagctctgggcctctgaggtgtgtgtccttagaagcgaggtcagagtcttagcggaaccggaagcttgagccccaacactagggtgcaagcagagctgggtagtgagttctttctgggttggttaggagggagggtaacctttgaatgagaagagctgtagctttcagaataaaatcacagtggcaagcattgaggaaactgacagccagttttagcatttagactatacagaggctagcttcagtccttcagggagacagttcagattctcagagtgaagagagtatgataacacacagccaagcctggggtgaatccccacaaaatgccaattaaagaaaattcttgccatttattatttagagttattttattttattttatttttgagatggagtctcactctgtcgccaggctggagtgcagtggtgtgattttggctcactgcagtctctgcctcctgggttcaagcgatcctcctgcctcagcctcccaagtagctgggactacaggctaatgcccaggtaattttttgtggttttagtagagacggggtttcaccatgttggccaggatggtctcgatctcttgacctcatgatctaccccgttcagcctcccaaagtgttgggatgacaggcgtgagccaccacacccggccttagagttaatttattttataagatcaaaaccatggccaggcgtgtatgctcacgcctgtcatcccagcactttgggaggccaaggcaggaggattgcttgagcccaggagttcgagaccagcctgggcaacatagtgagaccctgtctctataaaaaaaaaatcaagcaaaattagccgggtgtgatggcgcatgcctgtagtcccagctactcaagaggctaaggcgggaggattgcttgagcctgggaaattgaggctgcagtgagccatgatcgtgccactggactccagcctgggtgacagagcaagaccctgtctcaaaaaaaaaaaaaagataaaaactgagaaaacataggtcccacttcatcgaaaaaatcaaattttcatccaaaaggaggaaatcattttctgaagaggagagagtaaaagtggggaattaaggagcatctgcagaggtagggatgggtcagacagtaggcatgggctctatgcaggtggcagaggtcttagcctgtttggtttgctgcttacccctagccctagtgcagagagagcagtctctggcacactggggccacttggatattttaatggatggttggacaattctctggacgagctctatctgtggggtgctaagctagcaaagctcttggtggaggactatgtggtctagctccctggagttggagaagtcagctgataggttgtgctaaagaccagagaggggtgggtggaggggaagaagagaaggcattatttagtcgtgacggcagccaagacattggtggggagcccaggtgagtgctggagagagaacagtgttggcagagttttcatgacttggcgaagggcaccactggaaagcggggcaggaaaaaacttggagcattttcagatatacctttcaagtattcctcctcctaaggccaacaggggatattttttgggacccacctccctgaatgagagcaaaactaagaccccactcccctgaatccaaacgtagaaaattcccatcacgtcttgggaacacattcaaattgcccactcagcctttgatatctttttgccttttttttttttttcgagatgggagtcttgcagtgttgctcagtctggattgcagtggcacaatcacagctccatgcagcctcaacctcccaaggctgagggaggtgatcttcctgcctcagcacccccaagcagctggaaccacaggcacatgcccccacgcctggctgatttatttttatttttgtagagatgaggtcttgccatattgcctagtctggtcttgaaatcttgggctcaagtgaaccttccaccttggcctcccaaagtgctgggattataggcatgaaccactgcgcccagcccccttagtcttttttttttcaaaggtgcattaaggcataaggagtgttcagcaaactctcttgggatatacacgtgaacttgggtagggtcccagtgggcttcagctgtaatggggagattctgctcggagccactctgctgtcaccagggtgcgaatccacatcatgagaggcacagagaacattctcagttcacccagaggttacagagaggctgtaaatggacattcaaatagaagaggaggaaattactggagtcaactctggtgtaagggctttaaacaaaggccataaattagtcatatggtgacatctaaggaagacaggattctatttctggggttggtttattattattttgagaggcatcaggagaagcaagaggaaaagagaaatgggtcaagtagcataaagaatttgaatcaaggcaaactagaaaccagttttgcttgaattacccttcttgggactttcactattcaaagtcgtatctttcacaagcaggaggctgaatgagaaccctttgtgaaaggtggttatgttttgttttttttttaaaccacttcatcttgtcatgtacaaagtagcgccttgtacatgtgtgctaaaattgaacatttaaatcctattgagtaatcctagttactccgaccttaaaaaccaaaacacaattcatgttaattgttaacataatacttcaggttaattgttaacacaaaatggggaagtggcaacaaacatgcaggagtgggagaattaagtcatatctgggcctagagagttaagtggttgggtagtctggcttgtgattgaaagagaactggaggagcctgggatagaaatgagatggtggtgatgggatctcctttgcgtaagagagaagactattctttgcatagaggtgattcagaaatcgctctgtggcaggatgccttctgtccatatggccggtctttgcgtgggccattcttcaaggtgccatgccttgactgggtcaacatggccagtgcccgtatggtgtgtaaaacccagtcctggaaagctggctcccctggaggtgttgtgcaattggggcagccggcagccagcttctgatgtggttggctgcctggctcacacctctcaggtgctgcggagacagcaagatccagtggccccaggctaccacggaggcgggcagggtgccacggccttcccgagccattctgtttcctttgtcttcaggagcccagcgtgcacgggccctggctttccagttcttcaggctggctgcctggcatcacagcgaggcttcaggcgggcccacctgtggaatatattgggtaaggttggctcggcctggcttttgtgaattgataaaaggaactgtggatccagggattcttcttgaatgtagatgtttctagttcggtgtctcctattagataaaataaacatgtagcacacacaaactctttgtccaactactgtttttctgttgtttccttggttaatttggatatttataaatctcaaatgcggtaggccaggatgggaggttttttctgtctaatgctaagatactccactgaacacctctcctaagacatagccctcgtggccggtgtggtggctcacgcctgtaatcccagcacttatggaggctgaagtgggtggatcacttgaacccaggagttagagaccaacctgggcaacacagcaaaaccctgtctctacaagaaatacaaaagctagctgtgcacggtggtaggcgtctgtagtcccagctactcaggaggctgaggtgggaggatcacttcagcccgggaggtagagggtacagtgagttgagattgcaccactgcactccagcttgagagacagagtgagaccctatctcaaaaaaaaaaaaaagaaaaaaaagacacagctcttgattacagcatctgaggcctttggtcctaatttttggtgatggagaaagagaggtttcagctggtccctagggtctggagaaggagggtagtgtgaaccccttggtagggtgaacccttcagggacacccctgcttctgtgtgtccagtggttctgtccccctttctccagatggctatactagtttcctcttgatgccgtaagaagttaccacataggccggacatggtggctcatgcctgtaatcccagcactttgggaggccgaggcaggtggatcatgaggtcaggagatcaagacatggtgaaaccccttctctactaaaaatacaaaaattagccgggcatggtggtgcctgcctgtaatcccagctactcaggaggctgaggcagagaatcgcttgaagcagggagtcggaggttgcagtgagttaagatcgcaccactgcactccagcctggtgacagagcgagactgtgtctcaaaaaaaaaaaaaaaaaaaaaaaaaaaagaagaagaaattaccacaaacttgttggtgtaaaacacaaacttaagtttgcattttgatgttttctgtaaggatgtagtatgtttaaactttattaactaatgttcaaaactgcgatgtgtgcatagaatattacgtatgcatgttcatgtctaaagaatggctgttgatgataaaataaaaatcagctttcatttttccaaaaaaaaaaaaaaatgcaaaaaaccgcaaactgattgccttgtagctggagcctagaagtctgaaatcagtttcagtaggctgaagtcagggtgttggcagggctgctttctcgtagcggtttcgaggaggaacccatttccttgcatggtctaggttctggaggcccccacatttctgggttgatggccccttcctcacatcactctgtgtcatgcttctgttacatctccttcttctgcctgactctgtcctctcctttgcccctgttgtaaggacccctgtgattgcatcaggccccctggataatccacgatcatctcctctatccaaagatccttcacttgatcgcatctgcaaagtttcctttgctgtagaaggtaacatatttgtaggttacggatattaggatgtgggcgtcttcgggggttgttattcagctactgcacggtcctgtggaggaattggtgcagttggcaaagaaagagacccccacgtgcctctagaggtaggtggctcaggagggcaaagctaaaccaaatattacagccttacctgttccaacaatgcctatttccttggaaatgagggaagaggcttcgagatgaaatttggtggcctctcccctcccccaaataatgtgacattattttgtgaaattgtattttggtgaggcccaaagagtcatacttgagagaaaaataaaagagagtgtttataaagggtttttggccaggcaccgtggttcaggcctgtactcccagcactttgggaggccaaggcaggcagatcacttgagcctggaagtttgagaccagcctgggcaacatggcaaaaccctgtctccacaaaaaatagaaaaattagctgggtgtggtggcacacgcctgtggtcccagttacttgggaggctgaggtgggaggatcgcttgagccagggaggcagaggttgcagtgagccaacatcgtactactgcactccaacctgggcgacagagcaagaccctgtctcaaaaataataataataaaaaaataaagagttttcacatgggtccctgtaaagaaagaatccaagtgttgtgggaataagagcaaaggttcagtggagattgataccacactttagaggtcacttgaagggcacagatgggcagtctgtgatgtgttcaggatggtggcctcctctctgcccttcttgtacagccccttggcctgggtaccttcactcccgtgattggtaggtctgtacctcctgagcgcccagatgaaatgtccagttgctagttgatggcttataggctgcctttggcagtccaggagtcctgggggaagtgtgtgcataggatggagctatgtttctagaaccagcatggatacattttctgctacaagagatattgcaaatgacaattcattccttggctggcctctgatactatgtatttgaaccatatggaatcaccatttttggattaaattagagttgttaataacatcatggaagaacgtgttaggttctgggcaaggatcttaacagcacgattttggaacaagtataggttgttgggtatctagattatatcattcgtgccaggatctcaaaatttgggatggaaaatacttctatcaaattattttccttttctctcctcttctcttttgtctttgtcttcatctccagctgcctagattaagatataagtagtttcacccaaattccaaggaggacttggaggatgaaggccggttgctgctgtagtgtgtagccaccgttgggcaccggccgtgggcttgggcccctccctacacttgttccaaaactgtgtatttaagatccttgcccagaacctaacacattcctccatgatgttattatttaacagctctaatttaataaaaaaaatggtgattccatatggttcaaatgcatactatcagaggccagccaaggaataaactgtcatgtgcagtatcacttgtagtagaaaatttgtctctgatggttctagaaacatggctccatcctatgcatgcacttcccagcacagaggttgagctgcagtggtcatggagaggcgctgtggagctgaatggagtttgaggctgtctgcccgttagttgtacctattccaccaggtgttttggtgttggaagacttgagatcaagttctcagttggcagtggtttcaaagccctgctgagaagactgactgcctttttgggtacctctattttgaagtggctgtgacatttgactgtaatgtttagctcgaatgtgttttgtgcttgatgagctaatagcatgccttcctctaaagatagtatttcagtggtggcagaagaggcttcctctttggtcttgggggacggggacagaagtcagcttctacccctcgatagaaacttacctggtgccccagaattagtgcagaatacccaaataacaccaagataaaaaaaggtatcccaccgaattgagttgaggaggggcatcttaattttggttgcatttattatcccagtattttggggggaggggagttagcttaaagcttaagaatccacaggggggcttgtgattttttttttttccttgagattgagtcttgctctgtcactagcctggaatgcagtggcatgatatccatgcactgcgacctctgcctctaggttcaagtgattctcctgcctcagcctcctgagtagcgccaccaagcccagctaatttttgtatttttagtagagacagggtttcaccatgttggccaggatggtcttgatctcttgacctcgtgatctgcccaccttggcctcccaaagtactgggattacaggtatgagccaccacgcccagcccagacttgtgatattaatatatgcagtgttgctgggtgtggtggctcacgcctgtaatcctagtgctttgggagttcaaggtaggaagattgcttgaggccaggagtttgagaccacgctgggcaacaaagggaaaccccatatctacaaaaaattaaaaaaaaaaaaattagccagggccaggtgaagtggttcaggtctgtaatcccagcacattgggaggctgaggcaggcggatcgacctgaggtcaggagtttgagaccagcctggccaacgtggtgaaaccccgtctctaccaaaaaatacaaaaattagcccggtgtggtggtgcatgcctgtagtcccagctactggggaggctgaggtgggagaatcgcttaaacccgggaggtcgaggttgcagtgagccaagatcacgccactgtactccagtccagcctggatgacaagagtgagaccctgtctcacaaaataaaacaaacaaaaaattaacccagtgcggtggtgcacacctgtagtcctagctactcgggaggtagacttgggaggatcacttgagcccaggagttcgaggctgcagtgaactatgaccatgccagtgcactccagcctgggtgacagagcaagactctgtctctgtgtaaaaaaataaaataaaaataaaatgttcaatgttggtcagagagtagaacttgatgtaaatgtctcctggagtagaactcgtgtgcccaaaggactggctctggagtgggtggtttctgaagacagacacagcacatcaggcagagtggagacttctggctgccagctcggtccttttatgaggtgtctagagtcagctcccctgagaggaggaggctgagatgaggtaacctggttctgcaggtcagcagggaggctctgccctgaggctgtgtgccgggctctctgataatgcagcattttcgctttaatgcatctgaaatgtggattatactattaattactgctggacaaagagggattagtgcagctggcccactttcccctttgcacttttacacttcccctttgctagggaatgggccaaaggccagcgggttttcctgtcatccgtcttttgttttagcggcagtggctgctgaacctctcgtggggatgaatggggaacggtgcagagtcttgaactccatttggcacacgggcgatgcaggtggcacagtttccttccccacagctgggcattctgtgccaggctcctagggtggctgctgggtggcttctccccagcagggcgagtagcagtgccctgcagcatcttcgctgttaaagggccttgctctgtggtgggagctgagtgccaccttcccatggggcgtgcctccgtgggtgttctgatgctaatggaagcccccaggtgctgtgtacctttatgagtttttttttttttttttttctttgagagggagtctcgctctgtaacccaggctggagtgcagtgatgcaatctcggctcactgcaacctctgcttcctgagttcaaatgattctcctgcctcagcctcctgaatagctgggattacaggcgtgcgccaccacaccctgctaatttttttatttttactagagacggggttttgccattttggtcaggcttgtctcgaactcctgacctcaagtgattcgcctgcgtcggcctctgaaagtgctggaattacaggtgtgagccaccatgactggcccctttgtgagtttcttaaatggtcaagtaaagtacaaaaggctggccctgccatctgctgctgggggatggaggttttggtagccagcaattagcccatgatattgtatttgagacattctgaatgcctaagtttggtactaacaccttatctttgcataaaacgttatagattttaagtaatatatgattacattttctatttttttcccatattcaggctagtatactcatttttcatccatatggaatgagttttttttttaaatagatgaagcattaaataaccacatctcactaataatgctcccaagagtacataacttggtggtgtttgcaattacatacaatgtaatctgttgtgtgtgcaggcgtgtggatttctgtttaccggcatccttcattatatggtaacataatatacagaatttcccagttgcagaaattagaaagtaggaaacagatttcttcaacgtaaattggaaaactgatttatggagtccatttttttttcttttctttttaacttggcactacaaagtttgtgggaaggaagggagttgatacggtatgatgcttataagcacaagttaattcaattaatttgggattgaaatgcgttttaaggtctgtagcaggcaagatctacaagatgtagtaattgtaaaatgggaaaggctgcgtaaggagatacagggaactggctactgtactgcctcagcttcatgttcctgacatttaggtttcaaaatagcccagttggaacctcattaagctttttaacatatatatacacacatacacacacacacacacacacacacacacgtatatactttatttttcttgtagctctcaattcttctgaacttggagattgcagaattagagattattgtttttccctcctgccttctttagtcacagatgtaatcatcttggggccaagtcttactcaattgaagccatctctaaatttcatcaaaaaaatatggaagtttacttggttatatacttagatggtgtatctgggatggttttattccatttattgaggggtgactttgcttctgaaataagcaagcagtatatgcccaagataaaattttcagaaggcacagagacttaacatcctcttccctctctccttgtgttgcttacactcagatctctcagtgccccaggaccaatggtggttatatcccttctacaaggagtgtctgtagatatggccatcacagcattatatgagtcatttttcacttttaacattgtcgtgttttctatttaaaaggtttttttttatttgccagagtttcatctcctttcagagatgtttttatcctccatagaatacttaaacatgttaatgaaatccagttacttgaaaatttaaaaatattctcctaaatcacacttgggtcaaagaggaaatgaagttactgttacaggatcattaggaaatattgagaactctgtatatctaaatgtatgggttattaccaaagttatattcaggggcacatttgtagctttaaaacattattaaagaaaatgaaaataaatgaattaagtattcaactcaaacttggaaagcataaaacaagcctaaagacagctggagaaaagaattgtaagataaaagtgatattaatgaattagaaaaacagataaaaacactgaattgataaatctaaaagctatttgggaaaaaaggccaaggaagtagaccaaatcactatcatgtttaattaagaaaagagaaaagagaaaaccccaaatacagaaaactaaaaaggaattgatatgatagaaaaagtgtaacaaatgtaagttgcatttgaagtaattgttttgtaatgtaaaacacagtaacttaaaatgcaacacctttgaaaatcccagtgacatggctgttgggaaatgacttggatgtctgaaactttaaatcagaaactggggaagaagctgagcattaaaaaaaaagttctggccttgcgcggtggctcacgcctgtatgtaatcctagcactttgggaggccgcggcgggtggatcacgaggtcaggagttgagacctgtctggccaacatagtgaaacccagtctctactaaagatacaaaaaatcagccgggtgcggtggtgggcacccgtagtcccagttactcgggaagctgaggcaggagaattgcgtgaacccgggaggcagagattgtagtgagccgagatcgcaccactgcactccagcctgggcgacaatgtgagactccgtctcaaaaaaacaaaaacaaaaaacagttatgaggagggctctggatgcaagaagtttaaaggataagttattttaaacttagagggatgctataattgcctgctaaatacactgtttcagggaatagaaaaagaggtaaagcatcccagttgatttgacaaagctagcataattctgggaaccaacaccatcacaaaggttacacaaaaagaaagctgaagattgagttccgacatgagtggagatgcaaaaatgccagataaaacagtcacagattgaatttagcattttaaaagaatcataaccacataggatttatcctggaaatgtaagaaggggcttaatatcagaatgtcttctcttgaaataatcatgtatgtagagccaagaagaaaaacataatatagttggccttcatagtcacccgttctgcatttgtagattccagcaactgcaaatcaaaaatatttggggaaaaaattgggtctttactcaacatgtaaaggacctgtggactcgacagcctttttgcttgtcattattccttaaatgatacagtttaacaaatatttatatagcatttacattgcattaggtgttataagtaatcaaaagatgatttaaagtatacaggaggttgtgcatattatgctgttttatatcagggacttgactatcctcagattttcgggatctatgggagatatagcaagggacagctgtctgtctgtgtgtatgtgtgtgagagatacatttgatcaccttccttcctttccttcctttcctctttccttcctccctttcctttccttttctttcgtttctttcttttttttcttttctttcttttctttctttgtcttgttttgttgcttaggctggagtgcagtggtgcaatcatggctcattatagccttgacctccagctcaagcagtcttcctgcatcaccttgagtagctgggactacaggcacacaccaccatgctgggctttaattttttttttcatagagattggggtctcactatgttgtccaggctggtcttaaactcctggcctcaagttatcctcctgcgttggcctcccaaaattctgggattataggcttgagccgtcacacttgactgcatttggtaattttctacccttattcctagtctgcttagaattttgaaaactcaagcttgaaagaggatgcattgacttctcaatgaagaaacaggcagccaacaccctcagacttagtgatgaatcatgagaggcaacattctgaaactgggaacacaatggagactatggaatatactaatttgctaatttctttttcctaccttattgaactggtcaggatggacaaaccaaagtcaaataatggttaaaaagaaacaaagaaaattatttccagatgttactgtcttcctagtggcccaagacacatttaaatttaattaaggagttcagttacaacgtaacattttaaaagataattagctttctcatatactgggaaaaactggttagaaaatatagagatcactcagtgggatggaatcaaatagaaatgtgtctggtaaaggttgtatttcatgttaagtgagaggaatcagagtaacagctcacataacgcttcagaacttctaagtgccaagcattatgctgaagaccttttttttttttgagacggagtctcgctctgttgcctaggctggagttcagtgacacaatctcagctcactgcaagctctgcctcccgggttcacgccattcttctgcctcagcctcccgagtagctgggactacaggcgccggccaccacgcccggctaatttgtatttttagtagagacgggatttccctgtgttagctaggatggtctccatctcctgttctcgtaatctgcccgcctcggcctcccaaagtgctgggattacaggcgtgacccatggtgcgcagccaacttttttctttttttgagacagagtcttgttccctcacctaggctggagtgcagtggcacgatcttggctcactgtaacctttgtctgccaggctcaagcagttctcctgcctcagtctctcaagtaactggggctacaggtgtgcgccaccatgcccagctaatttttgtatttttagtagagactgggtttcaccattgttggccaggctggtctcaaactcatggcctcattatcttcccgccttggcctcccaaagtgctggcattataagacgtgagccactgcaccagaccaagactttatatgaacttatttaatcctcataaaaaccagatgaattggatactactaatacattactaatagttcattttatagtgaaggaaaccgaagctcagggagtttaagtaacaggctcaaagtcagccagacttggacactgatgtaactgacagcaaaaccagtgatctctatcactgcacttcactgcctctcgtattataaaattatgcaataaatggttgtaggacagttagatagccaaatggcggaaaaattaggttagagccatttttcatagcatatgttaccatccattccaggtgagttggagaggtaaaagtaaaactaaaatcacaaaagagctagaagaaaatataggttaatattgatctgaatatagggcagtgaggaatattaggcctaagccttgtggggaagaaattgtaatagaaaagattgatgtagtctacttaaaaaaaattgtgcatgctggtcactaatcacaaaattttaaggcatatgacaaactgtgaaaaggtgtttagagcacatggaattgacagtgtgtcctaaatccttaatatataaagagctcttaaaaatgaatgaaacagccaggtgcagtggcccacacttgtaatcccagcactttgggaggttgaggcaggcacatcacaaggtcaggagttcaagaacagcctggccaacatggggaaaccccatctctactagctgggcgtgatggtgggcatctgtaatcccagctacttgggaggctgaggcaggagaatggcttgaaaccaaaaggcagaggttgcagtgagccgagattgcaccactgtgctccagcctgggtgaaagagtgaaactccatctcaaaaaaaaaaaaaaaaaaaaaaaaagattgatgcatacagatagagaaaaatggaggccaggcacagtaatcctagcactttgggaggctgaggtgggaggattgcttgagcccaggagtttgagaccagcctgggcaacatagtgatacctgtctctacttaaaaaaaaaaaaaaaaaaaaaaaaagtcgtgtttttatgtagttattattgtggtaaacaaaaataaaaagagataaatgggcaaagaacacaaatggacaattcatgaagaataaatctaggctgcccatttgaagagccaaatgagacctcattgttttaacgtatttgattactggtaaggttgagctttttttgttttgttttgtttttttgaactaagtggaaaaaaaaaaaaaagcaaataccctgatctggttattgggtataaaaattagtataccctttctggaggatcatttggcagtatgtgtcaagaaactttaaggtttatttaaatgtgtagcttttccccccgtgaattcctgaccccctcactctgttctgcctctgcatttctgaccataccatatgccactagtaaaatactatacaattaaaaaaatgtattatcctttttgtttgtttgtttgttttttgagatggagtctcgctgtttcgtccaggctggagtgcagtagtgcagtctcagcttactgcaatccctgcctccctggttcaggcgactctcctgccttagcctcctgagtagctgggactacaggcgcccgccatcactcccagctaattttttttttttttaagagatggggcggggtggggaggggggggtctcaccatgttggccaggctggtctcgaactcctgacctcagatgatccacccaccttggcctcccaaagtgctgggattataggtgtgagccattgtgcctagcaaaaaatgtattatccttgattgtttcccctgctagaatctaagcttcacaagggcggagtctttgtctgatggtttttttttttttttccctttaattatcttacgtctaatacccggatcaggactggtgacaactccatttgtaataaggaaaccctgagagtcgtgcaaaggaaatttatacataaagatttttgctacagacacttataacagacatttataatagtgaaaaatggaaactatctgaaaaatcttacaggggattgatttaaactgtggtgcagccatatggtagatgcttatgcagctatttaaaactcctgcctcctggttataaatgtgggaaaacagtgatgtaaatggaatgaaaggaactctgtggactataggacttcagtttaatttttaaaatatgcatagaagagaagctaaagaattacatatgactgatggctatttccagctggtagaagtacaggctacttttaatactttgttttctgagctccgcatagtgaatatctattactttttgtcatgagaagaaaatatgtgcttaaaagtttgcaaaaatgtagaatcacttaaatagcactggcctgtggctgtgtttggaggctttttggagattattcaatcttgtgaattagcgagaacctaatttaaaaaaaagcagcaaagatgcttcacaaaatgtccttaggctacttagctttaattatttatgatatttactgtaagcatctatggtatgtgtttgtaaaaatagtggaagtcttagtgatctgcaagcttgtggaatcaatcgccttgggtacttgagaacacctttgcccaagttagctgtcttgatggaaatgtgtgtgctgtctttctgatatgtcactgaatttcaaagcaaacttagatcacacctcagcataagctgggtgggcagtatgcagttgtgatatgtgatatgtcgattctggtattaaccaaggagaagacgctctgatctaccttctctatctcgtcactttgtggaaggacttagggggcaggtataggagaagctgccaagtgccaggggagccagccaccacagagcattaatcttggtgtgccaaaagagaagaccagagttactgatggagttctcctggccagagaagtagaagcttgttcagcatgtttgagtagaagtttcctggaatccctaaagagtcacgtgctatcctggcgggggtttgagttccatgtccgttactttatggctgtgggtctcagatgctttatctgtaaaagaaagttagactggattctctcctcactctttcttcaaccctaaaattccaaagcaatctggtatccttttatttgggggcatgactgttaggtgtctctgtcatctgtgaggatggagagaggcccagggagttttgctgcttttctggtctatggaccggaatgtgggcttgataggtaatgccacatggtgagaggaaggtggctagagagagtcagtctggcctaagtgagaatctctgctacttactggccaaaattatatattttcttttctttcccccccttttttttttgaagggtctcactgtcttgtccaagctgaagtgcgtggtggtgcagtcagggctcactgcagccttgacctcccgggctcaaggcatccttccacctcagcctcctgaatagctgggacgacagtcatgtgccaccacacttggctaacctttttttaaaaaaaattttgtagagacagagtcttgctatcttgcccaggctggtcttgaacctctgggctgaagtgatcctctcacttcagcctcccaaagtgttgggaccacaggcatgagtcagcactcctggcctccattatatcttttcatttgcaaaatggagatgtgtattgttatctattgctgcatcacagattacccctaagttcagtagcttaaaatggcaagcacttattatcttacagtttctgtgggtcaggaatcgggctgtggcgtagctgggtcccctgctgcaaggtcaaagtgtttacctggggccgtggtctcatctgaagacttgactggggacagactgaaatctgtgctcacacacacggttgttgataggattcatttccccaagagctgctggctggaggctgctctcagttctttgccatgtgggtctcaccacagagcagctcacaatggggcacttggcttccataagggagaggaggaggagaagggtgcagacgactaaaatgacggtttctttgcagcctcatctcagaagtggtgtcctatcacatttgtcctattccatttgcatgctgttggtaagaagtgagtccctatgtattgctcactcccaaggggaggggactacacaaggatgtgaatgccacggggtgggattggaggatctggcttagaggctgcccaccagggatcataaggactgagtgaggcgacagtttgttcaagtgtcaggaacagcttcattgcttagtgttggctgctgttcttgtctccacccccagtttcaaaattgctttgcctaaggggtttgtggggttcagcagagactccaggagtgtgtcgaacgtggaggaaggtcttgtcacatgatctgacgcccatccgctgtccttttccagttaggctttggagtgtctgctgggtgtggcatgtctagcgtaatttgagagggaaatgggtgtttggccgctgaaaacatccagtgtgtgtttctgtgggttaggcagctattcagagaaacacccaggagctcttcgggagcccacgggtcgagacagaaaagcttcctgaagttgtccctttttgtgtgtctcaatgccaccacttacgaagtcaaggaggaggcctgcctggcacatccttcagttaaaggatactctattgggttgagccgagtgccagacattgccacaaccctaggaaatgagttaggaaaaaaatggaaagcagagtcctcccactagaacaagctgagctttgtgcagaacaggctccaaatatgaaaagaccattgttcccggatggctttttaattcatgctcaccactcacacccatcagctcgccaagaagaggcgcctccttccttcctttcaccgcgtgcccttcgtccctccctcctctctccagtgccctggggacaggtcgagggaccctgggggatgggaggatgccgagcctggtgttgacagacagtggtgcctgctctgttcttctgcccgggatacttactcgggtgggccctccacctgttggagagcagctctctgcatttctaggttcggaagccagccctgtccccatggggctccgggaacaaagcccagtgtcagcccattccagtctttccttcaaaactctgtgcacaccttctcttgcctgcagccaaagcgacaagccagaagtgaactgttttctgtatgtttccgttttccccgggttgccctgctcttagagctgaatctggatggatgagcctgcagaagctttcagcttgccagtgtcctccactccaccagatagggcaggtgcagctgctgagcggagagagtgaagtatgtacttatggtgtgaagaaaattgactgattcaagagttgctgccaaagtgtgtgtggtctcgtgggctcaggtgagacccctgcccacgctggcatcgaaggctgtcccatgtctgacttgtatcgtgcccaataggatggggtcctgacagctctcaggatagatgggtcacccctgagccaatcctgcccagatctggactgagcctgcgaagttttctggttagctgttgctgtgagcatgcctccaaagtttatgccctgtggacatttttcttctgcttatagtgattcccaagcctgtggatttgtcctgtgtttgtttgtgccttaagattttccaggtatccaggcatgttggctcatgcctgtaatcccagcactttgggaggctgaggtgggaggatcacttgaggtcaggagttcgagaccagcctggccaacatgcgaaaccctgtatctactaaaaatacaaaaattagccgggtgtggcggcatgtgcctataatcccagctactcaggaggctgaggcaggagaattgcttgaacctgggaacctgagaggcggaggttgcagtgagggaagatggtgccactgcactccagcctaggcgacagagcgggactttgtctcaaaacaaaaaaacaaaagattgtgtaggcaccacctcagttgattattctgtgtaatctcatgtctgtagcgtacatgtgactagggcagaaataattcagaataatctcagattaggtcaaaatggaagtctcctgtttaagaatgaggagatgtttatgtggctactacagagttaaccacatgtcattgcaaagacagtgagttttcaagttaaagggttatgaggattttaaattaagaaaccccaggggtctagtttaatggtggacaagccccagagagacgatctgatggaccagataagttgtacacaattctgtgaaaatctgttaactccaggcccgggcagcttaacttcttgacatgtcacccaaatataattgttaatgccgtgggaaagagtcttgagcagcggtaagttctgtaaagtctgtgagtgagaactacaagcatgaattattacagtggggccagatcagagttatgttttaggttctcatgattagaggaagccagggttttacattactgcagtatgtggcccctaagcacccgaaatgtggctggttcgccctgagccatactgtgagtgtggaacgcataccagttttcccaggcttagtaggaaaacaaggggaaactgtcttaataaaacctagatcgattacgtttgaaataatgtgtagacagattcggttaaataagacatattacaatgaatttcacctgtttcttttttccccttattagtattattattttttgagacagagtctcagtctgttgcccaggctggagtgtggtggcatgatcttggctcactacaaactctgcctcctggattcaagcaattcttgtgcctcagcctcctgagcagctgggattacaggcatgcaccaccacacctggttaatttttgtatttttagtagagatggggtttcaccatgttggccaggctggtctcaaactcccgacctcaggtaatctgcctgccttggcctcccaaagtgctgagattataggtgtgagccaccgcacctagccttgaattatttttttgtttttatgttttcatttttgttgtttggacagggtcttgctttaaatcacgggagtacagtggtgcaatcatggctcactgcagcctccacctcccaggctcaagcaattctcctatcccagcctcctgagtagctgggaccagaggtgcacaccatcacacccagctaatttttttctttttttgtagagataggctttccctgtgttgcccaggctggtcttggaactcctgggctcaagcgatcttgccgcctcggcctcccaaagtgtcaggattgcagctgtgagccactgcaccaggcccctccccttttttaacatggatactgggaaatttaaagttcatagataggtggttccccttttagatgaaggatttacatgaaagatggttaaagaaggaagagccatagatgtgtgggttatgattctggccagtgaactttgtggaaagtcaaacctggctccagtggggagtgctgtgaataagtctggggggagatgatctgtatttgcttttcagattaccccaccttagacagaactttgtcagattgtgtcccactggctgtgatctgactggaaagtgaggagacagatgtgtagcgagaagactgagtcgctgcctccttggtgaggcagaggcaatggggcttcaccctggggaacccttgagggcaagggtggttactcaagacttggaacagccctcttgagtaaagaactctattgctcaactgtgggacctttaaaggaaggcagctgttgctcaaacagagacgtctggaccctcagaatccggttgttcaagtttcacagcccataggcaagacagcaccattgaattctccagtgggatggagaccgccatgatatgcaagacagatcttaccccgccagtgacagatgggagcgatagagcagattcccacagaacctgtttgtgaagctgcaggaacacttgtgcagtgtgcccttatagaaaagttagatttctgtttgtgatttcctttctcagggttggtttgggagggtctgtttttgagccgggcccaacggttctctttccggagcaccaggatcttgcgcttctgcccagaagctgggtagctttcttggccacactgaatgtccagccttactcttggcttttaccagtttaggggtcaagggttgaccataccagttgtcagtagtaatacctagagggctagcaaaacgaggctgaccttaagcttcttttaagtttgtcttttctttgtgatcctggatccggagtactggtcagaccagtccatatctggctgattattatcaacaaagtaaacttaactctgtggccagaaacagtccttagcatccagcagcttaggtttaccaggtgaaactgccagaactccgtggttggattgcactcagggcagggcctggtaatgcaaggagttgcacaggcggggttcccacgcccccagcccctccccgccttgtaggctcacaaccagttatggaatttatcttgttattaggtttgtctctttttgtagagagttgatggatagttgttagcattttggtgcttaaggatgtctggataactgcatgggttatagattctagccctttattgaggaccagcttcttggctgcttggtgctctggctctgggcacactggtttacagaagatgagaagacacagtctctgctgataagaaaatcatgcttagttggactgatcattgtccatgcaaataagtatctacactgaggggcttaggagaagcaaaagaacgaattaattaattaatttatttattttatgttggagtcttgctctgtcaccaggctggagtgcagtggcacgagctcagctcactccaatctcagcctcccaggttcaagtgattcttctgcctgagcctcctgagtagctgagattacaggtgcctgccaccatgcccggctcgtgtgtgtgtgtgtgtgtgtgtgtgtttagtagagacagggttttactgtgttggccaggctggtctggaactcctgacctcaggtgatccacccgccttggtgtcccaaagtgttgggattacagacgtgagccaccgcacctggcagtaaaagaacgtatgaatatgccttcataattaccaagataggacagtgcctcctgagcagaacatcgagaaattctggagcctaaggccctgggcagctggaaaataccgacgtttatttgtgttttcaattggcgctgttctcatatgtgctcatttgaccctcttaataatcttagaagtcatttggccaggcccagagctttcctttgttgatggtgaaacgctgaggccctgtgaagttgcatgattggcccaaggtcttgcagctagggagtggcaggacccagcgcggggtttgtgggcggattcccgtgttcttgctgcacaccatgccacatccatggcttaagcctctgcaggagcttggagagctctgaggactgacagcctttgtgtttcatattaggggaatttggggcctggtcttggggagagcaatatgaccgctgtagttgtagttgtgatcggagggacaaagaaggtgtccatcagagaggtttgtgccagcggtttaatttcctttatttcaggactggaagttatttaaattactttatagacttcctgtttccttccaagagctcattaagtccgtgctgaactgcttgctgggttgccataatggagtgcctggatctgcagttcccgttccgtcctccagggcacccagattggagaggcacgggtgaagagtggaggggaaagtttgaacagcttgtttgtggtgacccctttaattgacatgccattaggactcgacatttattattttcctcaaggataaagcgtgccctggactctggactctgtagaatattttctgaaatgtgttaatttcaccatcccattttggagaaggggcaggcacctctcatctggctgtaggagtgggaaccctgtctacatttttggtgattggagtgcagcattggactaaatggggcgttaggagcagattacggggaaggctgaggattcccctggtgatcaggaaaacacattggtgtaattggattaccttaacccttcatttaacttgatgggaatgctttcaaacaggggttccggaatattgctacagcttttcaaccctgtccacaggcagctcttgaagagatgtgcatttgactagatgatttaccttgaaacctgccaagagaataattttaggaaacacccccgccccttgtgcctctttaattgttccgtcaggaggaaccttggtgctgagcactggttctgttgagaagtgctaattagaaataatagctacaacaaacaagtgttaggaggcagcctaagtgatgtcaacatcaagaagctgtcattggctccctgcagatgtgcgggccagctgtgaggcaggggagcctgctgctccctgccatccacctggggaaaggtagaggaggtaggagtcggataggctgccatagccaggcccccttggctcgatgacttttgttccttggtttgaggttctgttaatgcactctaagtcccattggtactcaatatggactcaatttcagctggtccagaaagtcttgggggaatcccagaaatggcacctgggggcttggggaggggaagtcattccatcccaggaggcagacaagaatccttctgaaggtggaagtaatacagcgacttaaatataacctgagccagacttgcatgtctaagtgaatgctgagtcttaaatattcatttacaatgttaaagtctataatttcttcataaagaattctaaaataataaagatgacctggtaggcaaaattcacttgtattttctaaaagcttttgataaggtcccttataaaagattaagagagaacaaaaccacagtgtggcacaaagtccttgttgtggattaaaaaatgattaagtgatagggaacagaagaattctggtggagacccactgcttgtagcggggagaggttaatagaggggtgtctgagaaatctgtcgtcggggctggagttattaagtatattaattgtttggagaaggaaatggagggtgaattagtgcactcggctgctgctaccctggtttttataactggattcaacccagagagtctctacagccccgaatgcattgggggatcgggcagcacagtggcagaggaaatgaagtttgaagacgtctagggtgtaattcaggttggcagaaagtctggtccacgtgggaaagctaccatgccccctgaacttgccgcctctcctgaggacagaggttcaggagttatcgtgagcaaacagcagttcagtgaagtgactttttaagtacaaaacagataaaggaaattggagtggggagtggtgggcttgaaaaataaagggttttcttaggaaggatgaaacaggcgctgctgtgctgttgggcatcgcttgttgtcctgttagagtgaggagggatgattcttttcgtctgacaatgttcttttttgtgcagttttaggtatttttagagtcatgaggagggcagctgctctatttggaagtgctcacatctttatttctcaatggggattttgcacgttattctgaaacatgttaatacatgtaggcagctaacggtaggggggcctgtggacaggtctggtggaatcaccaaatcatagcagatgatactacggatctcttagcatagaccacatggcctggcatctagaatcttgtgatgcgaacagtgggccatacagggtgcttgggtgaggagtgattttggttgagtgggtgataggagcaggcagccaggctggccagccaggccgggggacctgtcttcatgtgtcctgcctttttgcagttcttgttttttttgtttgtttgtttgagatggagactagctctgtcacccaggctggggtgcagtggtgcgatctcggctcaccacagcctccacctcccaggttcaagcgattctcctgcctcagcctgggagtagctgggattacaggcgcctagcgccatgcccggctaatttttctatttttagtagagatggggtctcaccatgttggccaggctggtctcaaactcctgacctcaggtgatccacccgtctcagcctcccagagtgctaggattataggcaggggccatcgcgcctggcctttctgcagtttttgatgcccctcgaaggctctttggtgccttccttccgcggctggaatgagtttcgtgtgcacggccatccaccttgagaggttgtacctttctgaatgggctgttccaagcaagccatacatttctttcttggtcagtctcctttatttgctaatttccttttgctgtctgtctctttacatgggtgccactttaattaagacctagagaagtgctggcctccatgagaaatgtggctgagtcccctcttttggctgtgagtaaatgcctttgtgtgggttgggatccctaggaggcacccccctagggaatttttgcaatcttggccgagcatagttagaagctgcaattactacttggttgctaattacccagcctcacattagatccgtttacagggagagcttggagcctgtcagcaaaggtcagccggaggtcctctcactaaacagccctcttgtgatagctgttggaggggaaaggcattaatgggggaaggcagggaagctggctctgggctgtaggatcctcgctgtgggggatgggagaggcagaagtgctgttgatggctgcagaggtcagagaggctgataacccatctcataacctttctcaggaggcctggaggaaggcggagaaacgctttcattttggaggctctgctctagcaaggagggagatggatacttagaagaaactaggacctgtgggttggggacttttaatggttgactatgtgagaaagatcagttcggcgacagcctctgagagtggaagagacccctctgcccccaactcagggcatcatttctgttgtttctttgtactgcctatactgtattatttgctttacatttttcttttcacgggatcctccgttataaccacaaatacccaccttagcatcatcccgagcaattgtgtctgaggaatcacaggctcgtgctggttggattggctcagataaacattgactggctaatgaccagaatgtacaaagttcacccactcccacctggaaccatctagcccctggccagtgttgcgtgggtgaaacaccctgaaaaaagatgatggaaaagacactggcctggaagtctgagtacttgtgtgtgaccatggacaagtctctctgcttctctgagcctcaaaagtgagaatacggcctttgttggattgctatgcaaatgacatgagaacatgttctttgtctgtataaatgttaataaatattaatataagcattaatagctaacccctattaagcatctactgtgctaaatacttcactgtctcattaatccttacaaccctatggggtaaagatgatcctacacccatcatatgagtgatgaacttgaggcccaaagtctgtagcaaatttgctgctgttaaatggcctctgcgctgggatgccagctcagagcatatactcctagccacgacagcagtccctctttatccttggggagacattccaagacacttagtggaatgtctgagagggaggatagtatcaaaccctaggtagactatgtttttttctctacctacatgcctatgataaaatttaatttataaattaggcacagtaagagattaacagtgataactaataataaaatagaacaattaaaacaatatcctgtaatgacagttatgggaatatggtctctcctctctctcagaatatcttactgtactgtaatgtgggtaactgaggtcatggaagatgaagcctcggataagcagggactgctatactatattatcctaatgctatacagtacatactatgctgtgtataggacttctttgtcattaacccatttctctctctttttttttttttaattttattttttgagacagggtctcactctgtcacccaggctggagtgcagtgacgcgatcttggttcactgcaacctccgcctcccgagtttaagcgattcttgtacctcagcctctcgagtagctgggattacaggcatgtgccgccacacccggctaatttttgtattttagtagtggcagggtttcgccatgttgctcaggctggtctcgaagtcctggcctcgagtgatccacctgcctcggactctcagagtactgggattacaggcatgagccactgcgcccagccattattgacccatttcaaggtgttagtttagtgcttctctgatatctgcctgttgggtacattattagacaaaaatcgtttaaagtgaggagaactggaaagaagagggtgctcagctcctccagggtggatcccttttaagatcgctcagcagctacagcaaggtcttcagcactcagttcctgtctgtttgtcccatccgtggctgggacaggcctggacttccccatagctctctcccgcccgcttcaaatcagggcaagatcagtatgtggtgatgggggccttggaggcaggggcacgatgtgtgagactgataacgttcttgcagcctgagacatgggctttagagcagtttcgaaactctgtgttctctctcttcacaagtacaatgcgtttccctggcatttacaggccaggacctgggagaacgccgtgtcgtcttaaacctcagaaattgccaagtgacagtgccaagggacgggtttactggtttcccctccatcggactgagtgcagctgcccttccccaccctcctgcagttagggaggcgtgtccctcttttgactggctgagtcagaaatcagccaggacttagcgctttttgatttgaacagaaacggtggggggaaaaaaacccaaaccttgtggtattttataattcgggaaagttggtctagagagggccagcgaattggctgtgggaccctgttagggaaaggtctgggcctcctgactcctgctttctcttttcctgagccagaggagccccaggcctgtgcatgaaacatacttgacaaaactaaatttttactgaatttccaccccttgggtgctgactaacaccacttccccacatataactctgcgtccgcataattaacatataatttgatacctggaaattcatgcagggtggagctggaatggattactcagcttttggcaattcttcctgggctgtagaactctgtgtgctgcatcttgcttctcctgttactgctaactcatttggcccatattcttcccacttatttcttccttctgccctggaaagatgagtgaaataagtatgtggtatgtttttgtcattgaagcaactgaaggattgttgacttatccatgtgcactgtccacttacctagtatgcgtgttcttagcctgcttctcgcattggctggtggagtttgatagtgccatggtttcttttttttttttttgagacagagtgtctgtcgcccaggctggagtgcagtgacacaatcttggcccactgcaacttccacctcctgggttcaagcaattctcctgcctcagcctcctgagtatcttggattactgtcatgcagcaccacgcctggctaatatttgtatttttagtagagacagggtttcaccttggcctggctggtctcaaactcctgacctcaggtgatccacccgcttcggcctcccaaggtgctggtattatagtcatgaacagccgcacctggctctgttttaatttttttttttttttaatttgagacagcgtcttgctgtcttgcccaggccagagtgcagtgatgtgatcttggctcaccgcagcctcaaacttctgggctaagtgatcctcttgccttggcctctcttagctgagaccacaggtgtgcaccaccacttcctactaatatttgtattttttgtagagatggggtctccctatgttgtccaggctggtctcaaactcaggggctcctgtgatcctcccactttggcctcccaaagtgctggaattgtaagtgtgatctctgtgcctagccagtaccgtagtttatttcattgcctgattcctcatcaagatgatgccatcagtattaaaaaatgcagtcagtaattatcagtgaagaataaagatgaaaaattatgatgattttgcaatttaaatttatagcatatgctgatggttataagttttgttggagaaattatttattgtgttgacacatgtattaatgtgggggaatcatggctcttaatgtacatgatacctgcctttatagattgaaagactgggtgaaccctgacctgttgcagggacccagttagtgcaattgaattccaatcaggatcacttggaaatgaatccagaaatccgcgttatttgaaaagaagtgatttagagcagtgcagagggaagattgtatatggtgtgagctcagaggaaggctggagtgaatcccttaatcagaaatgtttggcgggttccagcctgcatatcgacccctcgatggccacagcttcctgatccagtggctggagaaggatcttgggtccgtgtaccagctaagcatgcacccttcagtcagctgcaggaaaggtgggagcgggaagagtagctccgggactggctggctgttccctgccctagactgtgcttatgagcctttcaggttttgagaacttgactttggaaagcttctaaatttgttcctagtgggttgatgtattttgtggaggtcaaattagagctaatggccttaatggtttacagtgctcctaaatggttcttagcacttatgcaggctcgactggccctgttgggcgggtttccaagtgtggaccatattgttcttagggtatgttttttgctgaagttattgttgggaggacagatatgtgcaagtgaggttaaaaggtaacagcagaattagccacatataatattaaactttcttttggtatcaaatccagggaggtgtttgttaacatgggccccgtgagcatatgtgaatgaatagggcgtccagcttggagttcagtaggtggcgtttgtctgtcctttgccactttgcctaggagcaggtgattcatgaaaggcagtcctagggaagcctcagattccctccggccattcctggttgccaaatagttcctctaagagcaggtagccaggttaaaggaatccctggtgcatcccttccagccatgctgtggtatccatgagttcatggcaaggtctttggcaaacgaatgatactctacataaaactggctccagtgttctgatttctgtgtgtttgggagtaggtggggcagaaccagatgtctataaaggagctgcatgtctgtactggtccacaccattgaagcatacatgtgtacacaggcacagtgtgggggcaatgacctcccagagctgctggttgcagctgaatgggaagaaaatagggcaggtagaggtccctctacctaaactgaggtggcagtggcaacggagaccaggagcactggtgaatgatttctccatgctttgatcggggagggtgggaggtggaagcagcctccacatcatcttactttggcctgtcagctctcaaagtggtgtcccttcaattgcaaatgttgttttgaaggcctagtgctgtagaagtctattacaggtaaaatattcttagctgctatgagagttgagtgagggatgggtgcttgccttctagctgctgatggaatgactactgagttctccttaaaacttgagttctttgttttgtgttgagacaggatctcactttgttgcccaggctggcgtgtagtggctggatcacagctcccacaactcactgcagcctcagcctcctggactctggtgattctcccacctcagtctcccgagtaactggggctacaggtgctcgccaccacaccttgctaatttttgtgtttttcgtagaggtggggttttgttttcgtcgtgttacccaggctgatctcaaactcctgggctcaagcggtctgtctgactcggcctccaaaagttctggaattacaggtatgagccactgcacctggctgggttctatgttttttccatttcacactctgaaaacacaccttcggtatatttgcagagccctgaagtcctggggctgccatccttaatcgcaggacccagtggctttcccctaagaggtccgaagaacatgattatactacctgcgagatgcctacttatattgaaaaatatgtctgcattgcagttcctcttgaacatgaggtgacagcattggagacggtgccgataattcaataacttgcgtctcgaggaaaacggtggtgtctgtgaccaagaaggagttaatttccactgctaataaaaactaaatgggtgccttgggcatgatagaacttgggacccaagcccagttcagcagcccaagtcacagttgagtagtgttggcggaaatgcattctacaatcagcatttgaccatgttcagttagcttcatggccaccaagttctccagagaagttttaattacaaaccaaggtggtgtggtttcttaaatgtgttagaacaaatggatgtcagcccaaggagccctgagcagcccccctccatcgataaaaccccataattatcacatggcgggtcctaaggaggaaatctgaaggccctgagtggctgtcggctgtgcttccgtcctccccttcctgaagttgggggcagggtgagggtggagaaggacagtctgttctttagagaatctgagagtgaagctccacccaggacgggccatggagtgcctgtccctgggaagaacatgttaaccgcccaggggtgaggcctgctttttgggagtgggagattgtggggagttggcggggtggggggtggttaaaaatggaagaccttgaaatggcaaatctttattagttttgtaaacagctttaggaagcgctgggagcatcttgcagggaccctgcaattatcataataaacagttttatcatctgcttggcaatcaatattgtggcttacactgctttagtatctcagtggtattgattaccttaacaactgtgctgcggtcagcttccattaacccctgctctgccggcagagcctgtgccttccctggttgggcggaagactgctctggtcacagcccaagcaagtgccagaatgtgacagctgctagtgagttcaacacagcttgtatctgagagcgtccaggagaagggagggttttaaccagggaatctggaagccagtacaactttttaaaggcgtctttttgtgtgtgtggagacagtgtattaaaacaattatagcagtgggatttcaactatgactcaggaatttgaatctcaagagcgaaaattccatttcttccctgccttgagtctgtccagtccaatgttgttctcagctctgcctcgccctccctggggaaaaattgacgtgtgtagaatttaattgaggacacccttatgcaactggctttcctgggactcccctcacatttgttttgtgatccacatttgacttttacagagaaaccacttatttggggacatctagttctaggattcaggttcccctggatgtctggagttacatagttgatcataagatgacagaatgctggagagagatgtcggtggcgcctgagatgatatcagcctcactggatagcccatctctggtgtggttcatgtttacgttccccttttctcctgatgagaaggtgacaaggacagtttaggagagcagctggagtccagtctccagacaaagccagtaggcagaccccatcatttcgagattacgtagtattaagtgacgtttctcagaaacttgggacaagatcttgcctgtgggggcgtgttggtgttcgtagtggtggtggtaggggtacgtgtgtgttggctttgtttttttcctcttttaattgctctattttgttttaaatatgagagatgtatgtgtatatgtgtataggtatatatgcatatttatataaatatatccatatgtatactatatacatgtacatgtatacatacatatgtaaacatgtaatgcatataaattttatatgtataaattctgttgaggcctggggtgagcttgcacacgatagtgaggtttagccccttcgccccagccttattgaagaccatcacggggtcctcaacattgcagacccagcaacacaggtgctgttcaacctaagggacattgacctataacattgacctctaagccatctaccacatctcctcagtgaattttttttttttttttttgagtcagagtcttgctctttggcccaggcaggagtggagtggtgtgatcgtggctccttgcagcctcaacctcttgagctcaagtgatcttcacacctcagcctcccaagtagctggattcacaggcgtgcaccaccatgtctggctaatttttaaggatttatagagacgaggtcgcactgtgttgcccaggctggtctcaaacttctgggctcaagtgatcctcccacctcagcctcccagagtactgggattataggcatgagccactgcacctggcctcaccagtgaatttttcaagtttgtgaacacaagtttcatggagtcactggggaatggaggaggaagaggcagtagatagactaggaggaaggttgaatcagggcagctgccaccttcctgactgtcttgccaggctgcagcctgtggcttgcttattcctctttgctgcctgagaggagccaggagtgaaactatcagatggggaggaagccagcagacaggttattcagataagggctgaggcctgtgcttgaaggagcgtgagcaggtataggcaagaaggctgcaggtgtatgagattcccacccatgggatttaagccccagctggtcaagggttcatgcaaaacagggtcaggaagccaggccatagagagccaacagcaagatggaaggttctggactataactggtggggccggggggtaatggcaagatatgactttagtatcagaccacaggcttactgagcagggccttaccctgtacccacacttggcagtgggtagttagacctgtgctggtgagggaagggctccaaggacagatggtaggaatggtgtttgacatgtggttggagagttgcatggagcaatggcttaagcagcctttctctctctctctctttttttttttctgagacaagatcttgatctgtcacccaggctggagtgcaggggcacgttcatagctcactgcagcctcgaactcctgggctcaagcgatccttctatctcatcctcctgagtagctgggactacaggtgggtgccaccactcccagctaattttttaatttttgtagagatgggggtcttactatgttgctgtggctggcctcgaactgccaggctcaagtgatcctcccgcctcggcctcccaaaatgctaggattacagacatgagccatcgcacctggcctaggccttctctgtcgacccctttggggttgccctcattccagctgggatgttcggggatcctggtcattgttttgtgttctggatctactcactctgcccccacccttcctctgcccagattacctcattccatgaattggaaaggtttgttttccgcattaatgctcttcctaaaaatgtcactcagcttagtcagttggactaagaaggtggtcagtggttattaagttgcctcataagtctcattgttttctatcacggtaggaacaggggcttccaagggctccaccgtgatggcagaaagtggactaaagaaactgctcacacccatagaataagcgacattcctgacggggaagaagccggtttccttcttttctgttttacatagatatgtgcactttgcttgggtcatgctacagtaatcctggggcccaaatcaccctttacgttacccccactggtcctaacctgaactctgcgttgacatgagctcctctgagttcagcctccttcatgaggagctcctggacgttgacagcttattacatctttttacaaatagccttttgagccgagtggtcagtctgctttggatgacagtgttgtctttgcagtctagggtctaagaggaggagttgcacccaggctactcctcagatcttaaacttttttatgggccaaagatccttgcttcagcacttggtgctttagtggatttgtttctcgggccctccaccattctggcctatgtaaaaatttacgacttaatgtcttgccatcactgttctggtctgtgtggagcaactcaatatttggtggtgtgtataactctactccactgaggtgtgatcaatgaaaatacctcctttgggtctttggcatcctatctttttctcgtatttagatgatacatgttttggaaggatttggaagcttaggcatgcagcaggtaggtttctgtctttattcttcttgtttctctgtgagttggtgattctctttaaggaaatgatgccttcatggagccaagagcaccacagtagaaactgtagcttgtgtcctggtccttgctctgcagctaaccagttgcaggaccttgagaaagaatgactcgtaggagtcactcagatgtttgaatgaattatttttttaaacctgtaaaatcgaaaatatgattcccattctatttaaaaagattgttagaggtcaaatgagagtgtttgaaaatgtgtagaaaggctgggcgctgtggctcactcctgtaatcacagcgctttgggaggccaaggcgggcagatcacctgaggtcaggagttcaagaccagcctggccaacatggtgaaaccctgtctctactaaaaatacagaaattagccgggcatggtggtaggtgcgtgtaatcccagctactcaggaggctgaagcaggagaatcgcttgaacccgggaggtggaggttgcagtgagccgagatggcgccactgcattccagcctggatgacagagcgagactccatctcaggaaaaaaaaaaaaaaaaaaggaaaatgtgtaaaacgctgtgtgcatggaagaagcattgttatgtgccctttggaaggctggtgctgggtgtgactgtgcccttggtcacatattggggtccccgtgaagaagtccattgcacagagtgcttctggggagcttgcagcatggtgatgcgtattgaagttggagggtgtgctggatgttgggggtgggtatgggcccacatatggccagaagcccacttaccactgggccgtttacctacagagccacactagagaaccagcccaattgggagcagttcagttgaggctttgcaaagcaattaaggtgcttataaaacattcatgctgagataaaagacagtgtgcgcaaaaacaatggctggtaaacatctgattttttaaactcactgaaagtgttaaaaatattttcttaacccgttgagtcaagaagtggaggcttttaattcaacggatgtatattcttcttaatcagactttggctcaaagcttgaaatcaagctgttatataaccttaggctgttaacttttgtaaacaggcgcatttttgctcagtaatgatcgtgatagctaccacttataaaggctgtcaggtgctatgcccaggcgtgatgcatattgtctttttctgtgttcttttaaacattagcagcctggtggtgcttggtaccttctaagagaaggagtaagagtgggggtcagtagatggtggtgtttgaaaggagctttagagatagctggggcccggcctgggaggaaagcccttcggaagaaaggagaaacccacatttctttgaaaaaaggcttggcttgccatgaacgtattgactcaagactgaatctcttggttctggtcaatgctgttcttttagaagatgttcctgatagcgaatggtaacttttaaggaaaaaaaaaattactgtataaaagtagaaagaatgatataatgaacccttccatagttctatcaccttgacttaacaatgaacttttggctagatttgttccgtcttttttgtccgttgctgaaatattttgaagccaacgatatcatgctgcttcatcattttcttatgtaaacataatattattccctaacaaaactgactttttttgagacaaggtctcactctgtggcccaagctagagtacagtggtgcgatcacagctcattgcagccttgacctccctggtctcaagcaatcaagtagctgggactacaggcgcacaccactgcacccagctgtttttttttttttttttttaacttttggtagtgatggggtttcaccttgttgcccgggctggtctcagactcctgggctcaagcaatctgcccgtctcagcctcccaaagtgctgatacttgaggtttgagccactgcccctggccaaaactgacattattaacatgatctaatcccaagttgcaattcagacttatctgattgtccccaaaatggctttttacatttggctggttagaactggcatccatacgaaactacatagcgcatctagctgttgtttggttcttaggtcccctttaatctagaacagttctcctccttccccaacgtccatgtgagcccctacccatccagccagcctgtggatttaaaaggatgatgcggagtagcttcatgtgggaggaaggcactgttagtgtggtgtgaagatacccaggtcttcgtcctagctctgccactgaccggctctctgacgtcagcaaaccaccaacaccctgtggggtcagtattcttgtctatcagtggaaacagtgagactagctggcctcacactcaagccttctcattattacctccacaaagagatccgggaaatagggctgcacgccctacttgcacctagtcttatcccattctcagcagttgagaaattactggagctaaataatcctgaccaattgatttttttttctcttggacattgtaaatagtgtacctttaaaggcatacctagcatgcctttatcctcttgacttttagaaagcttagagccaaatttgactcagtgtgtaggttattcttacatgcattttaagcttgatttttttggttcaaaatttcctccagttttgttttttctttcttcttttgcccgggcctcaatttatgctatgatgttgtattgtatattgtaaacaggatcaataaataactgtgtgctaggtattcttatggggccatcacctagtctgtaagcgcattgatttcggggtccatgtcttatatattctttgctttgttgaggcacagattaggtactcaataaaagcttcctgagagattttggttggacacattgccatcactggtccatgtaaaatttccattttaacagtgaagagttgtggggagcagtgttaatttcggactgtgccctggttcttctgtgatccatctttcctatggcgaaatggcctgtggaggtctggagagccacctggctggtggtgtttttcatagaacttgtctttttgaggagctccttgctgttttttccataggccttaggtaagcaaagcaatatttggcaggcaaacagttggagggatcttaactgctaaaacagtaaccattctgcgtattccgaagagaagcccacctgtggttccagccttggacacaggagcgctgttgttgggtgctgaggatgatggaggtggattagtcacaatctatcatctgctacatctgtaaaagagtaaagtagcccatcacatgtgctccacgctctcttaggactcaggtgtgagctctcctgttgacactcagctttcctttgctgcttgtgagagtttggcctgaccctcaggaaggtgttggtaccaactggttctctcctttaccttcctagacctctgcctcttcatctatccaggagagagagggagaagaacatctgtcctagagggttaggtgaggaccagagtctgggcatggtaagcacctagcacagtgcctggcacatagtaggcactcaataaatggtaagtgccttcaggatcatctctatgactggctggaggacatctttacaactgttgtatagtggcctcctcttttcttgtttgttgacatttggaaggggatcccaaggggctgtggagattggttgtaaggatgtttattctgcatccctggaagactttgctgtaatccatagagaagcaccgaggtgccttgttggttcagagtccaacgatgtctcccacccccggccgatgctctcctaggccagcagcgtggcgctggtcttttatttttctgggaggagagcacttccaatcctctgggcagtgtggacttagcccagaggaaggcgagacctcggtcagggagtgggggaaggggtcctgggtgtggctgggaagttgaggcttatggcctgcaagttttcttctaatggaatttcccatcacttactgccctgctgatttctgatcaatgaaaatgaaattgcatcacctcctcagaggctccacgtatgcctgctgcttccagctgtgtcagttccggtaaaataatctcatcaggcgtgtgagagggtaataggaaataaaaataaaaacccacaattaacaagaggccttgtagctgagtaacactttccatcccagagcagaaagggctgggtcgtgaatgctcgggaaagagttccttagaaagaaaaaaaatcccaggctgggtgcggtggctcacgcctgtaatcccagcactctgggaggatgaggcgggcaggtcacctgaggtcaggagtttgagaccatcctggccaacatggtgaaaccccgtttctactaaaaatacaaaaattagctgggcatggtggtgtgcgcctgtggtcccagctactcaggaggctgaggcaggagagttgcttgaacctgggaggcggaggttgcagtgagccgagatcgtgccactgcactccagcctgggcaacaagagtgagactctgtctcaaaaaaaaaagaaaaaagaaaaaaaatccctggtccttttcttcttcccctttttcttctcacttcccctgaattccatctctcccctccaccctggggtgcatggtttgaaattgtgcacagattttcattgccccgcttttggggtcagtagaatttctgtgtgatatgctcatgctggtgtggcttttgctttttttttctctgagtcccctgcaggtagacaccaagtgaatcgtagagatcccagcctctcctcaagagctgtgtggagagtgattttttttccccccactgacccacgacagggaactaatagttggggaacaactcaaagtcgagtgcaggttgtacatagacttctaagaggtggttcatgttagttcctagactttatgcttcaattctaactcctttaagaataagactcccctctctgcagcattccccataatgcagcatgtgtcgtgagcatgcgaccctataaatggacactggtcacgtgaaagctgggctgagccacctccttgtgcagtgcagtgagtgtgtcaacccgccaaccctcagcacctcttcataagacctggggaggccagacgctgcgtctggaacctgctgcactgtgtgtggagtttataaagtcgctggtcccagcttaaagaggaaccaaggccaaagaaaccaggatgggaatgcaaagggcaggtgaggaagtgggaaaccagttgggttacctaagaggagccagtagaaatgaaatcatatcctttcttgtcaactcgacatcaaaggagaagaaatgcttatgtgtaggccggttcagtggttctgcaatttctcatcaccatttgtgggatggcatgcccttcatcccagagaaaaacatgttgggctgtcaggaaatggtcaacctaaaatatccctaaaatgcctttgatgggtgactcccatgtggactgaaggcgagacccccgtgggggttagaactcccggggcactggcggagttgaaccgaggtctcagggcctccgggttccccagcactgcagggtctcagggcggcggtgccacttgtccagccatgagatgccatggtcagtgtttttaaacacagtggacctcagtcagttcactgtgaccacaccttgttaatagaaggacagattctggcatcagagcaggtagactctggaatgaggcgagcagtaacccagataattgtgttgacatagtgaatcccagtggccacgtggagtgctgagtccatttctaccggggtcctgatcactgccttccagttccttcctttgcctgcctggacgctactgagagcaagctcgtaggagtctgtatcgacaggagggacgcgctgtgtatgttgtaggcactcaataaatattgtggcacgaatgaataaaaatcattagaacaaccagtgagtagttggataagtattatgcagaggagcttaaaactatgaccactggggctggaaccccagtagcctctgtgttattgaagtcaaagaaattggccccattcaccatccagatttgattccccgaatcttaccatggcttaacatgggaatcttttggaactgcaggaacagttgccaaaatttgttctggcgctgtccaagattagaactgctggctggaagttttggtggaatgagcagagctctaggcatgaaaggagagagggtgcagcttcagaaagaaagctgaagttctttatgttaacatgcatttttcatatgtttgtgtgtttgcacaaatacgcttcccctctttcatcctagacacttagcacagggtcttgatctacattgatcacattttatgacttgagctggcaatttctcccctgggaccagacctaaccagggtgttcaggaagccattaaggaaaaatatgtaaccacactcattcccaaactcaattgttctgtcttagcagtgctcagataagagattttcaagcataattaatccaagtactatttaacgtggccttggtggttcttcttagcagctgttgacccaaacgcagcattgggagcagcaagaggagaaagaccgtctgtgccatttttgctgagttggtgagggtgtaattattgcccacagtcacttggttctctgggtggcttctggaaggttaaggaagtgtgagctcttggatccttacacttcaagaagaaattttcctttgttattttagctaactatcagggccgctctttgaagtggccagtggtaagtatgtctcaatatggatttcttgattaaaagtaacagtgcaaataatgggctttgtaattaccatgtgggatggagaaggggccatgaagaaggggacatgtgatcacgtttcatgatcccctctcttccccctgtacacccctctctcctgattgtattgtattttattttgtttgagacagagtctcactctgtcttccagactggagtgcagtggcacgatcagctcactgcaacttctgcctcccgggttcaagtgattctgctgcctcagcctcctgagttagctgggatcacaggcgcctgccaccatgcccggctaagttttgtatttttagtatagagggtgtttcactatgttggccaggcttgtcttgaactcctgacctccagtgatccgcccacctcggcctcccaaagtgctgggattacaggtatgagccaccacacctggccctgatagggttttaagctttggaatttggaagtctttcaaacaaactcagagtgccagcagaatccatgcccccttcagtctgtctcaaagcccttgcgtcctggtggtagttcttgctgccggttcactttaccctaagaaagagaatcgagataggagcaactctctgggcctctaggatttgaggactactcatgatgaaataaacctctcaagccttcagtctagtgcagtgagttatctaggagggaattcagtgatggggtctctgtgcatagcatgcctccaccagataggaagttgggtggaagcttagtacgcacatcccaaaggggtctctcgagggtgcccagtcaaggcatggggaagaccccgtgtacgattttgcttttgcagtaggcatccccttttcatgcctttaccaatgtctctaccttacagtggccattactgctttgttgagtgtccctttggcttcccactgcttgaaaagctctttatgccagcaggccagggatatctgaagaactcgctgtgcccgtgttggtgagaggctgtgtgtgtgtgtgtgtgtgtgtgtgtgtgttgccctatcagtgagcctccaaagggcaatccttgtttgttttgtcatggtgccagttccggagcctcgtgccagagcaagctgccgatggtgagcccaccgagtggttttcttcctgccgagaggaaaacacactccttgtttcagagtcattttggagataactgctgtgggaaactttccttcgcccaaggccagctctcacctcacccttacaggttttccccattgtcctgtgtgtgccatttggcggaatcattgcgaggacgtacctctgtccagcaacgttgaatggtgtttcccaggtgctctaattagctgccacaggcccagagaaaagcagctgtaccatgttcttcatttgttctcaggtagattcgatgtgaataaaagaaaacttaaggctcctggctgcttctgcctgcattccccaaactgccaagtgcaaagaatctgaccaagttcatttctcttgggtttgtgcagccttgaatgatagcacttacttctgttccaattagtgttctgctgactaagagctacctaataggaacttaggaaccatagtagactcatctttctattaaactagtgaacccggctttgatagcccttcccaggaagcgggaacccaggggttcacttgcatgtagttcatacctgattttttctccttccgagtagagtttttttttggagacaaagtcttactctgtcgcccaggctggagtgcagtgatttcgatctctgcttactgcaacctccacctcccaggttccagcaattctcatgcctcagctccccaagtaactgggattacaggcgcccaccactacgcctggctaatttttgtatttttagtgggtttctccatgttggccaggctagtcttgaactcctgacttcagatgatccacccgccttggcctcccaaagtgctgggattacaagtgtgagccaccatgcctggccaataggcgaggattttattggccaagtacaacttgagcttgtgcttctttaaggatatcccaggtttggatgagtgttgaggaagagaaaggctattcaaagggcctggggttgtgggaacagagttgataatgcatcagaatgcagagatgatggggaggaatcctagttggagggaaacgacacaggtgattgaatggtagtgttagtggtagatcttggggtgatttgaaaccgctctggagagtttcagtttgaatgtgttttggtagttgtttcttggatggggaaggatggggatgaacatgatattgggaaagccagactgatctttcctttctgttttctgcaaagatggcaccaaaagttccttccagagagaccagggccgacagtgagggggcagtgtcctttggacatgttgagccatgctgagtcttggttggtgggacactaggcatgtacagacatcttctggtcttctgaaagtatgagacacatattcaagtgccaagtcaggaatggacatttttgctttgggagtcagctcgtaatttcagtaattgaaaccgcagaagtagttaaggtagctgatgtacagagttaagagcagagagccaagggggaagagtacaatgacgcttaaatacctacaggagaacagggaggagagatgtctgtgagttgaaatgataaaagaattttatcgaataagtggaaaatgtacccatggagagctgtaggaatggggagaggacaggcaatgtagagatgacagaggtgggaggagggccagaatatgtcagaagtgaagtgggggaagatttcaaggagtagagggggaagcagttttgaatgcaggggagattgaagcttaaagtagaggaggaggaaccattgaccaagaccaggaggacaccgatgactttggacagaggacagaaatcttggcgacatagtgccttcccaccctcccggagcagatacccagcccttcagagagctagtcttgtgctctgggctggggcttgacatccatatgtatttttattgtgccgcatagttggttccactgcacaagaaagcttgaaaatgattgatgcagtttggccctttataatcacataaaggagggggacttcacttgaatacaggaaaattgatgtggagcaaatgaagcagtggacagagtccactctttggatggagttgagatctgaaggacagagaacatcttctgaactggcagtgtaagtaggtcagactctctcctgtccaggagcttataggatggtggactggtaggaactcaagggggagggatcaccagtcaaattctgcaaaaccctttcattactcactcagaaaaggacaacacacacctgccatagaaataacaggcaaggccgggcatgaatgctcacacctgtaatcccagcactttaggtggccgaggtgggtggatcacctgaggtcaggagttcaagaccagcctggccaacatggtgaaaccctgactctactaaaactacaaaaaattagccggccgtgatggtgcacacctgcacctgtaatcccagttgcttgggaggctgaggcaggagaatcgcttgaatgcaggaggtggaggttgcagtgagctgagatcgccccattgtactccaacctgggcagcagggtgaaactccgtctcaaaaaaaaaaaaaaaaaaaaaaattaataggcagttcacaaaagaaatgtagactgccagtaaatatccatagatgggttctgtcttatgagtaaagaatgtgagttaaaatgagatgccatttcttgcctgtcaaacggacttttaaaaataacaaagtaaatacccactgttgatgagggtgcaggaaaactggtgctcacacaccagtgcaagcaggagtggaaaggactttcctgggggacagtttggcacgttccagagggccttaaatgttcctagcatttgagtcagcaactctacttccagaaatgcatcctaaggcaatacagacacaacgtcatgagtaagagcctagttttagagtggtaagggaggcttacctactttcaaaggccgactaaactagcatgcagcttgggcaaggtacttaactctctaagcctcagtttcctcacctgtaaagtgggctgccgcaaggatcaaacaaaacaacatgttcagaaaaatagtgctcaaaaccatgcttgattcaaccaggtggacagtaatggagctatacttggtttgttgtttttgttgttgttgttatatgtgtacaaagatttaagggcccttattgcaaaatgaacagcaaaatattgggaattgtttaaatgtctaataatagcatttggtggaaattatgcaatgtgtataagatatagtatctatatagccattagttttaacttatgaagaatattgaatggcataggaaaaatttcatactaaattaggttaaaagggcggcctacataaacagcagcgtgatccgaggtaggtaaggaaaatctgtatctgtaaacgtgcagaggaaaaaagcccgaaaaactacctaccagtggttctctagctggtggaattgtcagtgattttaactttagctgctgagtctttttgtacatatccaaatttttaaaataatgaactcccacaactttaatcataagacatgatttaacataaatttgacatcatgacatgccagattgaaactgtaatgggccagatggcacgtttttacattgtctcctagcttttgccctataatcccaatagcaagagtggagagagagtagaaataggatcttggagagggactttgaggaaattgggaggagatgaaaaagccttgagtgctggcaaaggaaacacataagtgttggttatggttagtgtcagaaggtgtccggtttagccgggaaagtgccagaagatgggtgaaggttggggttgtgagctgcgggcttgcaaggtaggagaggtgggttggtacagtcaggtaaagcaatggtatttggtgaaaggaggttctgctgcaaatccgggaggggatccgtgctctatggtaattaaatccaagtcaggagcaccagtcaagccagtcatgggcacacgatgcttgtctttcttgttctggaaatggtggaaaggcctccacgtgactcagggtagagacttacgtactcaagtgtgagatacagttactatagctgtttaaattgccccaaatccctttttagaacaaggcagagcataaataatagctggtttgtcttgctttttattattatattcatgggtttggttttgattcatggtggttgaactctgagtatgtttacatatatagtaaaaaaaaaaaaaatcttttttaattcctctaagtacacacagactgggttcctagacctgcctccgctgtcacgactctctcctgttcccctccacgactccactgtaaccagaatatcatggtggttgtggattccctgcagaatgggctgagctagcagttttcacttctaggctgatttatgttcatgctggaaatagcacagatgcacttattagcaaacatggaggcccacggcctgggcgattctctgggccttctgggcagtgggcgtccggcagcacaaggcgcctgttcaagcacctgtgtgttctccgacctggccacacttgcagagcaatcctgaaggctgctgggaaattgctaccaagcagatggaatcacctatgtatggcttaacacatattgacttctgtgcagcagcagtagacaaacactgttattgtaaaaaaacacagaagggaactgggtatggttcttcagtggattccaagctaaacagatgcaggtattatttctttgacccttgaaggaggtttcaccttctcttggaatctgggttgcctttgtttttctgtttttgtttttttaaggaggtggggttagtgaggggatagttgcttcagtgtagtgtgtttttctctctgatatgttttagcctggatttaacaatgctcacactctgggggctgctggagttctccttttctctgggggctgccctcgtccttttacttagaatcacttttcacaaagttagggaactttgcgaaagttccctagggaactagggaaatcagcccacagtcaggatcatgagtgtcacggggaaacggctcagtattgtattacgtgaagttctgcccaagttggaatggccatttatttgtcttctccaactggaaggctccacctagaagcctcttggctggaggaaggggagaccagttttcagtttttgtctctctacacctctctgtccagcctcacagccacttccttttttgaagctctgctgggagcaaatttcacataaagattaaagatacgcatgtcagggtgggttgactcttcgtttatagttttggggggttactatgtcgaatttttactctggacagtttctttttcttttaacaatttcaagtgtacagggaagttttaacagtagaacaaagaattctcgtgtcctccttctagactcctcctatggtaacatctcatatatttattcctgctgtatatatgtaggtacatatatatgtgtgtatatatgtgtatgtgtatgtatgtatatactgatacacatacacacacttacacactcacatattttttcctaacccatttgaaaatcgaggcattgtgccccttcacctctaaatataccagtgtgtattttaaaaaacaaagacattctcttttataaccacactgcagttatcagaattaggaaatgaggctgggcacagtggctcatgcctgtaatctcagcactttggcaggctgaggtgggcggatcactggaggtcaggagttcgaaactagcctggccagtgtggtgaaaccctgtctctattaaaaatatgaaaaaattagccaggcgtggtggtgggcatctgtagttccagctacttaggaggctgaggcagaagaattgcttgaacctgggcgacagaggttgtagtgagctgagactgtgccactgcactccagcctggacgacagagcgagactctgtctcaaaaaaaaaaaaaaaaaggaaattaacattcatatgccactattagcccatctacaaaaccttattcagattttgtcagttgtcccagttatgtcctttagaggaaaagaagatcccagattatgcataacgttcattagtcatgtctccttagtctcttttaatctgaaacagttcttcagtctgtctttccgttgcatggccctgacatttctaaaaagcataggacattctgcagactgtcctcagttggatttgcctgatgttccctcatgattagattccggttgtgcgtttttgacaggaacaccagggaagggatgttgtgttcctctcggtgtatcctaccaggaggcacatgacgtctgtttgccccactgctggtgatgggaactttgatcactcaatgaaggtggtgtttgccaggttctccacagtgaagttattgttgttgttttttttttttcctgctataattaagaagtatcctgtggggagagactttgagattgtaaatatcctgttagtattcaaacttttttttttttttttagatggagtctctctctgtcacccaggatagagtgcagtggcacgatctcggttcactgcaagttgtgtctcccgggttcacgccattctcctgcctcagcctcctgagtagctgggactacaggcgcccgccaccacgcccggctaattttttttttttttttttgtatttttagtagagacggggtttcaccgtgttagccaggatggtctcgattacctggcctcgtgatctgcccgcctcggcctcccaaagtgctgggattacaggcgtgagccaccgctcccggaagtattcaaactttcatccattagtttgggtacccattgattcttccctgagtggatgatgatgaagatgatgatggttatcaaatggtgattttctaactccatactctttttctacgtttattagttgagtttctaccctgtggaagaactttcctttctcccacacttttttttttcttaaagtagggacttggggattgttatgttacacattgggttgcaatcacttactgtcacttaattttcttgctcacgttgtccctgatgtggccactgggagcccctccaacccactcctaggtcattttgacacatcttccttattctttgagcacaagtagatgctccgagctcatcttgaacttttcctgctccagcccaagaattggccatgtctccaaggagccccagttccattttgtggagaatggttacaccagacacgtcttaaactaagagaaaaaaagaaaaggaatggattcagggatcctcttttttcctatttcccccattgttttattaagcacctattacatgtcagatgtggaggactcagagatgaatagcacagggaacctgatctcatgccactcatagccttgtggtggggacagacaagcccatagataacacccaggaatgagaagaatcttcacctttcataggctgcctgatacagccccctggccatagcacaatccccttctccattcttgaagccacagagtgcagtatttcacagcataaacattccatttgggaactgtgataatcttgagaaagattttcatttatagtgaccccacctctctttccttatagattcccctcattgcccctaattcaaccctggaactaggtggaacccatagaaccaaacccacttgcctgtggcaggcagggtttcatatagccgaggatagctgccttgccctgcaacgggacttctcttccctgcacccgtgaatggtgtgtgtgttcagccattccgatgaggctacagcttctttgttggtatctctcttaggagattccctggagtggttcctaacattattcacgcagacagagaaagtgatgggctgtggacctgctgagctccaacaggtacagagtagtactgttgccaaaggccccattatggtctttggccaccatgccaacttcgggcttcctctgagtttgtcatcaagtaaaactcctagatattttgttattgttgtttgcatgaactcttatgactccaagtctcttccatcctctattggtttagcagattgcctgaagttaaatgtagggcttcatgtttttccatctaaagttttgttctgttagtttgggcctgttgttccaactcatggagatttttttcctcagtcttgattccaccgttgagcattttaattgttccctcgagtctggtgtgctctgcaagtggacatgcctgcatggtcttgttcctcaagctgttgatttcagtcagccaaatagggacaagacagagccttgttggcgtgtcccgagacacacggacctctgtgttgacgcttaaaataatggcatcattagtcggctataaaattggccacagtttattatctgaaagccattttgccatcctggatataaagaaatgataaattttgtgctaccttattaagataaaaaagcagactttattgtatttctcagatcattaagtctaagtaagggtatttttcggtttattttatgtgggttttcttactggacctacagctaatcgctaattcctcaggatcatcccacccctaaaattcttttccagcaacttgaatctgtttgaaaactatgaagaacttacagtatatgctttacaacatattcttgaagtatttccatatccattaagtcactctgacattgtgactttctccaaaacgatgcacacacatcactctttccccttctcttgttttatattactttatattgctttttatttgagtgtatttgtgtgtggtctctcttctctacaagaatgtaagccgagaccttttagcatggattctgtagcatctgactgacacatagtacatgctcagtaaatgctgaacgaatgaatatgtttcctgatctgtaggttctggaacctgccttttgtccttctttaaaaatcaggatattggacctacatttcagttctttgcagcagcttctcctacctcctttatcctctcttgtctgcctaaagatatccaagcaaatcagtctgctttgaactgttcccctcacccccatcactctcaagcaagaaaagggcgtttgggtgagatgccagcgttcttttgcatgagcagtcctgggatcccatcaccttaggacagtccctgggtgcttaaagactgagtgtgaatgtgagatgtagggatgttctagtgttctcttttgaaaattagacattaaagaaaaacaggccaggtgcggtggctcacgcctgtaatcccagcactttgggaggccgaggcgggcagattgcctgagctcaggagtttgagaccagcctggccaacatggtgaaaccccatctatactaaaactacaaaaagttagccagacgtggtggtggtcgcctgtaggcccagctactcaggagggtgaggcaggagaatcgcttgagcccaagaggcagaggttgcagtgagctgagatcacaccactgcactccagcctgggtgacaaaggaaaactgcctgaaagcatagactccacacccatactctccggtttgtcagttaggctgcataactgggccacctcagttttcccatttctaaaatggggataaaaatagtatctatctcctagtgtgggtatgaggatcaaagtgatgctgtacccatgggtcttaacacaacacctaactcattaagtgatgacttccagtatgatggttttcaatttttttccttttttttttttttaaatagaccaagtctcattttgtcacccaggctggaatgcagtggcccgatcgtagctcactgcagccttgaactcctgggctctagcaatcctactgtctcaatgatggttttaattttaaagagctttgggaaataaaggcacataggaggaaatgaagtcacctatacctcattccctagaattcacagttgtaaaaattgtaatataagtctctcctgttttcctctccataatacctatatgtgctgtgttcatttagcatctgtatgatcattttcccatgcttataaatagtttctttgaagaaagcatctttataacaacatatggagctctgtgcactgtaatttatttagggtctgtttttgcccaaatttttcctcttttttcctgttatgtttttcatgaataaacttaaatctccatgcattgcttgggttctttccttatgatgaattcctagaacggggaattgttgagtcaacggggagggatgtgcacttctgaggcctttgatgtatgctgcctggtcgcctgtaggaaggcggtattcactgcttctccctccggcagagcaggggatcacccagggaatcaggcatccttgcctgctggctgatgtctcttgagtgatcccgcatgggatattcttggaggcaacagtttctcactgcctctattctctctttgtttttcctcccttcccctttgtttcccttcttggtttcctaccagacagcctcttgtgaaaggactgcctaattaaccctgtgctaattaacaatttaaaattacacagtgcgactgttcatgtttcattctccgggagctggagcaacagcaggagccccctccccttcgtcataactgcacccctcccaccccagcttccctgaaactgttgcattttacccagttctgcctcaagggaacaggataaaactgtcatcagcacatgtttttaaagagggagatgaacgttttgattaatagggagatacagggtaacagggtagagttttatccttttaaacaatctttgaaaagtaaagattgacatttgcaaagatgcagtgggctttacaggtggttccaagggagcttggaagatgagcaggagttgggggatacttgatgaaggtgctggaattcttctgtacaagattacctttcagatggcagatttaagtgctaagcagacagtgagccagctaggtcattcctatcttccctttaactttctcactggagagatgtgctctattaaaatctaactgaattcttgaagcccatatgttgagtgcaacattgggggttgtgagcagaatacctggacattttttagagggagttccgggtgccaccagcagagaagcgggctgcaggaagggaggaggggtgtgaacctgtaccagctagccctggcactagggaagtactgggaaggggcacagaacgtggagggagcctgaagagaggtgtgcgtgtcaggctggcagggctgcttggaaaagtgcggggacccactgggttcccaggctgccctctgtaactgaagatcattgattttacgggaaaccatgtttacagacagagtgctgatcgacctgccgagttgacttctgcctccttaagtaagaactacctttttcttattgactggctgataaacagagcgagagagagccggctgttgcgggggagtggtagatgccccgagacccttgagccgcaggatgtggcggattggagagacttctttacctctgtgcgcgcgtccccctcttctccatctccatccctgcacctcccagggaccacagggaatctaagactgaccttccctggttacctagcaatacaggtaccaaggacagaagagctgtgcttggtacctgtattggtgaagatggagtgaagcagagagtgtcttaagtttaatgcatggtccctgaggatggtgtgaaaatgcagattctgatggggcaggaggagacagtgcatgtctcttaagctccccggagaggataatgcttcaagtccacaaaccacgcttgtttggcaaggctgcaaacgggcctgtttgtcacagctggtgcgcatggaaaggaggcccaggggaggtagcttgggtcctgcagtgggttcctcctctccgacccgtgtcctcatggctgctgctccccgtgaatgggtgggctctagtgtcaccaccacagggtcaccagccaccatcataggtgggtacagtgtcattctttcctgacatcttccgctttggagtagaaaacaaagtaagggaggttttaaaagtcccagcctcttggctggatagtttgtggaagaggaggaggaataagaggagaacggagcaagagaagcccaccaattaattggtaaacgcttgcaggtttctctggcccagcccaggctggagaggagattggctttgctgtcgataaacaagtccctggtgcagcatcaaagctgttctgctttatcaatcgtggcccccccttcccgcatgttcctgtaacttaccaagcatttatgacattgattttacagtcgggctgttaaccctcccgccccttcaggcctgccaacctttttggcccaagctatcaatcagatgtcatccagccaatcagaagcatccctaagaagagccgccctgcagtctcacctgtatcccggctcagccttgcgaggaagtcccattgcgtttgctgtttggtttggtttggtttggtttggtttggtttggtttggtttggtttactgtagtcatctctgttttaagtcagtatgtcctttctaaggctcatggaactttgtggttgcaaaatctgaagttataaatggagagataggggtatgtgtttgcatgtgtgtattagacacatcatagctttattcttccaaaaagttatttctccctgagacttctggtaaacctgccttccccagtttttcccgagggggagctgttgtctcattgtgcagtcaataatcaagaaatgaaaaaaaaaaaagattgagaagataggggctgtcagggagggaagtgagatcaaacctggccgaaaccttcaccggctgagtgtgaatgagatggtgggtggaggagcagccacatgttctccaggaggagcagcaggggaatggtggctggggacctacgggcaaaggatcagggctctgcgaggtgctgagctgcctgtaggagcagggccagacggaatgatcgcccctgcgatgatattactgcaggagcagagcggccgtgatccgatgcctccctccccagggacatgaggtctcagagggcacattcagctcagtggcactttggagtcggaaatggaaaagccccagggctgaacgacagctggttgggtagcgactaataactaagaggcaggtgtggagctggggctcgccgagcccagctgccgtctcggcttgctgctcagatccttgatagcaaaaaccaccaggcacgtggggaacgcactccctccagccagggccaaatagaagctgctggagggggtgttggcagatccagagtctggtccattcctgctggaaataccaagctcacgttttgcacctacttagttttagtctgaagtcagctagagtcacaggccagggagcttgactggtatgggtggaggagacaggaatctggggacccatcttttcttctgtttcatggtggtcagattagcactgagccagtttttagattgaagcccctctgttttactgcttgtaaaatgggactgacgcctcccagatctggagaggacttttcggagtgtgtctagtcctgtacacctgccctgtgaacctcagggtcctcacccgccttctttgaacttctcaaactagaaccatggtcagtaaaagcgacggctgcaattgttctaaatccatgagcgttatcccactttaccgtcctttttccagggacattgaacctccctcttctcagccctcccctgtgttcccctgacccacagacagtgcgcggagtcggggctgacttcgtgtgagctgtccataagtggtagggctgtggctgtgacctcgtagagggctggagagatgacgcgtccgttctccactgtggcccgtcgaagctatgctggcaaagaatggaaattcccgctagtcttcaggggcagagcggtgacaattcgaagccgaagagggctgttcctggccttctttccccatatccctcgctcaggctgttgacccggccatgccacccctgtgtgctggaccgtgtggggcagtgtccccaggcccgccctccgccctgtgtctctgtgttgtggacagaagcctcttagagcgctccgtgcggtaggacctcagcctcggccctcctaacctctttcctttctctctctctttcccctctctccctcctccccccttgcctctgcccttcaggtccgagcctccgtactgggtgcaatgaaagctccacgcaggccttaccatggaaggctgtgactcgcccgtcgtctcggggaaggacaatgggtgcggtatccctcagcaccagcaatggactgaactcaacagcacccacctccctgacaaacccagtagcatggagcagtccacaggcgagagccacgggcccttggacagcctgagggcccccttcaatgagcgcctcgcggagagcaccgcgtcggccgggcccccctccgagcccgccagcaaggaggtcacctgcaacgaatgttcggcctcctttgccagcctccagacctacatggagcaccactgccccagcgcgcgccccccgccacccctgagagaggagagcgccagcgacaccggtgaggagggggacgaggagagtgacgtggagaacctggccggggagatcgtctaccagccggacggctccgcgtacattgtggagagcctgagccagctgacccagggcgggggcgcctgtgggagtggcagtggcagtgggcctctcccctcgcttttcctgaactctctccctggcgcggggggcaagcaaggggacccttcgtgtgctgcacccgtgtacccgcagatcatcaacactttccacatagcctcatccttcgggaaatggtttgagggcccagaccaggctttcccgaatacctcagccctggcggggctcagccccgtcctgcacagcttccgcgtgtttgacgtgcgacacaaaagcaacaaggattacctgaacagcgacggttctgccaaaagctcctgcgtatccaaagatgttcccaacaatgtggacctgtccaaattcgatggctttgtgctctatggcaagaggaagcccatcctgatgtgtttcttgtgcaaactctcctttgggtacgtccgttcgtttgtgacccacgcggtgcatgaccatcgaatgaccctgagcgaagacgagcggaaaattcttagcaataagaacatctccgctatcatccaagggatcggcaaagacaaggaaccccttgtaagttttctggaaccaaaaaacaaaaactttcaacaccctttagtttccacagctaacctcataggccccggacacagtttttatggtaaatttagtggcattcgaatggaaggggaggaagctctcccagcgggctccgccgctggccccgagcagccccaggctggtctcttgacccccagcaccctgttgaaccttggcgggctcaccagctcggtactgaagacccccattacctcagtccccctggggcctctggcttccagtcctaccaaatcctcagagggcaaggactctggggcggcagaaggagagaagcaggaagtgggcgacggggattgcttctctgagaaggtagagccagccgaagaggaggcggaggaggaagaggaggaggaagaggcggaggaggaggaggaagaagaggaggaggaagaagaggaggaggaagacgagggttgcaaaggactctttccaagcgagttggatgaggaactggaggacaggccccatgaggagcctggggccgcagcaggtagtagcagcaaaaaggaccttgctctctcaaaccaaagcatttctaactcccccttaatgcctaacgtgctccagaccctgtcgaggggcacagcttctactagttctaattctgcttcttcctttgttgtctttgatggtgcgaacaggaggaatcgtttaagctttaacagtgagggcgtcagggccaatgtggcagagggcggcaggaggctggactttgctgacgaaagtgccaataaagacaatgccacagcaccagaaccaaatgaaagcacagagggtgacgatgggggcttcgttccccatcaccagcacgctggctccctctgcgagcttggggttggggagtgcccctcggggagtggcgtggagtgccccaaatgcgacacggtcctgggctcctcccgctcgctgggcggccacatgaccatgatgcattctcgtaactcgtgtaagacactcaagtgccccaagtgcaactggcactataagtaccagcagaccctggaggcacacatgaaggagaagcacccggagccggggggctcctgtgtctactgcaaaagcgggcagccccacccccggctggcacgaggcgagagctacacgtgtggttacaagcctttccgctgcgaggtgtgtaactactccacaactaccaaaggcaacctcagtattcatatgcagtctgacaagcatctcaacaacatgcagaacctgcagaatggagggggggagcaggtcttcagccacactgccggggcggcggcggcggcggtggctgcggcggcggcggcagccaatatcagtagctcctgcggggccccctcgcccaccaaaccaaaaaccaaacccacctggcggtgcgaggtgtgtgattatgagaccaacgtggccaggaacctccgcattcacatgaccagtgagaagcacatgcataacatgatgttactgcaacagaacatgacccagatccaacacaaccgccacctgggcctcggcagcctgccctcacccgccgaggccgagctctaccaatactacctggcccagaacatgaacctgcccaacctgaagatggacagtgctgcctcggacgcccagttcatgatgagcggattccagctggatcccgccgggcccatggccgccatgacgcctgctctaggtgaggatgactacgtgtttgtctgttttcatgataggaatttaaccagggagaatggtgaatagggtgagatagtcctgtggattcagttgactctggtcttctcgagtggtttttgtgtaaactggagtgtcttacaatcaagtattctcaagaatcccttgaactgtgtgtgtacatatggaagagtttatgcattcaaaagagatatgcttgtactctggctacgtggggccaggattaaaatgtgagtgtttcctctagttttctgttcccattctctctttctctgtctcttctttcaatttgaaaaatcactataatcacctaaaactttggggtttcatcgaatatttactgaaacttacaggaaactgtagctgaggcaatcatttcaataagaggactagggacagttacctcaatgatttaagtagagacaatcatcttaataataggaattcggaaccacagtgtacgttattcagataactaaaggctgattctgtgccgagctagggaaccatccagatagacttctcaaagttctctgtatatttatgaggacctcaatgaaagagatgtttttttttttgcttatttttgatgagtacttggtgattagaatagttggaaattaattgggaattaaattgccccagtggcactgttgtgaggggtgtgagagatgaaaaatgagtaagttgtaaaaattgtccatcaaggaaagttaacttttaatagcagttagatcctggttagcggagccttcgttgccaggaagaatgacctctgctttagagaagctgatttggctctgttcaggctcccagtcttaccaattggcttacaatatctagaataggaacaagagtgtaggatttgggtgctaaaaactttgagtttttacgtagaacgaaccacagccactttgaggatagctgctgctgccaaaacaatctacagatgggtttcatgagaaccttctgatagttgggccactcgtgcctccacccggtatgcttcaaacaggatcctgcctgcgtcccatcccgtgacgctgctaatggacttcgtgggaccagtgacaatggcctgaattaagcaatatgccattattgacatgggaataggttgttcttggcaacagagtgtcagtgaggactttttttccaggatggcttagatgactgcagggccaggcctcagcagttggcaagtgtttatttgtgtggtgtttgagtgctaattgttgccgatgagttatatttcaaagcattccattggtttttcttgctatgtattcagtttttaatccttagtactttaatctcattttccattttgaaatatttgcctgttgatcctttattaccaaatgatttgagggtatttgaaaccaactggctaattgtggatgcacaagcactggtcgtcttatttgtcaccagggtgaaccatgcacaccaggagatgggagtgagtactctaaggttttctttaagccagtaggaattagaaggagtcatagaatcttgggaggtagatcttggagcaaatcaaacataacggaggtggaatgaagacagaacgtgggaacgtgggtaggttcatgttgggtcaaagtgagggtttttttttttttttttttttgagacagagtctcgctctgtcacccaggctggagtgagtggtgccatctcggctcactgcaacatccacctcctgtgttcaagcgattctcctgccagagcctcccaagtagctgggattacaggcacccgccaccatgcctggctaattttgtgtttttagtagagatggggcttcaccatcttggccaggctggtctcaaacccttgacctcaggtgatctgcccgccttggcctcccaaagtgctgggattacaggcatgagccactgtgcccagcctaaagtgaggctttttaattaccttaagaacaggtaactaaggcttgtattgagaagtagagaaatatttcgctttcacaccaagtgtctgtgagtctttggggcatcatgcactgtcctgggcattgcggcagattcagaaggagcagaagaatgaagccctgtgttgtagacacacatggaagggccacaccatatttcttagactggagctcttcctcccaaaggatttatccagctcagtcacaaagggctcttgaatttccagtgtcactacttgtcggccacggggagtccctggaaacctgtgccttccttgggccgcgaaaactgctgagaaggtgtgagagccacaaatcctttatgccagaagctcgagtgggtgtgggggccataggaagtgtccaaaagacttggaatttgagttgtatgacctcagtaggagaaaccaacttatgcaaataaaaacagccataactttcagttctagctgtggctgtactggttttttttccccatggtccatttataagatggctgtaggtgttattagatgtgactgagttctgcagggagaaaaatgtttttgtgaaatacactcctctttacaaggtgattgttttcatacttcccttggcagagccctctttagtatcatcaaacagacactgattgtggggttgcttcttttcagaagcctttgaggaaaggcttggggctccttcgcctagtacagtcggatctgctgctctttgtagacagcacattagatttgaggccttgtgaacatcctcccaaaccttcctttcgactctgaagtttagcatagcaccaagaaaggggttgcttgtcggggtggctgtgtgtttcccaagtagccagccagcccctggacacctgcacaaggtttagcagctcccttcgtctccctttcattccagagtgtgcctttgaatccatgcaccttcctgaggatgtgctgatgggtgggctcacgtgtcaaggtgtcagttccagtgttagagttaggtgcatacccagagatggggacctgctccaagaccacgtatccagtgtggctcaagactaaggacctgccaagttctttttttcatttcttttttttgagatggagtttcactcttgtcgcccaggctggagtgcaatagcgcagtctcggctcactgcagcccctgcctcccgggttcaagcaattcttctgcctctgccttccgagtagctgggattacaggcatgcgccaccatgcctagctaatttttgtgtgttcagtagagacaggatttcaccacattggccaggctggtcttgaactcctgacctcaggtgatctgcccaccttggcctcccaaagtgctgggatgacaggtgtgagccactatgcccagccccagtttcttatttataggggccctgctcctgtttgtgaactgggtgagattcccccactttgtggcagctggattagcggatttgtaggattctaagccctgggcttgtttctctgaggcatagttctcgaagggagttttcacttgcctgtcatcctcactcatttcagcactctgctgcttctgtcctttgcatttcattttaacagcctagaatgctggccaggcatggtggctcatgcctgtaatcccaacactgtgggagtccaaggatcacttgaacctgggagtttgagaccagtctgggcaacatctcgacaaaacatttttgttttaagatcagccagacgtagtggggtgcacctgtagtcccagctacttgggaggctgaggcaggtggttcacttgagccttggtggcccagactgcagtgacccactccagcctgggcaacagaatgagaccttgtctcttgaaaaaaaaagagcttaaagtggaaactgggacttcgttcctctgcttattccaaggacttctcattttcactcaggcatcagcaagtgacagctgaatttctctttagagcgatgttgatgtgccggggtgaaatctaaaaagtggagacgatttgatgcttcaggtggttggcatcagaaacaaatatatgtttgctccttgtcttaccctccgggcagtttctgctttgactgaacactgagtatgtttcctggatgttgcctggccttcgtccccgttaagggatggagcttttaggctttttttttttttctttttcctttctgtttttctttcttatcctaaaaagaatgacatagttatggttcctctcaccaggggagatgggaagacagacaacaagccgaaagcttcctaagccttctggaatgcatgtgcaaaagatttctgtggcttgctagactgtccgtgagcttcaaacgcagctgctggtctgcttagcagaacctgtactgatcttatcactcgaggtgacttgtgtagcgtcaataagaaaatcataaaaaaaagaaaaaaatattttctctgatgagccactgacttggattctaatcagttgtaaaaaataaaataacctcagcccaaccacacataaaaggtcaagtttaaatttcacttggggggtggggcagacctaatagctcaagtgcacgtgtgtttaggaaagagaaactagacgccagtgcccagccttctgcttgaccgtacgcttctaggaactggagggaaggctgctctttttaagccattctcctggtagaaataagcccttgcagtattaatttaccatagcaaatgtgagcttgtacccggtttatgcagggcagtgatggactgaaaaagaccagggtgggagagggaggaagagatcttcgcccggccctttcgtggagacgtggagctgagcctcgtgtctcactgcctgtctcaatccacttcctgaacgtgcagcagtcccgctcttttttcactcttgtctggcacagcaaacatttgggcgtctgtgcactctgtagagggccagcgaggataagactggacccctgtcctagggaggtggtgccctgatggggatcccagctatggtgcatctctgtaggtaggtgactgagtgataaagggaaggtgattggtcctagggtagccccacatgtcacccagggcagaggatcaggaaagagaacaggtagccctactgagaagacatgggagggttggcagcattgactgacgggagggatattgaccagagggcagcagtgaggagtagagggattactctccaagtctttttttgttttgttttgtttttgagacagggtcctgctctgtcaccagggctgagctgagtggcatggtctcagctcactgcagcctctgcctctcaggctcaagccatccttccatctcagtccctgagtactggaactacaggcacacgccaccatgcctggctagtttcttttgtatattttgtacaccatgttgctcagactggtcttgagctcctaagctcaggtgatctgcctgccttggcctcctaaagtgcttggattaggggtgtgagacaccacgtccagccccactccccagatctttgctttagagatgcactatccaacccaggcgccactcaccaccatgtagcttcctaaatttaaataacattgaaaattcagttccgtagttgcactacccatatttcaggtatttattagtcacaggtagccagtgactgctgcaccagatgacacagccatagattgttctcaaggtggcagaaagtcatgttggtcactgccacctcagatacattctgggcccaattctggttccccatgaaggcttggtatgttacgattgcagctgtgactcatttccaattttggaaggtctgcagtttgagattctgttatatccagtgaatgatacatatttctgtcttttcttggatctcagagaagggatgaattgaaatattaaagaggtggctgggcgcggtggctcatgcctgtcattctagcactttgggtggccgaggcagttggatcagctgaggtcaggagttcaacaccagcctgaccaacatgatgaaaccctgtctctactaaaaaagacaaaaattagctggccgtggtggtgggtgcctgtaatcccagctacttgggaggctgaggcaggagaatcgcttgaacccgggaggcagaggttgccgtgagctgagattgtgccactgcactctagcctgggcaacagggcaagactccatctcgggaaaaaaaaaaagaaaaggaaatattaaagaggctatggctcctaacttttctaggtgttcttttcctaaagaaagaaaatacaaaacctgccagaaatctcagaatgtccgcaggaaagattgaaacacatcaggttgactgtgtttgtttgtttgcttgttttccagccagtagccctttgcaacacttgaaatgtcatcttctccttttggaccccagttgagggtggcggagggctggggggtgcctcagctgtggccgtgaccatgagcctggtgtctgactctctccttctctccttccctgcagtgggcggtgagatccccctagacatgcggctcgggggcgggcagctggtgtcagaggagctgatgaacctgggcgagagcttcatccagaccaacgacccgtcgctgaagctcttccagtgcgccgtctgcaacaagttcacgacggacaacctggacatgctgggcctgcacatgaacgtggagcgcagcctgtcggaggacgagtggaaggcggtgatgggggactcataccagtgcaagctctgccgctacaacacccagctcaaggccaacttccagctgcactgcaagacagacaagcacgtgcagaagtaccagctggtggcccacatcaaggagggcggcaaggccaacgagtggaggctcaagtgtgtggccatcggcaaccccgtgcacctcaagtgcaacgcctgtgactactacaccaacagcctggagaagctgcggctgcacacggtcaactccaggcacgaggccagcctgaagttgtacaaggtaaggcccagctccttatggctcaggcgctctttctgaaaggagggggttgcgcaccggggagttagggagcactggggaggagtcggacagtctctggcatggcctgcttggctgttggttgggaacctggagttgagaggagagtcggcggtgtccactttgtcaccaggtggaaacgtgacaggttcagtgagtagcttgactagctgaaggttctctttctgggtgcccaattttgggtcaggttttgttgacagcgcctctagggttggttcttttctttcttacatgggctcttttgcatcctctgctcctgtggtttccctctctcctttaggctttctgttctccttttccatctctttattccttttttttttttctatttctcctttcccggatgctcctggggtgttttgttcctcccttccttctttcatccatccatcattccaccaacatatgtacactgggtaccttctcaatgacaggtactgttctgggcatttgttcacatcagtgcatgaatctgaccaaaaaaaaaaaaaaaaaagaaaagaaaatccctgccctcatagagcttccattcttttagcaggagatgggtgagaaacgatggataaattttgtagcaggctagaaggtgctaaatgctgtggggaaaattgggtccatgaggggcctcctttgtgtgttttttttttcttccccgctctgttgcttcctgggttctgtgtcctctttctcttccttatactttttcttcttcttcctgggcttctcccatcctccccctcttcctctgtctcttctcctcttccctctttcctgtccatttattctttctctccctccaccctccgctttccccccagcccttccctctactccatagacggcaaccgagggggaggtgctccggatactgtaaatagtcctttcacttgcacggcagaattgctccagacgtctctattgattttcactggacttaaagcctcacctttttctctaatcatcccataatggctttagtatgaacaatcaggtacaaatcgccataaatctccctggcctgatcccacacaccttccactccctcgctctctcttttcattttcctcactcccattatcagcctctcctcctgcctttcacactgtttctcgcgtctttgggcccacgagtgtttggtttctgctggccccgagctagttgagtccctactctactcagaatgattttaaacggagattccatataaggaagacttctagtcctttgcccatgtcggcctctgccggggttgataattgtacttcattttatagttgttccttctcaggatgtggggaggcctgcataacgtagtgcttaagaaagcactttagggaaaggaggagaaagcaggaatgaggtagaggggatagaatgttctggaactgactgtggactcagctatggtgcagtgaggaaggtctggacaccacgcatccaatccccttatctcaaatgagcaagaaccttgctggactggcttagttttgccaccattaaaagaaaaaagccctttgcagtcagtttaaattggaggtctgaactggccacaggatggtgccgacgtggtcaagaaaacctgatggaaaaaccagtggaaaaaagaatttccaaaggacccaactgagtaaaatttgtacaaaggactcggcgtggccattgaaggttgcatgcaactttgatgaaggtcgtttagaggtggcatgaagctggcctcttgcatccaaggaaaaaattgccctttagactctaaaatgcacacggtggcgattaactctcatgctgcatcctccgtgcggctggagtcttgaataagagtctgtcaggcacttgactttgcttcttacgggcctggaactcggcggatttgctgagaacatcctgttttggtccccaaactgtgtccacggatcacacccagagagtcagggtgaggtgtggttggaagagacgaggtttatttgcatgtttctgcactgctggcctgtcatcctgggacttttttctcatttctttttttaaggtagaggaaactgttgctcaaaaagatggcgtgggtagaagggtcctgagcgttgggatgcagggtagaacgtggacccagcacctgaaggagagatcctgaaatggtgcatctggccggcacatccccggagtgaccagcctgaggttcagggcagaattgcctccgtcaggagccaaaggtcattagtctagtctcattagtccttgggtaatgaatggccctgtgcctgcccgggcttcgccacagggggcggggagctctcccgctcactcctggatgacaccgctgggattgtcattccagtgctcgccctcagccctttggtccctcagtacgactaagatcaaacttctcttgccactaaggaaggctccctctcaaggtttcgtcattccacggatttggggtggggattggaggtggtttgagagtcactttttctctaggccctggtgtggcctgtagtaaatggagattgattgcatgttatttttcctcttgctaatgtaatccattagcccggcacatgcataatcagtttagagcacagttaactggatgtaatcgagttctttactgtctgctagagaaaccgctccagatgcagctgacccggggagctgaccgggcttctcacacacaaccctccttcctcaccccttccccaccccaccctgtcccggttccctggcaaattattcatgatcagccagggcggctctccaaagctgctctccgcggcacctagtgaagtggcagtgatgtatgtggcttcccggtggccctcccagacctctctttcagccgaggcttttattctcctcctgttcctttttcatgttggaggagacagagctgcattctcaggagattcaagcagtggcatggctttcggtgtgtcatctgacctcaccctgggccggagtcactgcccttgctgtcacgcatgctagtgcgtagattgctgtaagagtgaactttctgaaagcgtgagataatttttaatccagaaatgagagagggttgtgctaatctacaaaacctgatgatattgtcttcgttgcctggaatggtgtcgttttgatttttgtgtgatactaatgtttaaatcaggattaggttcaacctgtttttcttttgcacctcctggaagtagagtggagtaggggaatgccgcagggcccgaggcatccgggggaagcccccttaccttgtctctgggcctcaggttacttctgcaaagtgctcctgattgaaatccttgggatcttttgggttgaaacagtggccggctctggcctagcccctaatgctcacatgtccacgtcctaacatttaccgtcttgggatccccgtgattggctgacatagcaagaagcccagaggctccagtgaagcttgggaactgggctctttctgtccttagtgtcacatctgagccagcatggaaaaatgcagaaggcacttgtctctcaactgggactgagctccggggtccttaattcctcatccttctgctttcacatgtaaatgtatcactcctttctcagaggactacaccctggccccactctcaatcttctccacccgtagagatgtgggtgcccttgatcctcagaactaggagagcggctgtcactgacacatgcttgccctctgccctctcccacggctagtgtacagcctgcgtctgaggcgtgtgggttcagagctggcaccagctcttccacgtttatcttgcattcccagccaagtgacgtccatggtgagctctctgaaatgtgtgctgctttctacccggagggggcggggcacagaaagggcagttggaaatcagtgcacactcccaccatctcccagaatctgtttttcactttgatgtttttcttcacctgagagtcattggagtggaaatctgtcaactttagcagatagattaagaccctaccagaatctgttactcaaaacggtttctagctggggttcctttgattggaccaagactgaaggttacctgttaatcttaaatactgtacaaggagggttgtctaccacggtgttgagtctgggccacatgtgagctgctgtgggccaacagggcacacaggagaggagaagccagtgtccaagccaactctgcttggcctgaggtaggaggcagagtgtggtattgattcatgcacatggccagattctccacatagaggatgtctgctcctgccattctaggaggattgtgcagtacggaagaatgtaagaaaacttccatcagactttgcattgctttagaacccatcttttcagttctttccctgatgcataagaaactcattgggattcacactcccagcagggctataaaatcatcgtatggtagacgggcaaatcagaaaatgtaggtgaagtcagacaatgatctggtttgaaatctgcattcttggtgctcctctgtgggtgtgctggggggaagtgggggtcttaggaagatagctacacattttacgtccgtaggtggtgcctggaggcctttgtcttgcactgagagcaaaaagcatacatcctttggggaccgtccccttcctccctcccgtcctgccttcccagcttggctgtgtgtttgaagctccggtgaaagtgtcatatggtttgcgtcgggattctggagccagttgcctcaaaccttgttttctcattattagactattttttttgtttgttttaagtacatacttctgccaccttctctccctaccttgatgccttcaaccaaaaaatgaaaggaaaggaatgttttcctgcaggtgatttagaaggtgtgcaaggccagatgttttggtgaattttagcagatttcgcctgcatgccctccttctcctggagcagctggaggcctgcggttcatttccatggcttgatggttggtgctggtgggacgtgggtctctgcagctgggctgggaggctgcacgtgggcctgatgggttcttactgagagcctgggctgactctgacagctcttgtggccaccagttaacttcaagaggactccaggagatggaaagaccaaatagtttggggggcagggcttgtgctaggaccaagttcatccatcactgctgtgggaacgtatggctcatgattcaccagtggtgtgcggcatgaaagctgggtaccttgctgggaggtcccttgttctttcctccttccagaagcttcccacctatcttcatccacattcgtccaataggttgtatttcacactctcagccgatggctttaggcacaagctttgtgtgggtcactctggttagagcattttacacaccctcatgtcaagaagatcaggtcagtgatatcttttcactccactctttagacaccacataatggaactgaaatcttattagttgtgcctattgaaaaaaaaaagtttagtacttaaaaaccacctgttgaaaaaccagttttgcaaccattaaccatagcacttttattctcttttttctaaatgcttttagtgttttttttctctctctcttttctgagtcctttttgtggatagtaaagaactgaccagacccttttagaatagtattgtattcttaattatttcttaaaaggttagcattccatgtttacctcaagtgtaagctagtaataaaatgtggattccctattttttacagttaaagtaatatgagtaatgcatgttcactgtaaaaaaatttggaaaaatccaggaataaaaaagaaagtaaatatatctggttaatcctaccatgtgatggatttttattttttatttttgcatgtaacataggaattttacaaaattggaatgacgttgtgtaatacctgagaccttttttacatctttaagtattttccaatgatttttaaagtggatgtcttttgtctactttctgactttactgtccagaggcaaacccactgttacatgtagttgatattttgtgctcttttctgtgcttctgtagatgaaaatgcatgtgtgtatgtatctgtacacacacacatactgttcatttttaaaaatctttatagacacatgctgtggtttcaattttgctttattttgttttttgagacagggtctcactctgtcgctcacatgggagtgcagtggcgtgatctcggctggctgcaacgtctgcctcccaggctcaagtgattctcccacctcagcctcccaagttgctgggaccacaggtgcacaccaccacacccagctaattttttgtattcttcatagagacaggatttcgacattttgcctaggctggtcttgaacccctgggctcaagcacgatccacccacctcggcctcccaaagtgtcagtttgttttattcaggaaaatcttttaggtcagtagatatagatacttttaggtcagtacatatagatactttttatgaaaatcattttaggtcagtacatgtagatactctttttaatgtcgacatagtatttcctttattaaccagctcctttttgatgtaccttgaggttatgtgcagggtttggatactgcagataatgagctaggaacatgattctctacacacaccatgaagtggggttgttgggtcccaggacctaatgccagtagatgcagcacttcccagtggcctttcagaaagcaggtggccatgtcatccttccccagtaagtgacggccagactcccacacagtgaccaacaccgtgttgttgtttttccattttcattgtcagattgacaacattgttctaaagtaagtcccttttcattgttctaatgtagatgggggaacattttttgtcatgcagttttttgtttttgttttctgtttttttgagactgggtctcactctgtcacccaggctggagtgcagtggcgtgatctcagctcattgcaacctccgcctctgggttcaagtgattctcatgcctcaccctcctgagtagctggaattacaggtgcccactaccacacccgctaatttttgtacttttagtagagatggggttttgccatggtggccaggctggtctcaaactcctgaacttgggtgatccacccaccttggcctcctagagtgccgagattacaggtgtgagcccccacgcctggccctatttgtgacttttcaggaatatattttttgtatagttgtaagactatgcagtgtgatttaggactctttattttccttcaaattcaatggctagctgtacaacgattgcttaaataaccagcctttcctagctggtgtgaaaagctgtttctcattctccattctcttacgtcttgcagaacctcttgtgaatgatccacagatttaggtaaatcagaacatatttacggaatactgtcttcggagacactggggaacaagaagaagggatggaaaggcctggctctctttcctggcatttggagtctgtggaccaaacgccttcctctcaccttttcctatttctctctggcatgttccccaaaagaaaatttcttagattagtttgccttcattgaactctccaggatgagagagtttccagaagaaacagagtctgcaaagaggagctgggtttttagggcaccttaatggagactgtggatctcaccatttatcttaaaaaaggggtcaggaacaaattctgaaagccatggaaattccctttcctgaagttcttacgtaaatagcatataaatttcatgactctgtcgacatatttccagtataaactgttttcaggtactggttacaagtctccttttggattccaaaggtataccatggcccctgacttaggctgagcagcaaggaggtctaatttcagaaagtctaatagctaccactttgtcaaaatatttacgaatccccccgattctctatttagaaagccctggaccttcttatgagagagaaacctcaaacttccagtaccttcacctaccccccacccatccagaggaataagtcacaccgtggaattcttcgcataaatgacatctgccgtcttaggggtggtctgtaacccttaggagaattttgtgcaaatattccgttgcttctgcattccaggataatgcgttgtgttacggttgttttaggtaaacacactctggcaggaaagccaatatggcaggtgccacataatggggcaaaggtgtgaactcaatgttgaattctttcaacttgctgaggacttggactcaaagggcagatttgaatacgtctagtcccaacaggtgtttctggtttttttgttttgaaagggaaatcataagggaacaattaggcattgtcaggaacatagtcaggaaaaggcaagagtttttaaataattatatgatccacctgaaccatgtactttattctgttttacacatcagttgaaactgtaaatactagtaagtgtagggtgggaaaggctgttactatgaaaaccatttcggtagtattgagtaagtatatatttaatacttaacagaaattgatttttagcacttacagcagccgggatgtagaatgaaagttaaaattttctaatggcagaaaatctgtcactcatagaaatactggcgactgtagaaactagcaacattagggtggtgacttgggatggtgttggcaaatacagcaaagaaaactgtggaattctcagtgatgtgaatttcattctttttctttgtataaaaagaaatttatatgacattaaaaaaaaatagaaacagggtctcactatgttgcccaggctggtctcaaactcctgggctcaagtggtcctcctaccttggcctccaaacgtaaatttcagataagcaacaatgatgttttgtgtaagtgtatctcataaattatacttacacttacctgaaattcacatttaactgggcatcccgtgttttgtttagcagctctacctctggatagcctagaaatttgttcataatgacctgccagcaggctctatagaagtgtaaagagagctatgtggcttccttgtttgtgaaacccgttttcttccagtggttcccaacaaaagaaatttacaaatgcctctaatgatgatatccagtttttgttatttatagaaaagtgtcctatccaatattcacattttgtgtgttaagtaaaatgctttcctataaagaaatctgaaattttctctagagctgtttgttcaaacttacttttcagtcatttttttcatgagtcccttttattgaaatgcctttgcgtcacacagtggacatcaggaggcctggttcggtcaccagcaacttggccagatgttgaagctgcccctggttcactccaggccttcttggtctcctcctgcactggttacttatatgtagaccatgaaaattcacagcacgtgagcattgctcacagtgcgtgggagaccctgtgtgcctatggtgtataggtcgctaatagggaatgcagagagtaggtttaaattgggactaatcatcaagaatgattaggagatgttctctagggtccccctcctggttctgtaaaaggcaaactagttagaaggttagaaatgtttatctactgatagtgtttggtttgtaacctgttaatgagtggagcatgttcccggactcaggatgagagcctccaaagcatagccagtctcttaggtcaacagtgatacccacattgccttggcagggccggcctgtgcactggggttgctgaaggggtttacacccacctgctgttccttttgagtctctcttcctgtcttctgtcgctggcagtatgctcttcctggaggatgactggacctttctaaccccttctgagctgatctctgtggagttttcttggtggcacgtgtcacaccggggcatccgtgtcttcctgctgcccctcagaatgagacagaagtctgggttctgggtggaaggcatccttgcattggctaccctgacttcttctcctcccatgggttcagaccccagccctcaggacccaagaggcacaggatttcccagatttccctgtgcagcttctgggagactgaaatcactgggaaggggtcttcgttccctgggtcaacaacatttgtggagtactgattttgtgctggccattgaagtaggattttgtacagactcaggctcacgaatgtgtaatgtgttactaaaaaacttgtttggggccatggctcacacctgtaaactcaacacagggaggctgaggcaggagaaccacttgagcccgggagttcaagaccagcctgggcaacataaacagaccctgtctctataaaaaaatttaaaaaattagccaggtgtggcggcacacacctctggtcctagctgcagtggggactgaggtgggaggatcagctgagcctgagagttcaagaccagcctgggcaacatagccagacctcatctctacaaaaaataaaaaaattatcagggtgtggtggtgcttatagtcccagctacatgagagggctgcggtgggaggattgcttgagccgaggaggtcaaggctgcagtgagccatgatcacagcactgcacacaacctctgcctcccgggttcaagtgattctcctgcctcagcctcccaagtagctgggattacaggcgcctgccaccatacccggctaatttttgtgtttttagtagagacagggtttcaccgtgttggccaggctggtctcgaactcctgacctcaagtgatccgcccacttgggcctcccaaagtgctgggattacaggcctgagccactgcacccagcctgtatctatgggccttcgggacaatgagaatgataatgtcggggtttggtgtttgctcccagaccccttttgcccttgggagcgagtctgtgtcactgcagtggtcctgcagatgcctgttggcgctactgaagatctgggaggagctccgattgtgtttatggcagggagtgtcttagcagagtggctccatctagctttagaacatgtcttgctggtttcgaacagggcttgtttgatttgaatgtttcatgttccagattctttacgaactgctcattgtcgcaggcccaggaaggttctctgagcagcatcggatgtttttgctctgtggagggtactctgtgcctcgagatgggggtgggggagatcaaaggtaaccccactggctcgtccccagctgaggagtcccctgctccaagatggttttcactgtggtcctcccatagctcctgtgcctttgtcttctatacttcccctctaccgccatgtctcttgttttctaaaataattatagatagagaagcatggggaatattcctcggctcctctagtgagccaggccaagtggcgcgggtcccagggctatgtgtcctagacatgagtcagcaagtgtgactccgaagccagctgtgcttgaggaagcactgtggggagtgatttggctggagacttctgtttgtgcgtggttgttcactttctggttctcagattaggctctgaccattttcattattaatttttttttgcccagactgggttcacattagtgatggctgcagctgtcagcggaggaagaccaaacaactcctccagggacaagagctctgacctctgtcccgtctctttgtgtccaactcggaatccatactcggctctcttcacctccagggtcttgccgccctaattcatgtctctgagtgtttagtgctttggggttatccaaaactcatgccttgggggcgtgccgatttgctctgaggtggtgagttctcgagtgacacctctgtggatggctattcctccctgatgttctagctagcttcccgagggacccaccaaattctccagaaactccctctcccttcccgctgcctcccgcaaacacattcggacgcctgtcttcttttcctggcctgtgctttcttcctcttggagtgtggcatttggaatcaagtcacctggggagatttcagacaacagccacaaagcccagctccgctgaggggagactaattacacagctaattaatccaacagatgtcattttaagtgctcatttctgtgtgatttggttacacacgccctgcgttgctgagatgggcacggggccctgttggaaagtatcttttattttttaatcagactttaaggaagagcatatttcctgtccatcttttatgctctagtgacacatccctggttttccagaactgtctctccagctgctgtacccacacacggcatctctgccccacacgggtgtcacactgtttggcaccacgctggtctctgcgtcatgtgctaggtggtttcaccaactggttcgtaaacctcttgaggacctggattgccttcagttttgtgagtttctcaagaatgcagcacaagtagacatcagcaggtggttatccgtttctctccatttactctcttgtctttactgacagcaagtttctttgcaagaaaagtagctgaggagtgtctgaaaggtgttgttttacaagtggagggttaagaagtataggacaccagtgattgttggaaaactgaaaaagtcgtgcataggacaaacaaaccaaaaaaaggctcttggaggcagaggaggaaggtcaggaagtgagaggagatggtgttttccttccttccctctgcagtggtagaagtggaacagagaggatggaaaggtactgccttctgcaggtggcgtgggagcagctgcggggtgtagcatggcggtggccctgaagctggcagcctgtactcatggaagtcacctggtcctccatgggggctggcacccaaggcccaaggccgcattgcccagcaacccctcactctgaatcatgcccactctgggagttgactcaccatgtcccctcccagttgctggatccagaagtgacacttttcaccactagtaggacaggtcgccagtggtttctgtgttgctgactctgtcggctgtgtcctaattcgccggacctttcagccgcctttgccactcttgccctttgtctatctctgttggcttctcttctgtgacttcacgatgagtgttattatgcccccaggcttgtcccagagccccttcttttttctgtctgtaactctccctaagtatctcattcagtccagtggttttaaaccccatctactttctgatgacatctgaatctgtccctagcctaggcctcttcctgtatccagctccccacctggcatttgcattcgaatgtctgagaatgaactccgcaggcttagcatggtgcagaaaggactctgtgaccagaacccccaaatgcttatgggctcccccatctcggttagggccacctccagcatatcatttgcttaacccaaaaagctgggaactatctgtggggctccttgtcttttgctcccctacagccaaaccatcagcaagttctgtgggtgcttccttcaaaaatacatttgcaccaccaccctcccaggccagcccccatcgtctctctgtatttcaactctcccccgcctctactcttgccctttacaatcccctctccatacagggattttacgaagaggaaaatcaggtcatatcactctcttgcaaagaccccacaaaggctttccacctcacttaagataaaagctcacctttgtactgtggcttacaagctcctttgtgatctgaactcctcccaccatgctgacctcattttacaaccctctcccctttgccccctacactgcagccacagcagccttctctgttcattcaacatgctaagctggcgcctgccacagggcctttgcacttgctgttctactgagtgtatgtacctccttgaccttgacattcagctctcattcaatatctggtcgtcaaagaggctttccctgacaacccagtctcaaggagctacaccatcacttcactcaagataacttctctgcattgacagtgattatatttatttttcttgtctgttcattaatttagttgtctgccaagacagcagagacctacgttgccccattaacagctctgtccctaatgcttagaacagtgtgtgacaccagctcaataaatattgaaccatagggtaccagcagagcatgccgtgcttctgccctgtgctagaacaggtacaacagcctcatgcgcacacttggcatttcataaggtagagccctaaggcatatgttggtgtaaagtggatggcttgtgtggaccaggtcattgcagagcttctgcagcccaggtcatttaccatcagcttcacacacagctctgttcctgtactgacccctgagacacagccctggcaagatcatgcagctggtgtcaaattactttgaaaattcccacgtgctgctggccacccgtgagtttcggctctgtccgcccaaattctgccaactaaaatcactgctctttctccccagcactctcatcaaaatgccttgttcctttcccattcttatgatagaccatatttttagtggtctttcttctctgcttagttgtaagatccttaccggtgggatctgtttattctcacccaactttgtagccttcccagggtcttggggatattaggtagactatcagcaagtgtcgcctgatgatttgatggcaaaagatggatttttttttttttttaagacagagtgtcactctgtcgcccaggctggagtgcagtggcgtgatctcagctcactgcaacccccccctcccgagttcaagcgattctcagccttccgagtagctgggactacaggcacatgccaccatgcccagctaatgtttgtatttttagtagtgatggggtttcaccaagttgcccagtctggtctcgaactcctgacctcgggcgatccgcctgcctctgcctcccaaaatgctgggattacaggtgtgagctaccgcacccggccaaaagacggaatcttaaacatagaaatttaaagattaggggcagccccgagtcgcctcctccctcagtttccctagaggctcctctcctgctttcgttcccttatccttgggcgagcgtctttgtctgaatgatgcttacttagtcccatatctgattgtcccccgccctgagaaccacatttttggtggcagaacatattcccagtgagagaagctctgacctgcttctctcctcctgtcccatgtacaagccacacgtccttgagcacccgctatgcgcaggataacgtccttgcttctttagggcagtgacttttaaactttgttgacgataatctaaaaagaaatgcattttacatgagtgacccagcacatacatatagctagatattctgtatatttgactaaaacagaaattgtgcagaatgattttatccttactgcaggtgctacattctgatgctttctattacattcaattctgttttgttttacaaatgctggttgtactcacagcatggatttcatgatcccctgacatgatcctgatttcgtaatccagcgactcttagcccaggggcctttaaaaaactacgcctgcctggcttgacccccagaggttgtggtttcatttactgtcggattctgatgtgcggctgcagtttgagaaccactgcactaatgggtcatgatccacagtttaagaaactgtattactgtgatacgtaatacaaagaggaattgatcattcagtaagagccgtcaaatgcggacacaagagttatgaaggtgaagggagggagcagccacacccaactggttagatccaaaaagacctctgggagggaggggcaagctggagtttgagcaagatttaaagagggtagaatcatatagaaaggtgaactagacagaggacaaaggcagattcattcttgtacttactgaacctgtggctatggtactaaaataattttaataactggaacttcttctcacatacttgtggatactactctgttttatttttttgagagagtctcgccttgtcacccaggcaggaatgcaatggtgtgatctcagctcagtgcaagcttcgcctcccgggttcaagtgattctcctgcctcagcctcccaagtagctgggattacaggcgcccgccaccaggcccggctaactttttttgtatttttaacagacacggggttttaccatgttggccaggctggtctcgaactcctgacctcaagtgatcctcctgcctcagcctcctaaagtattggaattacaggctgagccatcacgcctagcctactctaacttttaaaagaaagctgtggccgggcgtggtggctaacctctgtaatcctagcactttgggaggctgagataggtggatcaccaggtcaggagatggaggccatcctggctaacacggtgaaaccccatctctactaaaaatacaaaaaattagctgggcgtggtggagggcacctgcagtcccagctactcgggaggctgaggtgggagaatggcatgaacccgggaggcagagcttgcagtgagccgagatcgcgacactgcactacagcctgggcgacagagcgagactctgtctcaaaaaaaaaaaaaaaaaaaaaaagaaagttgtgagctaaacatttcataataacaacacactggagtttgggtctttttagtgttttgctagtcaggaagtctgctcacgtgatctattaaaataataaaactacaataaaaacccataaacaaaaagaaaactgtagttgaggctgtgcatgctggagtagggggaggggtggagtgtactgcttctgcagtttactttggaatgaataaaagatgtaaggcacattgatagcaggataaagagaaggctgtaaaatagacagcaaagcattaatttcagcagctgggtggtggatacttaagtgtctactgtatgatttttttttcaactcatctccttggttggagatgttcataatgcaatgtgagggtaaaatactaaaacctaatggtgaaatgttctctcctctctcggctccactgtgtagaagcttcgaggtctcttctcaatccctgctgtcctcccctccaccttcctactcctctgggagagtagtaatgatgatctgttgtgtctctgaagacagggctcagattggttatttctgtttttgcagacgagggcatacatttcactagaggtagtaacatacctggttaagagcgctcaagctactgcgggagaggccatggaaatctaatgggatctgaccattcaggaggtgtctggatgcccacgagatgccgggcacatgttggtgtggcaggtggagtggggctcagtgggtgctgcagactagaaaaatttaagataggatgtccatgcgtcttaaaggaaacccagatagctcttggggttttaaggagggagaagatgcctggtgtcaggctgcctgggtttgaatcccagctcctgggacttaattcctgtttgttcatcatctgtaaaatgggctaatagaatgacttgctttgataggactctcgaatgacttaaatgagataatacatgaaatgcacctagacgcagtctgcatatagcatcagaaaggtgttaaggactctgcttttctgcattagatttcccatcgtcttcttagaccacacaactgacgttatttttataatttggttttaattagctttgaacttgacacgctgttggtttggagaatggaaaggtcagtggattttttttttttttttttttttggtgcggagcagggagatggaatttccctgaagagagattatgaccgatgtttagtgaaatgaccttgagccagtaatttaaccttggccaatctgtagtggcctcatctgaaggaggtggagcttggattcctcactaagtctccttcaagcactaagtgtgtgtttgtaggactttttttttttcccaaagggatatctccatctcctctcctaagtaatggagcaaaaagtgatctagtgaagtactcaggaaaattagaaagtgattcaagtccagctgcattgtggctatggcttgctccaccccttccctgagaagtacctaagacatcatccgttgtgagaaggaaatgatgttaccttcactgacataattttatcatattgtcccacataacctgggaggtttcagtatttgtttgtttctttttaaataggacttcctgcaagcatcaacacacatgtatttcccttatgtgaccaaaattagatgcaagttagaacgtaggcttggaaactggcatagagtacacaggacactcaggggaactatactccttggtagttttcattcccttacatgtatatttttctgattaaagctagtgcatattcactctaaaaaaataaagccacaatctagaaatacacagcttagaggacaaagatggaaaaacgagaatatatttgactttggttcttgttatggttcgtgtttgtatctgtttacattttgtaaccttggcaataccacagaatatcgtaaaagggggaacagcttctggacgcaagtgagtgttagctggtgttgcaaagctcacataccctcgttgcataagtgagttcatttgtatcgaaaaccacagtgtccgtggctcggatgacttaacattgccttaggaatctcactttaatgttcacatcagtgtccttgcttgtggctgtatcatcccaatctcccttcactgtagggagcacctgcagtcaagtatgcaaaactgtttccatggcaaccctttgttacccattaatttaaaatattccaaaatttttctccagctgaaacttttttttttttttttttaaatggtgcatccctcctcttccctgtcggtacgttggaagttaatctccttggctactgaagtcatgattgttttctaccttcccccgacctcttttgaaagctgaagagtgtgtgtgtgtgtgtgtgtgtgtgtgtgtgtgtgtgtgtgtaatgaaataaatggctaatcccagaatctctgattacagctctgagtcaacaagtgggaggaaatgcctcccttcttgatttgaaagaaggagaacttaatgcgaaaccgtctttaacatctgaaacgatgtgcgaagtatgtgcaacagaaacaaaatctcaccaagctcatgacctgcctgatgattagatgcataagtggatctggaaagtatacttgaaaaacagagcagctctttgtaatgtgaatggtgaattgaatgggtactaggaggactgagttttggcaacatacgtttcatgctggtgtcaagaggtgtataagaaataagtccacagcttatgtttggaaactttcacctatgaaatgaaatgcaaatcagtggcaataaacatgttaaggttgcaaatttgaacacaaatgaagaaatgcaaaagaaagttttgcatagcaatactcatttcacgtgagttagttattactatcaaatatgatattgtaacgtccaggatgtggggtacggctcagtgatggcaccttgtaccacattttacattttatgactgtcatatacaagtcttttgcatttcttacgtgtaggtaatgatttggtcatttattcttaccagaaccgtaatcttccttattttggcaatgtacaggcattatttttgttttcttccgtagtaggttttatgagtatttctaaatgtatcagttctgatctgttattcactattggcagtggctgaaagagctaagtgctggctgtgttttatagctgtgtagctttcaattgctattgtctgctccatagccctttaatttctgaagcatccttgccattatgtcacaagcgggttgtgttcagatcatttcgggtcttaggactttgggcctcgagatactttgcacttataaaatctgtctgcaagagatcacacagaatccattatctccttatcgcccgtcctcttttttttttaagcttatgtttatttttcttttttcccctccaattccaaatagtttggcaaagatttttaggtgcagaagaaccataaaggggtgttttgatcagatgccgctcccctcccttggggtgacaaaaatgggcgagaagctgtgtttgttaggagagtatgaagtatattattttattttattttatttatttatctattgagactgagtttcactcttgtcacacaagctggagtacagtggcaagatctcagctcactgcaacctccacctcccgtgttcaagtgattctcctgcctcagcctcccaagtagctgggattacaggcgcccgccaccacgcctggctaatttttgtaatttcagtggagacggagtttcaccatgttggccaggctggtgttgaactcctgacctccagtgatccgcccacttcggcctcccaaagtgctgggattacaggcgtgagccaccgcgcccagcctgttttcttttttaagtgaacgtttcttttcctcttgtcctccttttcatgctggggggctgggagcccagcacatccatgtgactgcattcggttcagcataattgatgcggtctcctttcccacagctgatgaggattatgtcagcttggtttaacagtctcattttctgctcccagtgcacacttgttttaatgtgtttcggttaatgaggtagaagagagaatgaggtgttactgtttatgtacagccagcttgcgtggagggccctgtcgcagcccgcgtggccccaggcatcctctggggcaagagccacagggcgaggccacctttcagaacacagtttttcctggctgaggaatgcagatcctgatgatgacctgtaagctttgccaaatagtcttatttctaccatttgtgttctctagacatatcgttctcatgtaatgatgaaaagattaaacttggcttagagcttggggtgcatttgagggagctgatcaaacacttcacccccagagctttttcaaacttagcttttgcatccctttcaccagtccctcacccccgggtggacctctccccaagcaagggtcagttaatttaacatataggtagaaccaatatcaaaaatccaggtggagttaagcagtaagaatttgattttttacctcactcttttttttttttttttttagacagggtctggcggctctgtcgcccaggctggagtgcagtggcgccatctcggctcactgcaacctccacttcccaggttcaagaaatttttctgcctcagcctcctgagtagctgggattacaggtgtgtgccaccacacccagctgatttttgtattttcagtagagatggagtgtctccctgttggcctgactgttcttgaactcctgacttttagtgatctgcccaccttggcctcccaaagtgctggggttataggcatgagctcccgcacccagccaagcctcattctgttgtccagcctggagtgcagtggtgcaattttagctcactgcagcctcaacctcctgggctcaggccatcctcctgcctcagcctcctgagcagctgggactacaggcacataccaccacacccagctaaactttttattttatggtagagatggggtcttgctgtgttgcccaggttggtcttgaactcatgacctcaagccatcctccctactgggattacaggcctgagccactatatctggcctaagaatttgtattttatcttacgtggatcagaacagtgctactggtgagggaggtaaaagagatcaaagagtcttccaggggtaatcttatatgaacaggcatctggtttgggtcatgacttggttcttgcttatctgtggagcttgggcctagagtttgggggcctatcgtaaacaccgctgacccctccttagggtgccttggtgagccgggtgctgccagagaacagccaggaaaccaagacttgggccgaggggttgtggtgggggggcttttgcatgtattcaaatctccagtcctggatgcatggacagcaaagggaatatcaggggtacaacagcaactttccctctttgggaccaacccaagccattttgtcaattgggcacacattgtggaaagacctgttctcctacctcctacccgctctttccatcttccccttaagccctttcctctctcgatctctcttgctgtctctcttgctctctcttgctctctctctcgctccccctcgctccccttcgctccccctcgctccccctcgctccccctcgctccccctcctcccctccccctcccctctccccatcctccacatcattgagcaccctaaatggttaaacccgttgcctggccttggcacggtgccagccccagggggcactgtgcagcctggaggcctctggcgcatcccagcttcccaaaggcacagtggccgtgggtttcagcaggaattaaacaattactaagtcttagtcctccccaccttccgtggattgactctataaattgtcagcctgttgacattttaatgcgaattatgtcatgtggtatcccctttgatttcgacatgcctcagtttgtaaatacatgagccactcaaaggcttgtggttagtgtacactccggaggcctcagggtttttggtgggggagagcgcgctggagggagcacaatgctgggagtgtgcctggcgcagagaggctgctgcagctcccccgggcggctccggaggggcggggggctgtgcggagggcctgctgccagccccagtgccatgctgggaacctcccagcccctcgcgggccgctgggaaggccactgcctttgagtccaagtcacgagatatttttattgagggcatcggtggctgaacgttcccccaaatcctccttttgtgaggtgtgatgtcacttcccccatcacctgcacctggagaagaactgacttattccagattccaaggcaaatcaggaggccaagggggcacggcctggagcaggtgttgccctcagaagaacttggccatcccagcgggagaatgaatcgggaggattgttaaggaaagactcgatgggtattgagaaattgagagagaaggaagacaaggaggaaggattactgtgacacagggagaagactcattggtgtgggtctaaacaaatttaaataaaaattttttactactgtttaaaaatggaaattattttattttaaccaatgtctgaccaagtgaaactgaccaagtgaaattctctgaccaagtgaagaaggagtggagacctgaaggttctgaatgttcaaattctaaaagtgaaattccagggaagaaatatggaaatagatttttagaggtaatttcaagtgagaacagctgagaagcccctatgctgggactctcctccagctcatggttcctaacaccctgttctctgtctcctgacctcttgattggagactttcctataaatttcgtaaacctgggggagctggcttcttggtaatcctttgtgtgtaggatgtcagtggtctagagagaactagccatctggaggtctgatgggctgtgcccagaggaggttggccaggatagacccagagaacgggccaggagtagaaacattggtctctgctttgtgtaggagaggcaggagcatgtaatcgcccctcatctgaatacagcaactgctgggcctgctgtctgtgttggaatttggctgatttacagaaatgtcatgggatctttgatgcccatgggtggtcgggacctatctcccacgtgctgagcaattctagtttcatgtgcgaataatgcccatattaaaacaattagtatccatactccgaaaaggaagaaggaaccccaattcatgttgatcagagacacttccagctcatttgagaaaggactggtaacttccacaagggcccgaatatgtttttcaaagtggattctgtaattcatttttaaagagttgtaatacacacaagtgtttggaaagtggagtcgctgtagctctttcagctcttccatggatttatctggcttttgttacttgggaaggggagcgagtgggcgggcaggatagagtgagagtgtgagagagacagagacgcaaaaatacacattgcttaggggaactgtttagttggttactatgggcaattatattctagcatctagtttgagtttagctataagggcatatgcaaaataaaatgataagacattagaataatcatgacccataacaacattattccttgttaagtttttaaaggtttcagttgatagatgtgtttccaaattaaaagaaacagtgacttccaagataaaaagggaggcctgtgctttttaaatagatcacagaattttgtttgtaacgtgaaaataggtctcagttacctgcttcctctctattgtaataattataagttaactcttgggaacatgctttcgtgcacaaatatagggccctttcaagaaactgacatgtgttatataatgagtagtgggggacaggggagtagcagtctgtgcctctttgcattttcctcctgtcttcaagaggacgtaaaagctatggtcactgcccacccttggctggtgcccgttccagcccctctgggcagtttggtcagggaaggagtaggcccgaaggtgacacttggtttcccagccctataaattagacaaattctggactattgtagatgattgtgcgggtccatttgctttcattcattcctttttcctcattgcttcaaagtgaaaggcaactcaagataagggaaagacacgggacggggttaagtggacacaggtatgggctgcctgttagcaaacctgggaaatgtgaccatcaggatcacctgtccttgaccccacagtgtgcgtatgcagcattgctgcggtggttggggaccatttagcctgacctgtgacatgcctgtacctcctgaaatttcctggcattcaggggcctctagaattctcttgccctttccagagttagggacctcaaggttctttgtgttgaactttgtgtttaaaaagtataagctagctcagtgatggaaccgttgacagggtaaaagcgcagttgactcactctacagctgcattgacggtgggcaaggattggtaggaaggaagaagtgggccagcttctgggaagtgggggaagagtgggcagcctcacgaccgatttcgatagcacagcaatggctttgtgttaactccacattccagcttgctccagccccacaggttatttgcatagcacacaaagcacagattgtacaatgtatccaggtatcaccggcattggcagttgaccacaaatatgaatgggacctgtgtgtccccgttgtaaggccttcccaaaccacccccgtgactgcctggacagagttcagacttgccagctggggcgccggagtaagacccatctgccttctccgtttttgggtctataggtgcgtttctgtaaagggtaggaggaaatgggactgaagtcccataggagagaagtgcccagaggaagaaaacccaggaggttagtttaataagaagagaaaaaaggaagttaaagggaggcgggggctaaacgagagtgaacgagaagggtttctgacaattaactaattctccttgctctaacccatgacagaattaatcacacattaacacactgacagcagaattgatgtcatatgcaaattaatagttcaggcttggcattcaacagcctgttggcttcttagggctggtgtcgtagttctgcgcacccagccgcggcctctctgtgggcctggtaccatctcaccctcattcggcctgagaatatccagggtgactttgtcatggaagcagcatctcatcccatctgctggcttgaaacaacttatgtcaaaacccataaccagttccttccatgttgttttcactgtggacacaaaggcaggtgtataacaggagcctgggttgaggaacccttgggctgtagtactttcttacctcctcttgtagttttacagtcagtgaccgtccttgtaggaaatcagaggctgttttcttgaactattcctaggaagggcctgcggtgttgccccagagctgccctgtttaacagagggagctgggttgcagggaacaaggagggatagcagtatagcgtcatcaaatctaaagtcgtttaagttttagttacataatacaaagtgaattgttttatgtggcttcaaagaggtctaacctattgcaaccaactctgaaagacaaaatgtgagcctctccttgatgttaataaataaataacaagaagaaagaacagtgtgttttatagcattttgactgctgaacttgagtgcctggggcaagtgctagctagcccgttacagccgacggctaacccacttgtgaattcgccatctgtgataattattattttgacatgtaatgagtaatcgtgttgtgaaccaggcattgtacacaacttaaagacgtggacctgcccagtagccgcgtcttgaacgtggtaggacgaggcaattcaaagtaggatgaaaacagtcaactgtgtatgttgatcgggaatgagtattggcattttcttagtggtgctgatttccttagctttttcattagctcccacttcatctactaccaaggagagagacttgagattgatgaggtcatgacagagatctgggaagcgatgttgtaggctgtggaatggtcttaattcctgggtgctcctggtggtgtctgtatatgacatgtataaaacaggctcagagacgcatcaactatatcagtgccatggaaattaggtctctgggaaatcattaacctgaaattttgattttataaataatgtgaggtgtttgcctctatcaaggatacaaggcatatatattcatagcgtctttttttttttttttttctggtctgagacaggtctcactctgtcgcccaggctggagtgcagtggtgtgatcacagctcactgcagcctctgcctcctaggctctacagatcctcccacctctgcctcccgagtagctggaactataggcatgcaccaccccgcccagctaactttttgtatcatttgtagagatgggctttcgccatgttgcccaggctggtgttaaactcctgggctcgagcgatcgatcctcccaccttggtctcccaaagtgctaggattacaggcatgagccaacgcacccagccctatgttcatatcttctattcttgttgtagacagatagatgccagcttctatttatgtacacaacatatacatagatacacatatacctaaaaatatacacatatactctgatgtgtgtgtatgtgtggatatacttgctgtaattttcatgtatagtatagtgccttagatactaatcatttcgtcgagtccttctagcagctttaccatatatggacttagtgctctaatctgaggagcctggtatggacagagcaggaagcaggctggggagagtctgctctgtccccagccctgacaggtatcagcctcagaccctgtaacgtcagctgtaaagtgaaggtgtttgcctcccagagtttttaggattagatatcctaaaatagaatatcctgttctaaaaactgtacagcatgtaacaatctgaaacaaatgttttatgattcatttttgatcacacaaggcaatttcataggaagaaagccaggtacgaagagagcgctgggagtgacggtcgttccataaggctgtaggtaggtttggccacactcaggttcgtgtggtactggctgtcaccatggtccctgggttgagggtgacaagcaggtggatttctttctgtgacgctaaagccatccttgatggtggccctttctgtctgtgctagaggtaaggatttgtcctcttcattgccacacctccctcttgacactggcataatgggtggaataggatgagatgaacttcagctgatagagaactaacaagtgacagaggccaaagggaaggttgtttgtctgggacaggggggcctcaccgtcctaatgcggggatggttaggagaggatggagggttaaagctccttcagctgagtgcagaaccaaaccagaggggcgagttgcagtaactgcaaggaggaattgggtgcaaagagaggagtaaagatagggtagtctgggtgtcaccccctgtgattaaagttctccgcaagaacccaggagtgggatttctggttctggtgcccctgcagtgtggaaatgcgaaggtctgctgtttcggtgactcagtggcagagtgtgggcttcacggcgtgcctaccgtgctgcagggctgagaaggaagtgagaccccctccatgactggtgcccccagatgtttctccaaggagtttggtgtgggagctgtctggcaggggcccctggtgcctccgcacccggctgggaggcaggcctgctttcgttttgcatctgtgcgtgtggccattttcatttttccctggacagccttgcctggggtactgcctgctgccggtgagggttgctaggaaaccggccaaggcctgtctcctcctggctcaggacaaggcccccgccagcttcctggggcctgaaaccagcatgcagcacgctgggcgccgagccaggcactgcccccttttctctctgccccgtcctttctctccagactcctcgatccccttctgtacatgcagtgatcatttgctgcacgaagcattgggggaaggcgaggccacgccaactgtctccatcatgcttctcaccgtactgttaaggtgctttcatcagagaataagaatagccccaaagccaaatgaaagtgagattccctctgattgttttctggagtctttcttggctagcacccaagcatcccaaatccccgttcagtcctctgcccttttgcattgcgccgtcttcccacttagccctatgtatctccttcatcctgagcgatagtcgtgtctgatgccctttgaagaacaggaaagccgcaagcatttttcgccatggggtctaggaaggaagtaaccacgatcacatttctgtgaagcacttgtccaagttcctagaagctgcatctcctagaagcttcgttgatgacaccacccggttaccctccagctctctaagcatgatgtagggtgtggcgggagagggagagcagggtctgtaattcagaaatgagctccgtccttaagtgaatgaatgcctagatgttctgcgaggacactctgagtatctgagtttggttggattagcttttttttttttttttttttttttttgacaaggtctggctctgccattcaggctgtagaatagtggcgggatcacagttcactgtagccttgaactcctgggcccaagtgatcctcctgcctcagcccctcaagtggctaggaatacaggcatacaccaccatgcctggctaattattttattttttgtagatatggggggtctcactttcttacccaggctggtctcaaactactggcttcaagcgatcatcccaccttggcctccaaaagtgctgagattacaggcatgagccaccttgcccagcctggatttgctttaaaagctaaaaaagttgttgtcttccacttgaggaagctggtctgcagatgacacacagacaggcagtttttcctctaggtgtgtttttttttaattttttttttgagacgaactttcacttttgtcacccaggctggagtgcaatggtgccatcgtgtctcactacaacctccacctcctgggttcaagtgatgagtagctgggattacaggcgcttaccaccaagtccagataatttttttttttcttgtatttttagtagagacggggtttcgccatgttggccaggctggtctcgaacttctgacctcaggtgatccaccgccttggcctcccaaagtgcttggattacaggcatgagccactgcacctggttggtgtgtttctttaagttgattatattcctaatcataatggaatccaggggctcatgtaccctgttggtggctgtgtgtattagtttaatttttccactgatagctatcacagtgtaaagtgggctaattctgtgctgaggcccagtgacttctgggtgttgatatgtatgagatgctcttcttcacaacattgtttattttggttatttttttttaagttggcaaattcttcagttggactagttaagataattacagcatgttcttgtggcttacagtgcaggtattaaaaatggtgatgcagggaccgggcgcagtagctcatgcctgtaatcccagcactttgagaggccaaggcgggtgaatcacaaggtcaggagtttgagaccagcctggtcaacatagtgaaaccccgtctctactaaaaatacaaaaaattagctgggcatagtaccgggtgcctgtaatcccaggttcttgggaggctgaggcaggagaatcgcttgaacctgggaggtagaggttgcagtgagctgagatcgtgccactgcactccagccctggcaacagagtgaagaactctgtctcaaaaaaaaaaaaaaaaaaaaaaaaaaaaagatggtgcatatacatgttttagttggaaagacggcctctctcaacatagtataaaaatgttacatatacagatcattgcgtttatgtaaaattggaggtatattttagatagatagacaggagatatcaagatggatattggtaaaaaatgttcacattagtgatagaatgtgatgatttatacatttctttctgtactgccttaaaaaaaaaacaaaacagatctttcttaaaaataaagataccacctggctcaaggattcttaaacctagctgtgcgtcagaatcagtgagagaaccctttgaagtacaaaatatgctgggcacactggctgacacctgtagtcgcagcactttgggaggccaaggcagatagatcacttgagctcaggagttcaagaacagcctgcgtagcatggtgaaacccccatctctacaaaaaaatacaaaaattagccaggtgtggtggtgcacgcctgtagtcctagctacttgggaggctgaggtgggagaatcgcttgagcctgggagttccaggctgcagtgagctgtgactatacctctgcacactccagcctgggcaacagagtgagaccctgtctctaaaaaaaaaaaaagtacagaatctgagctgaggtcctgcctgagagactgatcctgtgagcctggattagggaaatgcacagaatctgtgtttttaacaacctccaggcacatctacccgcatttagggaacacactgaacccagcaaaggaacatcgtatagaaatacctctaaacaggccgggtgcggtggctcacgcctgtaatcccagcactttgggaggccgaggcaggaagatcatgaggtcaggagatcgagaccatcctggctaacacagtgaaaccccatttctactaaaaatacaaaaaaattagctgggcatggtggcgggtgcctgtaatcccagctactcaggaggctgaggcaggagaatggtgtgaacgcgggaggcagagcttgcagtgagccgagatttcaccactgcgctccagcctgggagacagagcaaggctccatttaaaaaaaaaaaaaaaaaaagaactacctttaaacaaaggtcatagagattctctgaacatttcccatttctttatacaaaggagtccagggccacctttaattatcataaagcccatcctttatgttgagttactggctgcctagttacctgcaggggtagagatacttttgtcctgttcctcttctagaagagacatcttccttgtgatatgatgattttgtaagtgtttaaaggatactggtttttgtgactttttaaaactttgcaatatttgattttttgaatgtcactattttttccatcataatttttaatagctgcatagtattattgtatgaagatgccataagcagtttagctaattgtccctccttttcttgtctcttgtcttcatgtgtatgtaccgtccccatcctcctgaatgcaaatctcaagcacttgtgactattctttatatggtttccaaaccccttaccatccttgccccctgcttttgacttatttgcttgttgacaggtcccttgaatgatgatgcctttgatgggacgtggtcttttggcgaggcctcactcgtgtggatcacagggagtctgtccctttccttgatatagacaccaagtcattaatgttctagtcttttattaagcagccatctcaagccctcatggaactgagagttaaaccaggcctccttgtcccctcaacctggggaaggaacttgacatttattgctgtttttcttcatcgtgtttattccattgactcagtgggctagctggctgccctctcaagtttataatatctgaaaatgtaacagtaaggtgatcgtctttatatacacacatatatatttccacttaattatttttattaattttgagttcaaaagtgcttcatgtttattgtatgtaaaaaaaattttggaaatgcagagacacacacacaaaaaatcatccctaatttcactaccaagatgctttaaattgtaaacattttggtatatgtcattttggcctcttctgtacagatgtgatattattatttcgtagaattgaaatgatactgtgtgtatcttgtaactggcttctaaaaagctttacaatgtgtgaccttttttggatgtcactagatgttttctacaacatgatttttgatagctgcaccaaacaccccgtggtatgaaggtgctgcaatttagttactgggcgtttgatagtcggcttgtttccagtttttcactgttataaattaaacgttcatagatggataatataaacaaattaaaatagctctttctctatcaaaggtgttaaacatgtatttatgtatttgtgttactgtctacctttcccccagtttatcattatcttttgctgtttatggtatgttttgagattccaaagtttcgaaattttacatggcgaaaacttctcatttttgcttccttctcctttgtttgtttatttatttattgagacagggtgttgctctgtcacccagtctggagtgcagtggtgtgatcatggctcgctgtagcctcggccttctggaatcaagtaatccttccacctcagcctcctgaatagccaggactataggcgcgtgccatgatacctggctaatttttgtgttttttttgtagcgatggggtttcaccatgttgttcaggctggtctcgaactccttggctcaagcaatccacctgcctgggcctctcaaggtgctgggattacaggtgtgagccactgcacctggccttcttctgctttgttaagcttagaactgtctttcccctgccaagatcacattcactccatccccttttagtctttcatggtttcatgttttgacacttaactctgttatccatctggagtttattttggtatatactgtgagataggggttcctctatttatttttttctcaattatctgtccctgccatgtttattaagcaatctacccatcctttgccgtggtgcctagaaatgccactatatcatacatgaagttctcatttggatctgtttctagacattttctttttttattaattcgccttttcttggggccatacagaactgtctccattgtttagttttgcactgcctggtattaaaatataataatcctcgttagtcagttcgtacaaatgattttcatttcacctgtttcttccccatatgactttttgactaactttgttgggtgataggcatgacttctgtctctgttcacatcttattagaaacgctggacaggagaggtccacctggataattatattttactgcaggcattttcttccgtgttgactttgatttatcatcagcattctctgggccaacatttttaagtacagagacctcttaccatagtataattagatccccccattccagattgttcacaagcatatcatgagatacaaaatcaaatgtcattaatctttaatagtccctgatctcccagttcggtgttagtaataacagcagtagtcaccttatttgagaaaaagaaaggcggaggaggggggggaagtgaagagtcaaggaagaagtcagtctcttgctctgtaagtgattcactgctctcttttctaagtgcttacaaacatcttcttaattattttagatttttgccacgtatactattccagtccgtcatttccagcttctgatgccattaaaaatcagaaaatatgcctctcttcaatgctattttatgttttctggctgaagtgaaacgttgaaatgcatggaaaagaatactttgaaatgttaagtagttacgtctagagtgggtgattcttagaatgggcgttggaactgtgcctggcacatagtaagcactcagagattaacttattaataacacttttctgcattttataaaatgattatatgtgcttttaaaatcacaatgaaattcagccttttttttttttttatgacagagtcttgctctgtcacagaggctggagtgcagtggcacaaacacggctcactggagccttgacctcttgggctcaagtgatcctcctccctcagcctccggagtagctggaaccacaggcatgcatgtaccacacacctggctaatttttttttattttttgtagagactggatcttgccttgttgcccaggctggtctcgacttcctgggctcctcttgagccttggcatccaggagtgccggggttacaagtgtgagccactgcacgtagcctcagtcttgagaggtggcaattctgttttcctcttgagatctagttgggtggacaggttggagcagaggcccgccacgctgatcccggacactgggtgtcgagagccttctgtttgatgtgttctgcgagtctaggtgttgatggaagatctgctgtctgcccagtcactgatgggatcaatatagtattagaatttgtatggtgtgattctttattagtgtcatttttttaaaggcaaatttttgcagttgacacaatgggaaaacaaaagacagggttaaatggaggagaaataaatgccagatatttggagaatccagtgtggggcgggtgtgcaggtaggggacatttgttgcttcctacacacttcatcatcttttctctgtggacaggatgatggtaaagatcagtactggaattttgaattttgaataacgtaggctacttgttagcctatgtgtttttgttgttgttgtttgtttgtttgcttttagatggagtctcactctgtcgcccaggctagagtgcagtagtgtgatctcagctcactgcaacctctgcctcccagattcaagcaattctcctgcctccgccacccgagtagctgggactataggcgcacaccatcacacccaactaatttttgtatttttagtagagacagggtttcaccgtattggccaagcttgtctcaaagtcctgacctcaagtgacctgcctgcctcagcccccaaagtgctgggattataggcatgagccaccgcacccagcctagcctatgttattcttttgggtaagaatgcagcagttcttacccaaacattccttgttcctttcttgtttctctagaagcaagagcttccttgtttcttttttaatgtcagaacatcaaatgttaggattaaacaagcccatgagtaaatatttgcaggttgtagatcgggggtgttgtgggccaagtttctcccccaagtctgcctgctgatcgcttttttcctgacctctgagctttattgctttgtcacagtgaactctaaatgtttttggagacagttccaagtttgtgtctgtagtagataggggctgagatgggagtaagtatcgtggtctgtgggttctgagcttcttccatacctgtttgtagagagggaggtccttagccaagctaatgtgttctggattctctgccacactatagagatgaaggcggactgtcttctgttgaaaaccctccagaccatcttggttttgttgggcctccttagcgctgtcactcacagtgccactgtgggagtgacatggtgctgccgcattttaactgccctgaaatttcagagttgtatatcaagaagcaggatagcagagaggtctctagacagcatgatctctagagccagggggcctgggttcagatcccgcctctgtcccttcatagctgtgttaacacgagcaagtgatttaacctcttggttccacatttcacctactgtcatttgggaggattgttgtaatcttgtgccatctcattcatctggctgtggtggggattaaatgggctaatatctatagctacacagcacctggcctggcactgtgagggccctgaatctcttggcattgcttcatttccattgtcgagagcccaggtatgcaaaacaaagacaacaaactctgactttctagatagacatttccattagccacctttgtttgcataaagagaagtttatctcttttacgagatgtttttattttattaacagcgtaataaccagaaggtggagcttcactcccctgcccttaagtgtgggctgggcttagtgactctttttaatgagtaaagtctggagaaagaaaagtgttaacttacccttggagaaacccagcagatgtcaccttaacaaagtgatcaaggtcaacatcaccagtgatgggtcatgttgatgtcacatagcccctgatgtgatacggtggatgggaagggtccttccccttggtggcattctctccagaaatccataatctcaatctaattgtgagaaaacatcagacaaacccacactgaggggtcctctactgacctgcccctgtcagaagcgcccaggtctttcaggacaaggaaagacagattggaggcgatggaggagaatgacatttcagtgctatgcagggacatggtttggatcctggaccagagaaaggccttgagtagaaaaactggtggcatctgaataaagtctgtagcttggtcatagtattgtagcaatgctcatttctttgctttgacagtgtcccagctgttaagatggaagatgttgacattagaggcagctgtgtgaagggcacatgggaactcattgtatctttacaactcttctataaatctaatgttatttcagacacaaaaatttcaaaatcagaattcaaaaaccaggcctgttttacaaatctttaattagggctgggcgtggtggctcacgcctgtaatcccaacactttcggaggctgaggtaggcggatcatgaggtcaggagattgagaccattctggccaacgtggtgaaaccccgtctctactaaaaatacaaaaattagccaggtgtggtggtgtgtgcttatagtcccagctacttgggagactgaggccgggaagtcgcttgaacctgggaggcagaggttgcaatgagctgagatggccccactgcactctaggctggcgacagagggagactctgtctaaaaaataataataaaataataataaaaatctttaattcatttagaagaaaaggaagtaaaagtgcaagccccatccctgctccccattcgctcctatcctccctcccaaggacagcaacccttaggagctgctgtttctcccagacctctaagtgcacgtaaacagttttattcaaagtcttaaaaagcctttttgactcccattctgatcatacgccttagaagcttccaaccttttagctttcctgcaacaattttccaaataagtttcttttcagatgtattttggctcttccataagacttatttaagagcagcgtttggccagcgcttaatgttatttccactcatacctccaacccacccaggtcccatttatattgccactgcccttgccagtctttctaaagcctcccaaattagcatcatctgagaatttaattaacttgctgtttactaaccctctcctttcaagataattaatgaggatgttaagtgacactgggcctgacattgctcccagcggcacctgagcaggcacctccccgcgcggagcctggcagggtcgagctcctgcctttgtctacccttcagccagcgtctgggctgcatggccatgctgggtacaggcagcgatggcacatgtttgctgaaaatcagcctttcctgcctcgccttttatcctcccgttttctgctttgttaattaaaaagcctcattttacttagaatggaatgcttattttttatgttattccctagacagcgtctacattaccgggcttgaaattaaactagctgagagagtccggagttacaattcccttttgtttctaaagtggcagtgtgacgtctcccgcatccctctccccctgccctctgctttctacttaatccaggtaactagatgtgattgttggtctagaattcagcaccgtccactagaactttctgtgatgatggaaatgttctgtgatctgtgctgtccagcgtggtggccaccagccacacggggccatcgagcacttgaaatgtggctagtgtcaccgagggattgaacttttcattttatttaacttaatttaaatttaaatagtcacatgtggctagtggctgctatattggccagcctctgtgaatgatcttttatctgccctgggttatccgcggagggtctgaaatgcccagccgtttccaaaccttccccgacacgttgtttctctgaccgagaaggtaaactgatttcgccactgcattcagcaagccctaattaggaaggtaagttttccgaaggaaaaagatgttactttctaaatccaaatgtaagtgacttggattatccgtgtcactgagcgcttcattcatgcagataattgagaattgacagtgtccttttccctcaattacttcctgatagttccatgtgttacagtgggggaaacatggagctgtttttaaatagctatgctaacttcctcattaattttacctttttctaccaattaacaaatattaactcctgtggcagaattaagctggcttcccttgtgaagctacactcattctcgactcccttactgcccaagtctggtgaagctgagcttctcaccttctgttttgcagtgtgcaacccaggcagcaacatgatgttttgtaggggaatctttgtgctgggttattcacggagtagcacagcacgggctgacaaaccccagccgaggaatggtagatcccagggttgacttctgtgactcctacttgccagccacattctctttcacattcggacccagggattgcaaacccagatgcctgcaggggccatacaggtatcagaagtgggtaactggtgtggggctggagggctcctgcaccatcttttctaggtaattgctgacatgagggaatgtacagccagaaaccctgtttttttgttttgttttgttttttaatgtctaaagaggcaaaaaatcttgattgtatgggaaattggcagatttttaaatgttcaccattaattaagcatttttaaaaactcccgagggttatgaagctcccacctgcaggcttctcagccactgccaatttgccatctctagattatctctctcctgtgtccattaaacagaggagaaagccatctgccacgctgccatccactgcctaatgtctcaaggtgcttatgagaatcatttgagctgtgtaatggccaaaccctttgaaatctacgcaggactgtgtacatgtaagatgatgttattgagaaaacacctaaatacttcatttttctcaatccagatttcctgaccacttgttcttagatgtcaggatccaagattcttggatgtcctagcgtcagctcttaagagcatcttaggaaggaagcaagagcatggcatgacgcagggatgataatgacctgatttttcaccttctcattttttcctccctggctgtttaaaactggattgttttcagctactggaaggcgtagactcagaaggccacatttttgttgttgttagtaattccatcactaggttcgttcaaagtggcgtcagttacaggtattgttaagctctgaataagtgtataaccttaacccttattcctgtggtggtatttaccttgattgtagagtgagatgcagaacctgagaaccagtgccctgtgactgagcacactgacgagaaagttaggttcgaaagccttgaaaacaagcagtgaagttgaattgttctgaattcatttcgtaattgaaagttaaatggctcttaaataggtgttgactttcacgttgaaacagcttatttgcatatgaagtttgcaagcctggctttttaatttttttttttttttttttttttgagacacggtgtcactttgtcacccagggtagagtgcagtggcacgatcttggctcattgcggcctcaacttcccagggtcaagtgatcctcctgcctcagccctccaagtagctgggactgcaggtgcacgccaccatgcccagctaatttttgtatttttttgtagaaacagggtttcaccacgttgcccaggctggtctcgaactcctgagctcaagcgatcctcccacctcagcctcccaaagtgctgggattataccgcacccggcctgagcctggctcttaacttgagtttcaaaaattgtaagaaacttattttgcttatcaaagagtgtgtttaagagggtgtgtgtgagagaaagataatgtatatgttccctttattgagagcaggcgcgtgatttttctaaatgattgtataaatttgttacggggttttaggtcagggaacagcatatcactgccagaggagggaatacagccagccatttgtctccataaataaagttttattggaacacagtcatgcctattcttttatgtgctgccgtggcagaattgagtagttgagacagagatggtacgggccttaaaaacctaagcttttttaccctctgaatatttacagaaaaagttttctgaccccttgcctacattttagaaacgtgccttctaagaggctgtattcttatgaattctaggaaaactgggactaagacattattctccccaaaccgcttttcatgcaattgttgtcagctcggtaggctctggcttatttctgtgatcgtaagaatttgcttattagatgttgaatgcaatggccctggtttcatggtaactaaacctgcatccgcttctcgctaatgtcctgctagtcattttattcagcagactgagtagctttcgccgtttctatgggaaggacagtgctcattagtggatgtgctcagccttcagtttagctaaaatctgaatgctttctcaacctgaaacagtgggtattattctaaatgttaagtaatatggctctttacaaagacaaagtgtttcccagtcattattagctgcttcatcatcgttcctcatgatgatgccttgaagtaggttctcgtatcgccgtgctgattttagcactggagcagggacgggcgggtaacttgctgaaggtcacataataacaaagcccaatggcaatttgtgtcatcgcatgagtcatgttggcattggggatgcagctggcaccagcgggactgacacccagaggcaagccagtcctcctaacaggttcttccccagaaaaacccaatgatttcattagcaaggtaagtgaacggacgatcaagtaatcaattcctctttgtgtagtcagtcctaggaccctgatgaaatcagatggcaggggaggcgtcctgaatcttcaagttcccctttccacccattgtcgtcacctgagcagctgttttgttttaattttgctttattgtttaaggaagttcattcatactgattttctcactcaagcctcatggcccctggtgaggtaggtggccctattcctccttttacaatggaagagaaagctcagcgtcagtcctccctcttctccacggctgctcactcccattcccatgttctcactgcagaatgacgtggctcctgtgtgtcaatccccagggaggagggcatagcatctctgccctcaggaaccttccagtctcactggggggtgtgccacatacataaagctgattaccagcactcagggcagcagtgcccatagccgtgctgagagcccaagacttggagttcagaggagaaaggatcgctgcagacagaaaaagggcgggaggtgagatgcttagaaaggaggatagaatttggaggagcaggggctgggcacggtggctaatgctgtaatcccagcactttgggaggccgaggcaggtgaatcacttgaggccaggagtttgagaccagcctggtcaagatgatgagaccccatctctactaaaaatacaaaaattagctgggcatggtagcacgggcctgtggtcccagctactctggaggcagaggtgggaggatcacttgagcctgggactcagaggtagcagtgagccgagatcctgccacctgccactgaactccagcttgggtgacaagaatgagaccccatcaaaaaaaaaaaaggaatttggaggatctagcatggacttgtacacaggaggaagtggcctgagcctgcacctgtgtgcatacacacaacacacacacacacacacacacacacacacacacacacacacacacacacacacacacacacacacaaatagaggagacctttggaaaccgagaaccggtagagctgctggctggagacaggggtggtacaggggagtagtgggtgataaagaccctttagtgaaaggcctttctcacgtacagagaatgatgaggataatttttagaggtgattgatgaacactcattttggggagagattagagcgtgaggaaagaagcagcaggaatgtagacagacacacggggaatgaatgaatgaatcaaagccggaagaaagaccattataaaaataccagtgctaccagaacctgagactggctgctgctgtttcctctggccttatgctattatagagtcatctggaaaggtcatcgaaagatttgtgttttaagacttaagcctttaaaatacctactaatataaaagcgtccatagactgactagattaaggctagcagagcaggctactggatttgagattccaaaaagacatcacttgcccactggtgtgatggtgagcgattgactgcatcttaataccgtagccccgggagaaagcacggccaggtctgtgtccacatgccactgtgcacgcgtcacataaaaacttgtagcatgcgtgatgtgtcctgatgctttccacctggcagggtctgggcagtcctctctctagtcctcgcttccacccacctcctttgctcctccccaactcctaccattttgctcaaagaaaattttcccagtcattagttttttgagggggggaaggggggtggacagagtctcgctctgttgcccagtctggagtgcagtggcatgatctcggctcactgtaacctccagctcccaggctcaagtgattctcctgcatcagcctcctgagttgttgggactgcgggtgcgtgccaccatgcctggctaatttttgtacttttttgtagaaacagggttttaccatgttggccaggctggtctcgaactcctgacctcaggtgatccgcctgcctcggcctcccatagtgctgggatttataggtgtgagccaccatgcccggccagcttttttggtgcagttttctgaagacttgatttttactgaaggaaattcctcacagttctccagaaggttttgtaaactatcatctgtctggaataagattggcgatgctccccaccccggtcccatgcccccccagtgcgatcatcgaccacggcttcttcctgtgtcatcactgtttcttgggcctgcagtacagtgaacttactgagtgtaagcaggggatgttttggccagtgtggactggctggtgaaaattctccctgtattttgccacttaaaaataagttttaaaacgttttcccgggccggccttccagtctcattccactaggagctggagagctgaccaaccaggaggcggcatctttggatcgaattgcttggatgtcccgggagggatcttatcggggggttggccagtcagaaggctggagatcccagagtttgggcgtagctggagagggaaggaatcacatctgaacatgcaactctgaccccatgtagagaatggtccattcctcctaggtcctagaatggagagtagaggaaggtgagagccttaaccacgtgggttatatgacttggggatccagtcagcagcagtccctggcaacagttagattaggaggacaggaaattcaggaagaaaataaagttgtacgtgtgatgtgtgtattgaaaagatgtccccctcattctgactcatcggagctgtagacaagctgtcttatgttctaggaatgcctgtgtggccactgccttccaggtatctgaacactttcacaccactctgttggcttgggtggacattttatgtttagaactaaaatatgtaccacattctttttatctgcaaaggtgtgtgtggtgaacactgcccgcacacatgtagaattctgacagcctgagttactccccctgggaggcatctgcggagtgtactccctcttcctttcttctgtggtcttgatcgtctcgatggtgctcagatacctgaatcttgcaattatttgtcagtttaatagtaaaggagcatagtgatagtaaacctatgtaaataacatagctagggatgtagaagaaatggaggaatggaatgaggaggaccaactcagttgtcctctggctgggggacattgtggctgattggtggggaggggcgagcccttttgtgattcacatactaaaaaaattcaagtcactgaataaagccatttagtgtaattatctcctgtcattaaatcttatttaaacaagcaataaatattagcaaacatttttattctcttcagcccccaacctcccatctcagtcattgagggacagagagccccgtgtagaaatcaagtgaagcatctacacaaaagaaagggccgggtgtagtggctcatgcctgtaatcccagcactttgggaggccttggtgggcggatcacttgaggttaggagttcgagaccagcctggccaacatgatgaaaccccgtctctaccaaaaatgcaaaaatacaaaaattagctgggcatggtggcgggcacctgtaatcttagctacttaggaggctgaggcaggagagtcacttgaacccaggagatggaggttgcagtgagccaagatggcactactgcactctagcctgggtgacagagtgagactcccatctcagaaagaaagaaaaaagagaatgctttgtggtgggccctgatcgggaccacctggtgctgtgggacccccccccacaggcaaggagccactgttttagctcaggtgcaatgcataaagccttccaggcgcaggtgccaccagcctgccgtaggagatgtgaggcatttcagcatgggtcagagttatctgggagggtttcccagcaagaaaaggcactgagaccagaaagatcatagttggtggggaaggtgggaactgacacaagtctaattgcaagtggaatggagtggaggattgaaatctgagatgggggaagtgaatttggactggattagataggtcttgaaaggcaagctgaagacccaggaggaatagtggagctttagaaggattttcttcatctgttcaaactttcagcccacaatttttatttatttatttatttatttatttatttatttatttatttatttatttagtttgagacagaatctcactctgttgccaggctggagtgcagtgggttgtgatctcggctcactgcgacctccacctcctgtgttcaagaaattctcctgcctcagcctcccaagtagctgggattataggagcctgccaccacgcccggctaatttttgtatttttggtagaggtggggttttgccatgttggccaagctggtctctaacttctggcctcaagtgatccacccaccttggcctcccacagtgctaggattataggcgtgagccactacagtttttaagtccctgccatgaatcaggagctgtgctgagaactgaggatagaaatattcgacttggtcccagcctgtgggatgctgttgatggtgtggcggaggagcaaaggtggtttgcaacacgcacagcataggagctgcttccagtgggctgaagggcccagaggaggaagcgatggagcctggggcttggggacagctttggagtaggagtggtctgtgagctgggtctctgcatagtgcagggatctgatctttctagcggtatatttattttctcttagtctgctgatcccttagagctttcaaaagacccagttattctcgtttttacttctgtcacaatatgagactgttaacttctgaaattcagtagtgcgacccatttcatgatctttctcaactaataaaatggagttgtcacaagggcctctgtgttcttttggttttatttttcccgggggccttgcattctggagcagatgggtggtgggctagaataatagttcctcctctgagccaaacctcagtaagaatacggttttctagctatatcttgggcatctggactatttccgatccagaaaggtccaactccatgtaacatatgaggaggttatccctactagaagcctgccttgtctaacccccactgtaagacagtggccaccaagtgagcttgcctcagaatcgcctagagggcttgttaaaagccacattcctggccccatccctagagtttctgtcgatctggacagggtctgagaatttgcacatctgacattcccagagggtgctgttgctgttggttgaggagccacactttgagaactccctgctctaagccaagcatgaaaggaactgctggattcttggcgggacctgcccttagcatgggcctttctcaacgacctccacagtgggcaccctcctcgaactctcgcagcaggaacaaatgcacagcggcctctgaggaagggaagatggtgtcccttcctcatgggttgggttccccatagagccctctctggttatcctggtgagaattcagactcctgcagtaccgggctgggtgcagttgcattcaagactcctgacttcccacatcctcatctggaaggaataaccattctcaagaccaagacttggcctcagaaacttggacatcagcctcagagtggcggtttttgttcctgtccaactttagcccccggctggcctgcgcgactgtcagactttgaggttcagccttgtcctccatctctctggctgtttggtgctaaggcccgtccatgaaaggctcctcagccccccgtcagcccctttgtgctctgaaaacggtgtctcaaaaatgagggtgctcatattcagggacagcttgagatcctctaccccaggggatgcccataggtctttgcgctcaggcccattggaatgattaattggtgtcctccactctgctggacaattaaggaaagcaggaaaaggagggaaaagtcttcagtgagacctaatttggtaccatgttgttttctgttaatctattttgttttctgtccgtctgtccccagggacgggtgccttgctgcttgctgaagcatgcataactaatgtcctcattaagggctgatctgtttatcagggccatgcgaggaagccagcctgccaaacccaggcgcaagctgggggctgttacctccctctgggcctcagccccacctcattaagctggtccgggctattgattgggagcctgtgtttggaagagtcttacttactccatgcattatcttgacagattgatcagacctgattgagaacctcttaaaggaacgaacagctgtaatgggaaagttggactctgtcatccgttaggatgattctgggagcaagaagaacaaggctgacatcttggagcaattgtatttacaattaacatggttgaaaacgattgcctctattgatccccccttcctgcaattacagccccattgtttacattccagcacttcagttataaaaaggaaattcaataattattgcattatttaaagttaaagtgccacagagtttgctggctgcgcttgctggttgatttaacgttcagtaaaatccatgctgagctctccatcttgaggcggaacaatatcggcttttaatgagacttaaaaagggggtgggggaaggagggcagaacccagtgcatggggtgtttgtctgggttatttatgggggaacccaaaagcagagctgggaaatgagcagtgtcatcgtttgcagaactgtggccctctcgccacgtggccgtccgttctgcatacagccatctcctggcctcttgaagcagactcttctgtccttcctcaaagaaccatctttctcatttcactgttggtcccttgcttccctccgacaagtctgtctctttcaaccttccagaaaacaaatggaatttaaggagaaaaagtgaaatgtctgcatcagccagagtgatcgacgccagaagtgttgatttagagggagtttttctgcctcgccccgtcactttctcattctctcttttaagagaagaataaaataaaaaatcaagccccttgtacgaggcagaaggcagccttgtgggtgctgcttacctcctgcttgtgttgcgccggctgccctgtcttctctcattatgaaggtgatgaatgtatttgtcagcaaatagtaggaactcaagaggagcctctgggtttgagcaccaaattcatgctctgcagcaacaaccagaaagttgaagagcatgggaggaattttaaagagcattttcctctcgcatttggttgaaattcttctgtaggctcggttccagcaagacatctgggcaggtgcactcagcgggctgcagagcaagggaggaaaaaatgatgcctcatgctttcccatcaagagccacgctgccagcgacagccctgggaaattttcgagtgcaggtgtgaaaggggagaggaagatgaatagagccaattctgacttttatgaagtatctggagcaggccagtagcaggcagctgcttccgtgtgactttttcattaaggaggtgaattcttgtgtgcaggcattgcatgatttatcaagtgcagtttgctagaatttaagatactctttgggaaaagccaagtgcagagatttttggtcttggaaattttcctccctgcaacagaacatctccaggtattccgacttgggtcctttttccgtggccattgctgtcctggccagagcatcggttctcaaagtgtggtcccagatcggcgtcatgatgacctgggagactgttagaaatgcagattcttggggctcactccagaccctctgaatcagaaacccttgggatggccccagcgatctagggcgtagcatgcctcccaggtgcttccgatgcacgctcaagttagagaaccactgagctggaacaccagtggcatcatccatcaccaagcccacctggctgtacgtgcccatcagaagcgacgaagcaacatctggacttacagtagaaagaccatcactgtctcaaatatttgggtagttcttcacatgttccgaaggattttcacatatgtggaagttttctcatgcggtttttaaaattgctttgtgtaagacagggcaagtaaaatatctccaggttatagatgaagtagcacacccgttttgaccagtagacacgtgtttttttctgctggattgactgtcatgggattggagatacaaataagcaaattcttgagtggatttggagaatcggggaagtgtcttccaggcatttcagccgaactctcctcccttccctgctcctcacccaggatattggcagacatgagaaagaacgtggtccttgcattttattacattggtgccctgatgggcaaacagacccagtaaacacttcttgtttttttttttttttttttggcaagggcatgggcttaagctttggatctgggctctgcctacaccaacagcctgactttggcaagttttgcacttcttgtaagggtgaaggcagccctgtgtgtgttcagtatcctctgtccatgtcataattcctatatatcagtttctttattgtcaaccaaggattgccttttggagcctggggaggagtgagggttggttgtaaggagagaaataacaaataggtatgttcagtagatgttcgtttccatccctaatcctgaagattaactgatgaaaaataacattagtaatagcctcatttattatgaaggctaaccgtgtatcagacacattttatatgaattatcccattgaatcctcccagcagtgaaatgaggctctgttattgtccctgttttgcacacaaggaaaccgagacccaacagtgtatgtgacttgccctacgtggcacagctagtgagattcagagtgagggttttcaactgggctgcttaatctagagtgccccacaaaccatcattattggcaacagtttgacgtggagttggatgagcacaagctagagtaatgtgtatatggcggtgtattagttcgttctcacgctattaataaagacatacccgagactgggtgatttttaaaggaaagaggtttaattgactcaccattcagcatggctggggaggcctcagaaaacttacaatcatgatggaaaggggagcaaacatgtcctttttcacatggcagcaggaagagaagtgcagagtgaaggagtggggaagccctttataaaaccatcagatctcatgagaactcgctgtcacaagaacagcagcaggggtaactgcacccatgattcagttacctcccaccagatccctaccatgatacatggggattatggggactacacttcaagatgagatttgcgtggggacacagccaaactatatcaggaggcttttatttttgtatggggacctaaatttgggaaagctggaaaatagtgctagggaagaagtacatcttacaaatgaagaaagttgctgttcctgatatgatatcctagtgaagaggtgattgtcagattctggaagctctaggttgtttctggagagtagtttgaggttagcttggtgggacccactttgttgttttatccacctacatacccccctcagcttctgagctctgtgcacactcactcagccattgtggaaaccagtcctcattttgcttgtgacattatgatctggtaggccccttcctcagggtcctaccatgaaataaggaagatgtagggggtgttcattcaccatcatatgcatgcatagcatttactatgggcgaagcacctacacacacttttttttttttttttttgagacagggttaataatttgctcccataatggtaaaaatgcatgcctgataaatttcctccccatgtataaacagtggctccacactcctttgtggagttctcctagcagagggaagtgaaatctgtttacatggaggcgtcgacattccacaaggatccatgtttgtgtttttccaggaaagagtcaaagccaaggcaggtacaacctatagacagctatagacttagttattttccttctagaacttaactgtttttctcaaggccactaatgttgagaattttgaatcaggaaatgtgattcgtgcaagggaaaagatagaggaacgggaagtctccgctctggccttggatacggagagtgagcaatcatggcttgttccacggcctaaggagcctggcctagaaaccagaaactaggtcagagcaacccaaatggattgatctaagggaacatttttacttccttttacttttttcttataaatcatggttggggcttctatcttatggtgtctgcagggatcctacaatgaaatagaactaaattagcatgcgtcaaggacgagagcttgagcagataaaaagccagcattgaacagaatatacatatatatttaggttgaccttccaggagtcttcctaaaaatgtgacattacatttggaactataacgcgatctgactgattaaaaaattaacctcccccactcctggttgcgttacccctggaaggattttctttttaattttaggcattcaaggtgaacacctgggtctgcagagtctcatgttccagaaccccctgcagtctgtgcagcgtagcttggcggctgtggacttggtacttggactcaagtctcaggctctggtcctgtttcctccatgctctgtgtgaccttgcaggagtcatgtggcttctttgagctttgggctcctccaaggatgaaaaccaaatgtgacccacctcatggggttgtaatgtgaaaatttaaaagtgtgtgtaggctgggtgcggtgacttacatctataatcctagcactttgggaggctgaagtgggaggattctttgagcccaggagtttgagaccagcctgggcaaattggtcagactctgtctctacaaaaaatttaaaaattagccaggcatgatggcacgcacctatagtcccagctactcaggaagctgaggtgggaggatcacctcagcctggggaggttgaggctgtagtaagccatgatcgcaccactgcactccatcctggatgatagagtgagaccctttctcagacaaaaaagaaaaaaagtatgtgtgtagatgccgcacccacagtaaatgctctgcatgcatatgatggtgaatgaacacccgctatgtcttcctacttcatcttatcaagttgaggaattagcagacttactggtccccatcttctccccatccctctcaccaggtttgttagtgagattacatagtcctctccctgaagcgagaagctgaagctgttgcgtgctgtggttgctgtctttccctggacaggggtgctgtaacgggcagcttcttccatcatggggcctccagttcaatggactgagaagagttacagacaggctctcctgcctgcctttggcctgacaggtgtctcaggggttttctgggacattccaccatggggtttctcctctgctgggcaggaagcacctcgcatctcctggaatagccccctggctcagaggggctgctctggaaatggagttgccgtgtgtgcctgtgtgcacagcacagtgtgccgagagggcggccacgggtgtgtctgtagtaacaggtggtactcctgaggaagctttgtttgtgaattgtgcatgtttgtgtgtgtgtgtcagaatgtactttgtctgtttctactttaaagggcaggctttgacaaaacctgatcaatattttgcattccatgcatgaggaaccagatgttagaagtttcctatcgttggggaggaggagggagctggggcccctccagatttatagaaatcaatgttctctgacagaagttggttagttttccctgggaaacaagtaacaggaacacgtttttttgattttcacgatgcattattttctaacaagagccctcttttcgtctctttgactttcagtgtttgacgaggctgaacaagcacaacatactaatggggtagaatcccacaaagtcgcacagcggagcctctgttgtctcccttcttttaaaatgattagtttgctttttgtgcttggtgttacgcgccagcccctttatccgaggtgcctctggttgcagggagggctttgctgtgttcttctcagtgagccagacctagaagggaaggcacagagacagatgggggccgtgagatgttttcgtgtcagaagcattggagtgtcccccttccagcgaaactgagacgggatgaacattttaaaacatgagtagccctaataggattaggaagaggtgcaagaaaaggtctctttgactgacgtgagtgagccctcgtatgaaccctggcttcgtttccagccgtagctgttgacccccgaacgtgtgccaaatttccagttaatccagatgaggacagtctgttatccgctgcacagcatttggaggacttggagatcgttgggttctttttctgctcccatttatgactcaaactagatacttccttccttcatcatacttctccaagatttcagaaagtaaattcaattgccaagcatagatgtttctttctgtgaaagctacagtacctttgcagttcttatgatccagtcttttgcaggtgctatctgtctgtttttacctatctatccgtctatctatctatctatctagtctaatctacctatctgtttatctatgtagtctgtctaatctatttactgagacagggtctcactctgtgagccagggtggagtacgctggtgtgatcatacctcccttcagcctccacctcctgggatcaagtgatcctcctgcctcagcctcccaagtagttaagactacaggcatgtgccaccacacttggctaattttttatttctttttatagagacggggtctcaccatgttgcccaggctgctcttgaactcctaagctcaagtgatcctccttccttggcctcccagtgttgggattacaggcgtgagccaccacgcctggcctccaggtgctttctaaacaagcaagtgagttggagtgggagtgatcaaggaaaagtatagtcagatttaaggttatagggagaggttggcccaaccaagtgagtttgggtagacctgagttctcactcttttttggttagctaggatgacctcaagatactggttggtctcgctttctcattagtaatttgtggggagatactggattttcttgagttagctaggaggcccctgtgttttatagtattccgggaagtatattctcaaaacagtattcaagccaaagggggaatgccctcattatacccttccttattttcttagagttgctgctgacactgcctgcatcacctgcaggttaagtccctggggttgggcatagtgtgtgtgcatgtgtgtgctcacatgtgtgtgcgcgtgcatgcagtgtctcgtgttgtagacacttagactcaaaccgaaacaaacccccgccaaatgggctcaccagctggttttctttgggtccccggttggcatgcatcccagcacactgcccacagttggagctgttgttttgttttctttttaaaattacactcctgacccaacaaaggagagtaggtaggaattgtgagcacagagtaaagaaaatggaaaaagtaaaaacagaacccggttgccctcctccccagcgggtgactctgtgatagaggcggaaggggttggggaattcaggatttgcgtgggagaaaaatttcctgcctggcgaggagagcaagaactctgaaagcaggcagctcctttcttgagtgcaccactgggatttgtgccttggtggattcttcatatattacagtgaatttaattaaatacattgtgatcccaattgagggtattctaattagctgggtcaggaacaaattattctccctcctcctccaaatgaaaacatccactcccttctgcggggaaggcatgttcttggctgactgactggccccgtggagtgctcatgggcctcttagcacactccctaccactgctttttattaggcaggttccaagggtgggattctggggatgaggccagtgccacttgggaggaagggagagaggatctgaccaacagggtcgcgggttgagccgctcagggcctaggaaatggccgaatgatgtggagaaggtcacagaggtcaggaccttgctgctagctttgggtctctgtttacttccagttggacaacttaagaaataacgagacacttggaaaatctggggagagcaggacttgtcacatgcaggtagacatagtagacccaagcagaagtttgggttgggatgttaggtttatgcacagctgtttcctggcaaccaagatatagtttattctggatttttttttttttttttgagacagagttttgctctgtcgcccaggctggagtgcagtggcactattgtggctcactgcaacctctgcctcccaggttcaagcgattttcctgcctcagcctcccaagtagctgggactacaggcacccaccattatgcctggctaatttttgtatttttatagagacggggtttcatcatgttggccaggctggttttgaactcctgacctcaggtgatgtgcccacctcagcctcccaaagtcctgggtttacaggtgtgagccactgcatccggcctattctggatttttttaagtgttttggagaataaacttggaatacaaagcaagcttggaattttgaatgaatctttcatgaattttctaggagagaaccctaggtgttcactggaccaggttaggtgggagcagccgtggcttcattttcttgtttcctcttattcttttctccactatttgtaatgcatgcccagtttcttgctaaaatggctctcaaagtggcagacagaataattcatggcagtgtaagagattgtagtttaccaacatgagctagagtgtggagtggattttagaatatcttttatcatatccattttttaaagtgtgagtacccggtatgatgtttatttcaatccagggtttatacggtcctatgacccaagagcccatggatttggacatttgacatcgcatttccatccaactcttctggccatgttattcctctcttgtggctcagagattgaagactccagccatttggaatagaactctcacacatccatattcaaatttgatgtttgaaattcagtgccttattgtgaggaaatcctgtttcatagggaggtagtggggggattggaggtaaggctttagtgattcttggtctgatttcatagtttattctacctccaaaatctcttgatggaacgtatttctttgaatttcatggttattgtctctgccatcttttattcactcagttttagttgaagctttaatgaatatcattcttttggtcctggtgacctaagacagcagttcttggctcccttacaggtttccagctcctcggttttaggacaaactcttgctgcctggaatatcctggtcctgtttctggcttctgagttctgaggggcctcggggagtagttgggggaagggacgtgggctagctcatcttctcccttcacttctgccttccttctccccaggattgtaacctccagaaagcactgcctcagtgcatcccatcctcccaacatcctctgaaaggaacctcatcacagagaaggcagtgaggttaaatcattttttaaaagcagctcagaggtcaggtgcggtggctcacgcctataatcccagctactttaggagactgaggcgggtggatcgcttgaagtcaggagttcgagaccagcctggccaacatggtgaaaccctgtctctactaaaaatacaaaaattagctaggtgtggtggcttatgcctgtagtcccagctactcaagaggctgaggcaggagaattgcttgaatccaggaggcagaggttgcaatgagccaagattaagcctttgcactccagcatgggcaacagagtgagaccctgtctcaaaaaaaaaaaaaaaccaataaataaaaagtaaacaaaaagcagctcaaatttatctccagaaaagtagctttttatcaccagttgtaatttttctaataggtaacattgcactcactggttcttccaatactttctggttgtagaaattttgctttgtccaaggtgctgcatatgagtgtgtgaatcacccattttgggggcagaagggattgttctttcttggtgcctgtgaagctcatcccattcttacgtacaagttggcaagatttcctgtgggatactttagccagtttatgtcattgagggcttcaacccccctcccatgagttttctgtgacacttagttggtgcatttatgtttcttcttccagcaaagtacaaacatgcttctggatttttcacacgtgatcagtgaacacaggacgtgtgcatgtcagtacgtgagcctcagggcagtgtcccttgataggaagcactcacagggccactctggtattttcaggattgcgtggagtgcagggcattctaaccattctagcttgtcagtgtcttgcattctaagctggacaaggatgagacatccaagcaggactagaaaccattatcctggcataaacatcagacagaagcagtgtgggtcagaaaggagacaagcaacgtgggcagttctgagacgtttgttgtgtgcctgccatggctccatgggccaggcttggctgactgggctgggggttggggacaggtggtgaggagaaaaaaggaaggacacgtaatcacaggagcacataaagcactcacatgacctgaatttcctccttcaaaaggatgctgggtacatggctggaggagacaagcctcagcttctacatctctctctccccctaactaactgggttaccttgggtcagtcatttaagcttttggggagtgtttcccttgcttcatgtgtacccagtggaagaattccctcttcccctaaagtgaatcattggaatgaaggagatggcctttctacaccaggtgcacattcattctctgttagtcaaaaagggtccatagctatcattacattcccaggagactcagaaacattgtgagttttgttgttgggtcgtctttaagtcttcctagccacagaagcctggggtctgccacctgtctgcatcatgacctcttctgttctgataccccagacatgaatcctgtctgtgcctgcctcctggaggctcttaggctgccatgctctgggatcaatactgtgtctactaagtacaacagaggacgtaatttggaccatctgaccatctgatacaccaactgaccaatgatattggccaatgataagccaggggactttgagatattgacagggaactagtctggagaaatttatttttctggcattttttaatctaggtgaaaacctaatttggggttctcccagtagactgtggttttaaatacaaacactggagttgtcttgtgaaaaagccagataccagctccggctccatgttcctgacctagggtgccatacaggcaggatgaccagaggctattacctgaagcaggggttggcttaacttttcctgtcataatttagcacatttctatagtaataatctagactttgtggactataccatctctgtcataactgttcaactctgatgtttcaaaaacatccatagacagtatgtaaatcaatggacgtggctgtgttccaataaaactttatttacaaaaacaggcagtgggttgaatttggcccgtgggccatagtttgccaacccctgatctaacaagagcaggacactttagagaataaaaggggaaacctttaaccttgtgccaggaaagccggtgttgcactgggagggcccatgtgatcaggattatcaacattctgaaaagccacatggctggggccatttgggggagataggaatgggtatcagcttgctgtgttttttcaaagaactgctagagaagggtgctgggtactctgggggaaaaaaaaaaaaaaaccctctaaggaatctcacagttgaagacctcattagtccattaccgtgctgctactaagaactgcctaggactgggtaatttacaaaggaaagaaattgactcacagttctgcaggggtggggaggcctcaggaaacttacaataatggcagaaagggaagcaggcatgtctttcttcacatggcagcaggaaggagaagtgctgagtgaagtagggaaaagccccttataaaactatcagatctcatgagaactcagtatcacaagaacagcatgggggaaccacccccatattctaatcacctcccacaaggtcctatccccaacacgtggggattacagttcagattagaattcaagatgagattttgggcggggacacagccaaaccatatcaaagactgtcctgtttggctgtggagatgtgtcccctggaggcatgcctctggctgtgaccaggatggtgtgggctgatgccagtggccgcttcgagtggcttacccaaggcatgtctttctcttttgttacttgcagcacctgcagcagcatgagagtggtgtagaaggtgagagctgctactaccactgcgttctgtgcaactactccaccaaggccaagctcaacctcatccagcatgtgcgctccatgaagcaccagcgaagcgagagcctgcgaaagctgcagcggctgcagaagggccttccagaggaggacgaggacctggggcagatcttcaccatccgcaggtgcccctccacggacccaggtgagtggtctcacaggcatgggaggcccaggttgggcctgggtgttcacctccttgagacctccagaggacttctgtttgagggagacgttactgatccagctggtcctcatgttccttactgacttcacaggtgagcattgtgttttggaaggaacatgcagggattgttgcctgcccgcctttctgtctttttttcttttcttttctttcttcttcttcttcttttttttttttttttttaaaggaaattggcagcacttttcttggagcaaggctcagtcttagggaagtcacaagctactacccagggagcaggccaacagaagatactctcctctattctaagattcctccagtacatactttagattcaatttattggttcaaattgacaaagcagatgctacatcgtgtgtcctgcccagtattaagagtagtcaatttgtggcctcaaagtctggtctgtaaaactgaactttagagaggaataaaataagtgcttgttataaaaatttcagttgtatttgggagtgattctgggtgtttcttgggtccatgctgcttgctgcttcaatgcgtcgagacctgctagtgggagcttgcctcgtttctacctccccatgtcatctccctgcagccacctttttccccacctccctccctccctccacccatgactccgccttccatagggacttcattgggtagaatcacctcctcttttctattttttcaattttccagtctcttgctctccacttagacacacaagacagtcacttacctctttagaaaccaaaactttccaagaaaagctctcctttcatcctaggccccacactgtctctacaacagaatcttccagattcttgagagaaccctgtgaactgctcacctctattccatgtctcaacctcctacaacccatttcctctgtcaccaagccactcttgggagggcgctgctgatctttgattgacacagcccaggacctgctgggcctgactgttttctttctgcaatgtttgaaattgttgcccagccctttcttgaagctcccttccccttcccttgccttcccttggcttccggggtgtttttctcttgtcctctgacttcccttgatagttctgcaagcctgactctggctggtggttctcagcctgccccatgtccctgggcacagggcactgtggcctggtcctcggctcccagcctcttgagcttttgtgtcctggtgctgccaaatgcctttgtacagcttcctggacaccactggtcccacctcccagatgctgagcttcgtggacatctcattggtcccacctcttgggcacctggctcaccactttctctgccacacttctttttcttcttaatggcagcttgtctaacggcctggccaagccagagacccaaggccactcctgatcctacagtctcctgcagtgccttctcagccattcagccatcatggatgtgtgcagttttaaccttaatataatcaaattacacatttttatattttttaaaggcaaaaagttacataaactttatggagaagagcatggccctctcccacccccttttccaggggatcagctttcaactttcagatatttcttttgttacttatttccatgtttcttctcatacttctacgactgtttcttgtttttaagttttagatgttacctcttggctttctacctgggcagatgagaatttcaccagtgtgctgttccacaaacccacccgtgtacacacctacacccataccccaaccacagactcacgcagacggcacacacaccagcccgatacctcatacacgttctcgcacgtgcgcgcacacacatacactttctctgcatcctacacattccatccacgctcacatacacagcccacagacaagacaccatacccacatacgttgtacacacacacaccccctgtatacactcacacacccacacaagccatatactacacccacacgccccatctgcgtgcacctcccccacatacactgcaccccccacatgcaagcatcataaacacatagacactgtacccccacacaccccacacacactgacatgcatcccacacgcaccctcactctacccacaaatacacaggcactgccccgcacactcctgcaccccccacacaacagttggactccctcccactccccagctccctccacactcagtccttcctccctccaccttccattatgattaaataataattgggggttatattaatattcagtgttttcattattataactataaatattaatcgcagctgagccatgtagagttttataatttcatttaccttcttgtacaacttattgttttctctggttttctaggtacctatgattaattcatggcgaaccttactctgccagaagtagacatttcctaatctctgaacgctctgctctatcagtttttctgtcagcttcatttcctcctggaggcgtccctcctaagcccctccaaagccctctgcccacctgctcctctctggatcatctgactgctccttcgctgcctcctcatataaatgaaacagcaattcccaaatgatgggatagaccacaattcaagaatttttctccttgctagagtggttgaggtttcgacagtcagtagaaattgtttgttcaggaaagggctgttgggtaccgggataatttttgtcacttgaaggtcactgcaagactgtcccttccatgtgtttttcaaatgcctcttctggttaaagttgaaacaccttaattggtggagcttctgctttgcctctgatcccatccgtctacatgggagcactctcaggagtaagggacgaggatgggcctgaggctgaggcccctgggccatctggctgtaggggagcctgtgccccacccagggattgtggcctctgtttgatccgctgctctgcattagtgcactgttgagtcattccccagattctccttctttctaccaacacacctagacctgtttcttgctcagggtttgtgctttgtttggggtgtttttttggccagctctgcatacatcattgttttaatcatctgttaaaagctggtccatttcacccttcaattctttcttttactctgctcagaattccttttgtattaatgaggtgccccacactaaacagtgtacagctgccatttcacccagagtcggtgacctggaacaaacagttccctgttttggaatgtagtgcttccgtggatgcagcccggcaccagtgccttcgaggttcctctcatttagtgcatactaggggtttttcccccgagaagtgtgtgagcaacttcagtggagatgatagacttcccttccgtatgtcaagatgctttgggattggctttgacctggagtcatgtttttgctctctcccctactccctccctacaccatactcctcccctcccacacacaggctccagttcggtccatataactgatgacaaaagggacaaagtattacgtattatttattcatattgacattaacaagaacttggttccgttttaggaaccactttaagaaaactcatcttaagatgtatcttccctctccccaggggttggctcttcaaaacttgaaaggatatcttcaagagaacggacattatggacctggtagaattgagatgtttaagatgatcaacttcaaattttgtaaacatcgactttatagactattcccaactctgtcctctttaacataagggtcaggacatgatttttcagctagaaatgtcatcctgtggcatcaggagcattaggaagtcttggtgcaccttttaggagccccacccactctgaccagaagctccccatccatggctgtgctgtctagagttggaagttctggctttctgtcatcatcctgctaagtgatgacattccttctcctttcctcttctcctctgttgtccacatgccacagaatattacacaaaacccttcagaaataaccccttgtcctttctgagttctggacctcatccccagtctcatgtcacctcctacaggtatctagatgtctcctcctaaggcaggaggggtgaactctgcaatagtttctgccctgtggatgattctgcaatagtttctgccctgtggatgacaaaaaatacctattcccagtttacctgttacttaagtcacttgtttgccagtcggtccagttcatcatgtagcctgccaacccatgtgaacctgtgggtctggaggaaggagtcgaggtagaagaaattgcaaaggtctcctccatcccttcagaatcttctggtagcagccaggatctatatctgccatgactggctacgtaactccttgagaggcctcgtggttgggcacgtacatctaagtcctgccctgcaccagtggacagagccttggccgccagctgtgtgctaatagttaggcttctgtgcccatgtggccctgccatggcggagctctgcccttatgtcagtgggcaggccgagtcctgtggtaaattgtctttggttcagtgtgatggtctttgtcgttacacttttccacccctaccccacaatagacacaagcacacaagcctgctgggccttcctgttttaaaaatggcttggaaatacatctctcaaagacagtaactaaccaggtgaggttcctcttccaatccccacaatttatttttattggcttgagtgttttttctgcaagaccaagtagtctctggaattggttgggatttcgtctcggcatttcatacttacccacccacaggtagaaaccactcgtcatcactggccaatgcactgggccagagctctgagttgctggcatctgccatttgcttccctggtttaccagaagctcttgaaaaatggagagctctcagaggtgggtcatgtgtaggatcagcttccctgtttgcttatttaaaaggcatttctggctcctgggtgaaactgtagttaacttcattctatcaagtgccctgggctttgagaacacaggccctttgtgtttctgctgtcggcctttctccttctcctcctcctgttttctctcttactcgccttgtcctaagtactttttctttcatgtagacatagacctccaaattttacatgcatgtaattaaagttcaacaattctttattgacgacctattatatataaggctttttatgagttggagaacatagctgatcactgatctcctctgcactctcaatatggacacactgatgactagaccagctcaggcattggaaataattggacccggactcagtttacagagggtgcacgatcattcagaatttaagagacttgttttgcttggagcaaaaagcagtatcctccctttacagatacgtctttggcattcatagtagcgaatttctggggccagagaggtgcacacagcttgccaagtgataatgtggttttggtgacagcctttactgcaacactcactggcctcatttgatgaatcactttttaaaccaagtttcagggtgttgtgcttaatgtatacagcttaagagttaagagaccaagaatatatactgtcttcagctttctcacttgattttgtttttattttgcaaagttggtgtaaggctgccctctaaatataaagtacatctttttttttttttgtaaatagctaaattatatgcaatttcagtgtaatttttctgatagcactaaaatatgttgtggccagctctgaatttctgaaatattgtttttataaaatcagcacacccacgctctttctcctttcctttttactgtatgtcttgtttaccgggtttggggaaggtataggaacttaaagtatttttaactagagaagttaaatgtaaaagtgcatcaaaacaaatgggggtgactgaaattttaagcattgatggaggcatggggaaaacatgactttatctgtctaaaggacattccctgatgaaggactgtttggacagggattgtaaatttcagcaagctttttagaaagatgctttacaatgcaagggtaaagagaggtcattatgtatgaacatgaaaagagaacataatgttgttaaatgaaaaatggagtttacaggataacataggttgattcctttttgtaagtatttttcttacagcttttaaaatattcaagcaaggagttagtgactggtgtctctggctgttttggcggtgggatgtatttatatggactctaacagaatgtcagatgtgtggcaagggctcagaatggtggtggtgcttgttgatagagattttagcagaatcactaacaggctacgaagaagtaaatcttggttgtcttttgttcatggagatgttttttatttgccaatattcgtagtttgattactctgtgattctcctgcattttgcatttacatagagaggataggagtagttctcagggtgtatactgtcttgtttttctgttggaacagagttcttgatttgccttaattagtcctctaacaatctgcaaaggtcagtgccaattgcctgttcatttacatttgtaattgtgatggcttctgattacatattccttgtcttagtccatcctaagtatatgctagtgtgtcctccccactacccgctacacacacacacacacacacacacacacacacacacacacacacacacacacacacacacacacaccccagagtggtgtgaaggccaaaaatctgactcctcatagaagaaacctttgtagcgactgcccagcctcactggcacttcagtgtctgttctggaaagccatcttggagacgctattgcttctaagttagggatataatgaagccagagtcagggaaattacgtcgataccaggcaagaaatctgagagccattatctaggagccttgttgaactgagtaattaagggcaattaaacttttctgcttgctctctgcaaaatatgctaatgatctggtctgctggaaggtggacatatgcagtgctgtttcactgctgtcagacgctgctgccctggaaggtccccctggagaaggtgtggcatcaccaggatggtcaggtgggcagtgggttgagcgtgcagcctcgtacccagcctcctgtgtcctggctggctgttccaggacttgcaccttttcagcagttatctagacctggccgcagtggcctgagttgcagtgattcgtattcactcattctttgatgttctagatccaccattcattcgttgcgttatttttctgggatgatgaagctaccagggttttgtgcgtgttgtttcagcatatgacacgtggcaccagctgtacactgcccttctggttagtgttgttcttggtcaagggctccaggctgtcttccatgctatcttcatgagtgggtggcagcacgtgcccaacgctgcccactgggagaagcattgatactgtggccactcactgcagagagggttttttttggcacagcaaaaaaaaaaaaaaaaaaggaaaaaggggtacctgctgatggttcctggaattaggagagacagtatatgggtgtgtttgcatttgttgaggggtgagcattgggcgggggtcctctttttaggggtgtgagtatgccagagacccccgttggctcatcagagcccagtgacatggggacccccaagggagccacaggacatcatgtcataccaagtgttctttctgtgaaacctttatttcgaaacatcccaagtcaccttcgaaaggtgtatccaagaaacttgaaaatctgaaactccaccctaaagtgaatatggatagctagccagtcagtaggtgtttgtgctgggctgggagttgggggtgctgtccctggatttgggggtgctgtccctggatttcactggaggggagagacctcctaaagccgacagtgtagcaggaagtggcagccgtcctctgctgtctcctgccatgtgtgcagacccctcccatatggatcccctatcctagcctctggagttcacactttctccactgcctgaatggatgtttctcgagaaataatgatttgtacctgtaccgtctttaggaatgtccaaagaatccatttctagggctacttacatcctatatgaaacttgttcccgaccttggtaggggccagggaggaaatagaacatgcatctatctctctgcgtacagaaatagctcaaaggctttttctcagagtcacagatgttaaggaacccccttcaaactgtgacccaattataagaattatggttccaaattattttttttcaaacattgacgagcagtggaaagttttgtggcctcagtctaagtgctacccatacctccctggttcctgggctttctggtctcctgagagccacaaggaagcttctcaaaattctctattaatgctaaataaaattttaaatccagtttctgcatcatattaaccagatttcaagtgcttaatagtgccatggggctcgtggttaacttagacaatacagatttctagagcagttcagaaggttctgttggaccatgctcagctcctcctcactgggtttcctcagacttctggtagacccaggctaggtttggggctacattttccttaatattttttggcttgcattttagagaagtgtggttcccgccagcctggatagggtacatcttttcttgctgatctttctctctgtttcacagtttttctcagtttgggagaacagtcttcaaataagcatttaattttgctttttgctacttatgtcttattccattagcagttttgagggactttgaaaggactttgtaaagatgtgtttttcagagtggatgttaaatgggtttttatagttttatgcctcaagactatcttgagaccttttgtgtatatgttaataaaaggagccatttattgcttttaaaagatctttgacctctgctctaattagaatatcaaaaatcagacaatgtgtgattttcctggtacagggccatctgttgtttcaacccaaaattttatcaaaaattgtcatattataaagtcaaaaaagaatgtgtgtatttttcaccccccgtttccattggctggctgaaacaaaagaagtgtattttctcacagttctggacgctaaaggttcaagatccaggtgccggcaggtttggcttctcccgaggccttggtctcatatagcctggtctctgtgagtccccctggtgtgtctctgtatgattaggacataccagatagattggattagggtctaccctaaaggcctcacgttaacctaatcacctccttaaaagtcctgtctccagtcatagctacatcctcaggtactggaggttgggacttcaacctaggacactgggaggaccacagttcagtctattacccagactttctgatatctgaagccagtttcttgtttccttttctgtggtcactttgggtggggcaggagggtaggacagaaggtggtgggagagatgaagggaggtcatggagatcctggaagtcgcctcggacagaactgtcagcgcccaccaggccttctctggtttcctgctcgcagcacacggttctcagtgctggccttggcatgggattaactactgcgacctcgctggaaggggactccaaatgaagccggaagtgctcaaagacacttgttaggacaggaaaaggggtcagagccctgtgtcctctgagcccattttaccatgactctttccttgcctgttctcacacagccctcaccgaaaccttcttgctggcaaacaccaagaggactgacagccggccacgtggaggaaggttcttgtgcctgtgaaatttgatggtcttagcatcgagaaaagctgcctttgctgaaggtgctccagcaggctggcctgtgttaggctcctgttggagggatttatagaaataaaaactccttagctgggcatggtggctcacgcctgtaatccagcactttgggaggccgaggcgggcggatcactagagctcaggtattggagaccagcctggccaacatgatgaaaccccgcctctactaaaaatataaaaattaggcaggtatggtggcgggtgcctgtgatcccagcttctcgggaggctgaggcaggagaatcacttgcacctgggaggcagaggttgcaatgagcagaggccgcgccattgcacttcaacctgggcgacagagcgagactccgtctcaaaagaaaaaaaagaaatagaaacccctccttgctgcccactgtgcttttagggactaagcagatctccctgggcttgtgtgtggtgtttgtgctctggttggggtagatgctacctagagccttacaattttctatgacccattagggtatagaattcaatagggggccagctgattgactggacttccatccaaaggatttcagttgctcgaagtacctgaaggacttttaattccttggtttttccttaccctgtgttatatactccaggctggacataatataaagatcccagtgtgtatattgttaccttgtgtagctttcattcggagcccgtccttcacttgcgcttccagggcaagtcacatcctgcttcccatggctggtctttcccagattgagcctgtgatgtgagcctcgagggcagcctccacagggccgttcctgtcctgcacgagcataaagcagaggcgaactcggacccttcctggcaatcttggatgtctcatgtcgctaggttcccattgcagcggcccatctgtctcagtgccatgtggctagtggctgctgtattggatgtgcagacagaagccatttccttccctggagaaggttcctgaggacagggctgctgtagacagcagcagagtagggacttggtacagaggcccagggcccagggctgtgctcttcccactgcgtctggcctccttgctgcaggctgacaaactcatccacgggacaagtagcactttgccccaggggtgggattctttgtgtctagataacagtgtgatccattgctggattctctccaggatagaaatgaagaaatcctaagactgcggtgagcaaagcagcagcagttatctgtgactctgcacactccagagcgcgtgcctcgggttgctctgagaagtggaaacagtttgcatggttttcctaatgtccaaagccctttgtgacttccttgtgtgagtccatttcagaagcattgagaagccccacagcatggggagggcagccctgatctgattggccctggcaggggtcctcactggagtggcttctagcctgtcaccggcactggcaccagtgaagtgcgtgtgtgatgaggatgtagcctggccatctgctatgcagccttgaacccagcccacatgtttttatggcaataatgggaattttgtagtagatgtcagctggacttttggtaggtgagttttttttgtttttttgtttttgtttttgttttctttttttgtagagacagggtctttacacaggctggagtgcagtggcacaatcatggctcactgtagcctccatctcctgggctcaagtgatcctcctgcctcagtcttccaagtagcacaggcatgcaccaccacgcctggctaattttttcatttgtagacagggtctcactatgttgtcagggctgttcttgaactcctggcctcaagtgatcctcctgcctcagcctcccaaagttgtgacttgccctgttcaggtttacaagcccactataattcaggtgtgagttgcctccttcaccactcaacccgtggcccccagttaagggggcttctttgggcagggaatagaggcgccatgtctccagcaaccttgagtacagggctgactgcaaggaggaggggcctgagttgacctgaactttgaagaatccacgcacgtgcttgtctgggatcaacatagctctttggggctctctgttttagcccagggatcagaagttttttttctaaaaaccaaatcctttcctagtgactcaccgcccaagtatgaaacacaggaaagacttttgtccttttaacttgaggacgagtcgtctctactacaacataaacaccagacacgaagaatgagaaacttactgtgctcagggtgtgtgctatgatgactaaggcaaattgagattctcctcctacgctggacactctgatgcgtggtcactttccgcagaccatcttcatacagaagaccgtgatgtttatttccacaataagaatttgatctcactattagatattgtaacaacaacaacaacagaaaaacctacacagtgccttaacacctttgttctcttggtggccccagcgctgcgagtccagaggtcattatccgattcttgagggctgatgacctacttctgatttccatatctagctggccttggacagacaggcctgatcgaattctgcagccatttgattccctgcggacctgtgcccagaccctgggcggatctgaagacttcctcagaacacataagaccggggagatttgtgccataccgggctgttttctctgagctttgctttaatcaggaatgtagactattttttggttttggtagatggcgtgcaggggcagggcatccagtcattcctgtaaggcattattacagggctaattgggaaatagtgattctttttcaataactattttggaatcacccccctttctcccccgccaagtctctgttccccttgggattgtcaggctcacgttgaaagacccccagagggaaggatgttggcatatatcatagatatctggaaagaatgtttcaaccacacctggctgccgtgtgtgaggacaaatttaatttattttaaaaatctggccacaggcggctttttctgtttgtttctttaggggggaaaaaaattgaaaagcagcagcaagctatggttcacatttgttttcttccagattggaccagccaggagaagagagattatctctaaaggatatgaaaggtttaatcattttaattttgtttttattaaagtatatcataactttttttttttccaacatgcctgggtagaacaggagagaagaggaggtaatataaatatacagaaaccctcaagcatttggttaataaaactttccaacgggcgatgcctcgtggggaggaagtggttggatggctggggatggtgggccgactggggaaggcggtgactgcgctgaatcgtagccagcatcttgcaagcttcctgtccagttccagcagacacttgtgggagctcagagctttcatgaaactgaatgagaagaagctctgactgtgggcttattccatcatgtttctcaagcgagactggatccctgagccatctgtggctgaagaagtctgaatttacagagaacagtaaaatttgcttctataagattcttccacccctaccatctcaatgaaatatttgaacccggttattttgaaaacttgctttaggccaaaacctctgaagttgcatgcatgcacgtgtgttttatgaagcggcgaagttgggataaaaatagccttagtttttgggtagaaaaactatcctataaattatggtgaaactgagtaaccaggatgctagattaacaggattttaggctcgttttccctttaggacagaaaaataagctcatttcaacattaattcaattgtcaaaaatcaccggggcatgggctggagttatcatcacaggtgttcactgtggcctcccctctcttccagggctgtaaaactctgcaaaggcgtgactgtttggaattccagccctgggaccgggcaggttgttgcatcacctgataatgatgaaattatctttaccattatgttcttacaaaggcttgaaatttgacttgcacattttagacatcgctttaagcagcaggattaaagcattgtcatctcgttacacctgacttaacgtggcagttcagttaaccctataccagtctttaagtttttggctgcattagcgtttacagtactttccacagcatttttatgggcggaatggtttgttcatcaaggagaagcagctcttctagtgaaagctgcaactccagttccctgaatgaagtagaaactgcactgaggcttcaacttagccgtgtgagcaatgatctggcctctagcaggctgtgtagatagtcacatgttttatgaaatttccctcagggattcccggggcatctgggctgtgcctcctggcacagagggcttccaagaggagctgtgttggatctgcagcctccctgcagggctgggctcacaaccaagccaggtctccccgctgggaaagggatccagagcccagtttctgcccccagtctgcaggtatctgccgtattcagtgagctgtgttccaggtggaagagcggccaggccaccttactggcctgtaagtttggaattccctatgggagttccctatgggaattctctatgggagttccctgagccagtaaggggcagttttcttggttaatctcagctagagttgtatgagcactaaaacggaacaaacactggcccatatcattctctgtgagcttcttgatgggagcacagcatcaacaggttaggcagccccctttcagaggaagagagacctgacacctactcctgtccaggacttctgtcccaggttggactggatgaccccagcagttgtggtgtgtaggtcttggtccttgtttttgaagctgtatcacaggctatgaagacagcagaaggtgggggaaaaaaggttattcttttgtttcacaccactcagctatagatcacagaatcactccaaagtggctttaatgagttaggagggcatggtgtggtggcttacgccggcaatgccagcactttgggaggccgtggcaggaggatactgggagcccataagtttgagtctaccctgggcaacacagcgagaccctgtctcaaaaaaaaaaagaggtttcatttttccttatataagcagccttgggaggagggcagtcaggtgcagaagtgaaggttccactgagtcagcagacatccactttccttctatgtttccatgtagccattctcaccaagcgcttgttgcctcctcatggtctaaagatggctcctccaggccaggcgcggtggctcacgcctacaatctcagcactttgggaggccgaggcgggcagatcacgaggtcaggagatcgcatcctgactaacaccgtgaaaccccgtctccactaaaaatacaaaaaattagcctggtgtggtggcgggtgcctgtagtcccagccactcgggaggctgaggcaggagaatggcgtgaacccgggaggcggagtttgcagcgagccgagattgtgccactgcactccaggctgagcgacagagtgagactgtctcaaaaaaaaaaaaaaaaaaatcaaaaaatcctccatctgagctccaggcacaagaaagtgaggctggtgagagtgcatgcgtcacgaaagaccacctctttaaaagtttcctccaaagccccgcccacttgctttatcttacatctcattggctgggactgcatcatatgactgtcctcgggcacaacagacaacaggttttggctgagggtattgtgctttgaataaagtgagtgttctgttagcaaggaagtatgcttattacgaaggcaattagaaacatcagccatacgccttttaaaatataagaagattaagtaaactgtgttacgattatgtggtggaaatctgtgtagccattaagaataatgttcttgattaatatttaaggatatggaagcaagctccgtagactgaggggtgggtagcaagacccaaaaacacatataattgtcacagtttcctttaaaatatctatatgaagacagcactgattatggacaattttcgtcttcatactttctctgttttcaagatttttgacaataggcacttaggcttttatgatcagaaaaaaattggcgaacttgaagtgtaaggagcagaaaacctggtaattactacctcgtatatgaactatacttgatggaaaaaataaaatgagtaataaaagggaaaatctataaacacgtagtgataatggaatgatgacgagtagctgaggtggtacggattcatcaagaacaaatctcatcatactaataagataaaatgaaagaacgtacctgaattctcattgaaaagggaagtcgtgcaaatgcaaatttgtattctggggcctctaaatgtgcagcagaaacatttgccattttctccaagcatgcttttggagtcattcagaggcattctttccccttcattcttgcattgaaaacattagggcatgttgagctttgcagctgtttattaaacatctgttagttgtaaatactggttgctgtgagggaatataaaaagaacagaagaaatgagcccagcctatgatcttttggaaggatgggaaaaatacgcccattgaaggttaacagggttcaagatgatccgtagtgagtaccagagagtggaacaggaagtaaatactctgggccttcgagggtgaggaattcctggactgaatggtggggaagctctaaggagagagtcaggctgaaactggaaagataaatcagtagagacagaggaagaagaccccaggctgttgtgggagttcaggactctggtcgggagccaatgagcaggccattctgcctaaagagaggatcttgggcagggccaaaaattgcaatcccattttcttccatctttcggaagtctagttttgcccatcccccaccccccaccatcttttgaaaggcgtgtaggtgagtgtgaatatcatagatttatttaaaacaaatacatggccaggcacgtggcccatgcctctaatctgagcactttgtgaggccgaggcgggtggatcacttgaggtcaggagtttgagacgagcctggccaacatagtgaaaccccttctctactaaaaatacaaaaaattagccagacatggtggcgcgtgcctgtagtctcaggtactccggaggctgaggcatgagaattgcttgaacccgggagacggaggttgcagtgagccaagatcaccccactgtgctccagcctggatgacacagtgagactctgtctcaaaaaaagcaaaacacaaatacctgaaaactcctatttttctcgtaatctcctaaacaaattgagaacctagagagtactttcacatgttgaattctgagtaaaaagaaagccttaaagaggggaataatatgttgattttggggctatttgtattggaggggaactgcaagtgctgataggagctctgttttcattgaacattttcctcaatatggaaacaataagtagtaaatgaaatttgcatatcatctgaaatatgcataatatatataattgcaatacttaagaatacaaaattatataattggactggggatgttaggaatcttattttaatttcaatttgtaattccttgaaatttttttttttgttttttgtttttggagacagagtctcactctgttgcccaggctggagtgcaagtgcggtggcaggatctcggctaactgcaagctccgactcccgggttcatgccactctcctgcctcagcctccccagtagctgggactacaggcgcccaccagcacgcctggctaattttctgtatttttagtagagacacggtttcactgtgttagccagtgtggtcttcatctcgtgacctcgtgatctgcctgcctcagcctcccaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattgcactccaacctgggcgtcaagtagcaaaactccatctcaaaaataaataaataaataaaatgttgatataatttcagacttatagaaaagtaatgtactttacatagtaagaaaattctctcacctgcattccccaaatattagcattttaccacatttccttttttgacttctctctcgcattcataatcttactctctccataaagacggagaataaatagaaatatacacattgccatttttttgggaaggatttcagagtaaatttcacacatggtgccccttgacatcaaaataagttagtgtgtatttcctaagaacaaagatattttacataaccacagaacaatgatcaaaatcagagaactaacattgctataaaactattaggttattatagtccttattcaaattttcctaataatatcctttgtatgaaaagaatatcttagatcacaaggtatatttagctgtcctctttcatgttctttcttttttttttttttttttttgagacagagtcttgctctgtcgcccaggctggagtgcagtggtgcgatctcggctcactgcaagctccgcctcctgggttcatgccattctcctgcctcagcctcccaagtagctgggactaagggcgcctgccaccactgccaccactcccggctaattttttgtatttttagtagaggcagggttttactgtgttagccaggatggtctcgatctcctgaccccgtgatctgtctgcctctgcctcccaaagtgctgggattacaggcgtgagccaccgtgcccagccgtttttttttcttttttctttttttttaaagacagggtctagctctgtagctctgtcacccaggctggagtgcaatggcgagatcttggctcactgcaacctccacctcctgggctcaagtgatcctcccacctcagcctcctgagtacctgggactacaggcatgcatcaccacatctggctagtttttgtattttttgtagagatgatgtctcaccacattgcccaggctggccttgaactcctgggctcaagcaatctgcccgctttggcctcccaaagtgctgggattacatctcacctggcccatattctttaatctagcattgttcctctgtcttgcccttttatgaccttgacatatttgaagagtgtaggtcagctgttttgtcaagtatccttcaactgggttcatgtgatgcttccttatgattagaatcaggctgtgtattttggtagaaatgccaaaaaagaaagcgtgttctttctcgtgtattgtttcatgagatacatgatattgatttgtctcttgattgcgggcatcagctttggtcagttagttatggtggttccttctggggttatccattctgaagttactatttttccctttgtaattaatgagaatctagtgaggatatgcttggagatgatttaataaggaattgaattgtttaaatgagattgttttgaaaaaatggctaataaaaatcaatagggagaaatatttggcaaatgaaagtggtggtcattaaggtttatttttagcctatactccccttcccggttttctagatgatcaggaaattcagcaggctagaactttaaaaagactgggaagaattttctaaaatgtcactgatcactcatggtgtcaaacgaggaatggaggctttgggaagtggacaaagaaactattacagaataagaaggaagatcatgtgttaccttggacagagcctgggtaacagggtcttagaatgtgaaagttggtattatgataaattgtaacttatttctaaatcttttatttaagaaaaaaaaacacctttagctctcatcagtgtgttctgctataactgagcctctggttggcgagggctctggctggctggtccttgaaggatgatggcagaggggctggtaactgtgcaagagctcacagaagggaaagtgaaggctccagggccaggcttgctgtttcgtgtttctagtctccccagtattttttaaatgtaaggcctggtaatagcatttgattaattttccattttctctactaaaactgttaaaaatttgaagtccttcctgccttcctttccgtcttctctcccttatctgaaggaaatgaatgagaaagcagatgtttgccctgggatggctcagaaagcatagtctcatcttcacctttcaccctttctctgttatttggattttggaaatacagccttctgatttttttcctttcatgtcaaatcatcgtcagctttttctcctgtccattcttagaattcctgccaagacccactcttcctttctggaggtaattattcctgctttcatctccaaggctgttatgtacaatagggttgtttcttacaactcctgaggtgaacagagggctactgagccttgagcctggagaagcaatcaaggtggaggtgcagaaggtgaccaggaggctctctgtgcctgaggaatctcactgtctaacaggagaagattcctaagaagcctgtcgatgtggaccctgaaaactgaagatctgccagtgtataaaggtcatgggatgtagttgtagccaaagatagagcgcgaacgggtggagggggagaagcaaggactttcccctctagggagtgcggagccctgagatctgggggacctggcaaagtcacctgatctctccttgttttagagggtaagactggctccccagtggaagatggaagaatgtgagggaaagcttatgtaaggtgcaggatgccagagggtctaggttagagtgagacacttaatgctgtttttaggtggttccacctgggagaaatggggaagagagcaggtaaggatgatctgaggatgtgagcttgggccttggataggcgctgattctccaagtgggagagaataagatgaagggcaggaatgggtaagaagggagggtgaaaatgatgttatcatcaaaaccacacatacctccctcattccccacttttgtaaatgaatatagcagtgaatctgtaccactgacccttgcacccaattatatttatgtattacttatgtatctcatgttattccaaaaagattggacagcctcgtttggctgattacttagtatttgcttactattcatccctaaaattggaaacatcttggggcagggatcatgtcttacattacttttgtccagaatctatcccattcgtcagtggctcagttagttccatgcttccttgggcgccatcttgtcggagccccgtgggttccttggcagactctgtgcggctcttgatattgtcaccatttttggcctccacaaacacccttttcagtgattggtgagaactttccagaaaaaccgactcaactggttggtgcagtgaccagaggtatcattagaagaggaaagctgccaccttaagaaaatagtgcctgggcacagacagcatcccttcttcttcttctttttttttttcccctgtcaaagagtctactctgggggttcgctacttttcaccttggctagaaacttgacaggaaatgactgcaagagcaaaaatagatgatccaatcaaaataaatgtggattacatgtttaaactggtgtcaacaataaatggaagaagagtttgctcatgggtagtcgtactccatgagggtattaacgttagcatgggattacgatgttgcttcttacagtcttagattttggtatgttttggtatgttttgtcttctgaaaggcgttccatgtgtcttgcaatcttccagatagaaggggacacacttataaaatcgttctcatcttcctgctcaggattagacagagtgcacttctccattgcgtaaagtgcacgtttccagagttctgctctgcgagtgatgctgttagtgcagttttttcttctaaattttgtgtaaccactcagagtaatcacataatatgccacactgacattattgacacctggtggagtagaattaatgctgagcttcttcccagcagagtcacagatgacagcttcctcagcttcctgtggggttgaggatgccgcctggacagtctcatgctggcttagtgagacttgacactggacccaccacatcatcttctgttcagcccatggtgggaaacattcatgccaatgaggtgcactcttaattactttctacacagttccctctccaaattaagaaaagcaatacaggcaagataatgactgttcatattttgcagaacttccagagagatgataatttagggaatctggatatttcctgcttatcccattgtttccaggtcattctctggcttcagttaaggtggaactgcaggtcggtgggtttgtgcctgtgtggatggtgaatgggtggggttgttgtggggttggttcatgtcacttctgtacactgaagatgttcaaagaggtgccatggctttgaagaacctctgggatagtgaaaggggcttgtaaatgtccttggacattctacttagacccagcacccatctcatttccttttccatctcctcaactcttgtatttctttttctttcttactcagtgaagactgggggctttcagatcagatctggttgcagaagcttttataagtcacataggagtttagatcccagcttttctgagcttagtgaccttggtcaagttatataacctgaggatttcttaccttttcaggtaatctaatgaaagaaatgatccctcaccccagaagaatgctcatgaatgcacatgcacaaaaaaatgtctacatgtttgtttcaggggctcccaattgcacccttcttgagcctcaattcttttacctataaaaggggacgcaaatgcaccctcagggggtctacctcattaatctttgtttgacagttaagtgagggaatgtacataaagtgtcattatacttagtgtggagcctggcacatagtgggtgcaaccttctttctgaccctccctctctggctactgctctcactctccctctctgtgtatctgccaaaggagaaaagttagtgttatttcattttaggatcatttgttaggacagagccctgccagattttcatttcatctgtccacagtgatttctttgttcctttttttcctccttccaatttgggcatctcacgaccgcatcacattatctttctgggctgcagcctcagtacacccgcttcctttgtgtgggaggagtatgttgagctcagagaagccccgggtctccctttcccacttagggctgtcccggtggcatgtggaatcttcagcatggcgtttcctccattgtgtagggcaaggggagccctactccagagttcatgcctcaaaggagcatgagtggcgtaaccatgacctcagcctgcagggcacacagccccacagagggcttctctgtggatacagaagccttggtcagcagcagaattgggaagagccagtcctgatggtggaagccctcatttgtgatgagtttggaggtgaccctgaccacctccaacccacagccttcctctttggccagtcacaggtagtgggaggtaccctccatctcagtagcaaaaactcgccttctctttctgttgcctatacctgtccctatagcctatgacagcatactccttgtcagtgtgcccttgggttggcacattgggtggggacaagatccaagttcattctgggagctcaccagagagcgagccaagcactactgttaacaagggctgtcacagcccaaatgcctgatatggcccagcacagggccgccatgaaggtgaagacagatccatggcactcagagcccaactcggggctgaacgggcttgtgtgtatattgagggttctgctgggctagtggatggcaccttggagggatctcagccacaagcccttttcccattggtctcttccctttctgaccttacctggttctcaactgagtcctcagtcttgtgccctgcctgggcacatggaagtcatccataaatacttgttggtgagactctttcaagtcacaggttcatcttaagaaagtgaaagcctctctctcaggttcctaagttaatgtttcatcttctgtttaaaataattcattagggtggttcagccggctgtcactatcctgacagtaggcaggaatgcaaaatccactttttaaaatagcctcattggtagaggaatattggcctcacctaacacccatttgggctatcctggctggaaatgcactggcccacatctttatttgcatcctccaggattacaggacagtctcatttttcaggtggcatcatcacggctcataaattgaacaacacttccattagattgcgctaggcatcatcttcaaaactctaacatctggatgtttccaaatagcctgctatgtagatgattgatggctttcattcttggttggattctgatataggccatagctgttgggattggaattggtggtcctgatgtgccagtatgtgatcaactgatcgataacatgggtggccatgcagtgaggcccaagagtgtgggccacctgagaggtcaactgctgctctgtccatggtatttggtgcttcattcacaagtttagagaaagatttcaaagctttacttgtgtgtctatcgatacatgacagtctgttgccaagatacaatgcttaaactgtttgggtggcccgggaatactttcacatcttcctaagaagggggatgaacgccccctcaagacttccgacaaagacaagagagcacgacgctctgagttgctactgaatgattgatgtggtcttgtttgtacatgtgcttctatgttttctaatgtgtatttaatgaagcttcccatgtgccaggtatcttcaaagccctagagacatggtggtcaatgtgggtggccaggccccagctcttgtgcagcttacatcaagaagggtttatgaggagtaaatcaaaagaaaaaaatataagggtcaggtaaagaattaaaatcaaacataagatgggtgactaggggttgttgaggtacctgttgtagagggatagtcagggaaggaaatttttttttttcgagatggagtcttgctctttcgcccaggccggactgcaagtggcactgtctcggctcactgcaagctctgcctcccgggttcacgccattctcctgcctcagcctcccaagtagctgggactacaggcacccaccaccacgcccagctaatttttttgtatttttagtagagacggggtttcaccatgttagccaggatggtctcgatctcgtgacctcatgatccacccacctcggcctcccaaagtgcagaaggaaggaacttttttaaaaaaatgaaccttctgtgttcctgagttggataatttcaaacatatccacaagtagagcatgaaccagcagaccccatgaacccatcatctgtgttcctgagttggataatttcaaacatatccacaagtagagtatgaaccagcagaccccatgaacccatcatccatcctcggcagatacccactcacagccagtcctgtttcatctatacactacccctcactccctgcttccgtttactcaattattttcaaacaaatcttggttatatcatttcatccctatttctttctctctctctctctctgtctgtctctgtctctgtctctctctctctctgtctctgtcacccaagttggagtgcagtagcgcgatcatagctctttacagccttgatcttccaggctcaagccatcctcctgcctcagtctcctgagtagctgggactacaggcacgcaccatcatgcctggctaaattttttttttttttttttttttttttagtagagatgagattttgccgtgttgtccaagttggtcttgaattcctgagctcaagcaatcctcccactccgacctcccaaagcactgggattacaggtgtgagccaccatgcctgacctgtatctctctttttttattaacaagactgcaatatcagacccctaaaaattataaattcatggaatcatcaaatattgagttcatattaaaaattccctaatacatggattatttttatttattttaattttcatttttgtagaggcaggttcttgctttgttgcccaggctggtctcaaactcctgggctcaagcgatcctccaccttggcctcccaaagtgctggaattacaggtgtgagctgtcatacccagcctaatacatgtgttttttgatagttgctttgtttaaatccagatgccaacatggtgttcacattacatgaattgatatgtctctaaagtctctttacctgtatgttcctcttctaacttttttttttccttccttgcaattttggttgaagaaactgaatcatgtatcctgtaggatccctgcagtcgggatttggatgttttgatgattatagccccacagcattgttgaacatgttcttctgtacccctgtgttttctgtgaactgatagttaaatctagacacttgatctcatttaggagcagttttactttttctccatggctgcttcatgtgtgttagtcagtgtatctgatcaggagatacatgtctcactgattgttttgtgatgttattagccattgatgatcattgcccaaatctcctatttatttggagctggcaaaatgatgatattctcattctattatttcttcacttattagctgggctactccttatcaagggaaagctttcctcattaaatatttgtttaccctgaatactgcaaaggcaggttaaatgctaaatctttaaggtggtaacatttaggctgtgacctgacttgaccttgaagaaggcagggaacacagcaggcttagggcctggttggtgcaaaggccctggggcagaaggtaggccagtgcaattggtgtcctagggagggctgaggtgggtggcatctaccaccagacccacctttgtaagcagggtcctaagtttggggtttcagtgctatgggaaacccttggaggtattcagcagtggcctaacatgattgatttcccttgaagttgcatggtatacagtgtgtcacacagttcctccccacagagcatatggtctcagggagcagaggacaccgacaatgaaacagaaaattccagttctatctattctttttattttgagatggagtcctgctctgttgcccaggctagagtgcagtggcatgatcttgactcattgcagcctctgcctcccgggttcaagcaattctcgtgcctcagcctccctagtagttgggattacaagctcatgccaccacacccggctaatttttgtatttttagtagaggtgggatttcaccttgttggccagactggtcttgaactcctgaccttaagtgacccgcccgcctctgcctcccaaagtgctgggattacaggcatgagccaccatgcccagcgggttctatctattcttgtgcaaattttacaaaatatgtggaccttcaggttaggctttctggttctggcatcttttgcatgttggtaattccacattttcagatagaatttttctctgatgtatttttccattcctggactctggttttccaggaggcgtttggggcttccttgggggtattagggtgttctcttgctctggtaaaagcttgaaattacccaggtatcaggattcactggtgtaatgaaatgtgcacgtggatggggaaacagtctctttttccagactctgaggagtaacccgcctcccagggagggcttgtccttgtgtctgggactgcacccaaaacaggatggccggccagcttctgagtggcttctccatcctgggggttgggttcacattgcattattactaatgtgagaatttccacccgatgcttagtgggaagatctcatacccttttatctttgttaatattcttgatatagcgatttaaatatgcaaaacgaggacatgccatatggcaatgtgtgacaagacagcccagtggctgtaggggacagttggtaccaagcacttccagaagggtgatgtcaacacagcacaggggacacaggtgtctgccaggtggatggcgggttagggagtcatttgcatgggagagggaaggtgcgtgagaaaagcatctgctgacccgttgctgttggccaggtaagagaagatgaagaaaagtggtggcaagtggtgtctgtaacttgggaaaaccctgggaggctgtaaagtcacctttgtgcacacaaaaaataaatgcattatttttaactgtcagaccagggatgaatttttgagagctgtcagaggaacagccaggcttgcgcaaagatcgagaaaggacagacgactgagcatttagccaaccccttccctgaggtgttgtgttctgtgagggcggtccatagggtggcagctccaaaggggacctaaaagtttgtaaattttggctgggcgtggtagctgacacctgtaatcccagcactttaggaagctgagacgggtggatcacttaaggtcaggagttcaagaccagcctgaccaacatggtgaaaccctatctctactaaaaatagaaaattagccaggcgtggtggtgcatgcctgtagtcccagctcctcgggaggctgaggcaggagaatcacttgaacccaggagggagaggttgcagtgagctgagatcgtgccactgcattccagcctgggcaacagagtgagtgagactctgtctcaaaaagtaaaaagtttgtaaatttggaaggtggtttggagggacacacgtttgatatttgttaaacgctgaaaggaaagaggggggaaagcgggcaggcttttaagaattgttgactttgtggatttggagcttcctgggggaaaacagagccgttccaccgaggcctgatggaacaggaagcgggtgtctgcggcaccatcccagaaccagctctgcagggggaccagctggagggggctctgtgttttcctccctgctctaaacagaaagccgtttttctagatgggaatctggatctgttaaaatataatcggtaacgagaccaggattatttatttaagtatgtggaacgctgagggagtgttgtacttcccagctgggctaggagctgcaaacgtccaccatgtcgaggggcacggaaataagaactcgccaccccttcggagatgcctgcatagtgtccttacaagcttctcttctccttgttttcattgttatttatcttccatttctgtaaactagcctgtcttacggcctgggggcttctatcagtgataccttggagcggagtcctgtttctgtaaactcttctgatctcagaaatatgaacacggagtggcccaattgtgttcttaaggccattaccagaagtgaccacaacccagctgttcatttcctctaacccatgtcctgccgcattctcccctcactgggcaactccttgtagactaaaggatggtctcagtaaagctcgtttctgcgctgaattttccttgtactccagtggggccaatgagttttagcctgtggtttcttctgttctaatttatatgaagttaaagctatatttcaaatccctaaacgtctttatttccctctatgggagacagaaaaaagtggggccttataagtggacttccacatgtccaagttgggaatctcttccagacttccagagactttaaacatggctgtaaaagaggagttgggagaagaaggctgaggtgggattttgtctcttgcccccttgcggcctctctgggacgatagcggttgtcatagaaatccagacccacaggcaaccctttgccccatttccacccacaaagaatggaatccagagaactttctcgccttttggacatgaagagaatggctgagttggtgacaggggaaaagaaagaggattggcccaacagtttgtttatgtgggctgcctgtttctggagagcgtcatcttttcggtagaaatgcccttctgtggattgctttaaaaaaagaaaaaacaaagatgaaagttctcattgctttttggaaacatcaagctgtgacctggttggaggagtccaatcaacgtggggagggctttcagaggcacagaagccagagggcagagggtgtggagggagcctgggaataccccgtgctggccagtccggcctggctgtcagcttgaggaactcaggatctgattgtgagaagcagacagaaagcgaagttgagctgggcacagctttctagatgagctgtctgaagctgccgtgtttggtttggcctgaagctgagcaggagacccggccggctttccagaagggaggccagccctgacccgctgcagggcctggggctctgccctctgtgtcgcccaggttgcggcagctcgtgcgtaaatggggcagccaggtccacatctcttcctccctctgcacaaattgaaaacgactaaccttgccatatttagtgcagcactcacggctgctcgcctccaaggggtaatcatgcaggcataaattcggaaagttgctaagctatgagcagtcttatgagcattaaaagtgtcctctttgccagaaaggtcattcataacttggctaccctgctgatgtacagccagtgatattgattgattaatgtataaaagcaccagatccatttgcttctatgaaagagaataaagtgcagtcgactctctctttattttcacctcatccttttgtttgaaggacattttcccccctctttttgttttgccggctatgtttaagggggttacaaaaagccagtttctgccaagtaatgtgttcacaaagggaacattgattcacatcagtgtcgcttgaattacccttaaaggtttgccaaggagttgctcttatattaaccttctgttcgtgaaggaagaaataaataaataagtcataaagtcagcctcgttgctttggatttcattttgggcttgatctaaaataatttcttccacggctgcttgtggtgagaggtgttgaccagaaaggcccttgttagtttttagggtatgggatgggggcaccaagggaagcaagcccacccctgccgtcagagccccccgccgcaccagatcagggaagagaacactgaatttacttccagcacagagattagttctgattggctgccccgcctttcaggctgaggagcagcgggccctggtccttgctctcttactccggtagttcacactgtcaggtgttggaaacggcaagaaaaccctgcctttgtctgaaagatgaaggattttggtggggaaggcaactttgctttttagaaccagtggcatgaattatacaaccttcagagttatccttaaatttcccatttctttgcaaacctagcagggctgcagcctgaagttgggaaaaaataactcctcagcttttgttaacttggaattaagtttgttttgttagtgttttgttttgttttgtttttgtcaattacagagacaggatcttgctctgtcacccaggctggagtgcagtggcacgatcgcggttcactacagcctcatactcctaggctcaagctatcctcccatctcagccttcatagtagctgggactacagacatgtgccaccatacctggctaatacttttattttttgtagagatgaagtctcgctatgttgcacaggctgggcaaactcctgggctcaagtgatcctcctgcctcagcctcccaaagggctgggattataggcatgagccaccacactcagcttagtctttattttttatttttctgttatctctgtaggtggaggaacttcctgtccttgtgaaacccaaatggggctggtcctctatgaaaactaacaaatactgattaccttgtgatttggttagccttgggtattatacagaatacagcatcttgccaaccaattagctctgttgtttaggttttctttcagtgacttgatcagaaatgcctaggaagatagtccagtgctaggcaatgtatgaggccattggtcagtatcaactggctgcccatcttggattctttatcatttgacatgggtcttttcagagctggaagaattccaagcaggtgggaaggcaggggaatgtggaattgtggaaacataaggctgcatttagctcctgtggaggtgtgatctgaagcatcacctgcgggtgtcagtgtggagttctccttactggctgccctactggcagaatggccttgctttttgaggtctgtgtacttttggtgggtgctgtggagtgaaaactgatcaatcttcctgtctgtatttataagccaggccccactcacttgacacaatccatttcaccaagggtggagatggcccaggctgttcctgcaacatggtttagtagaaggtggccaccttctgtcttcaaagctgatgtgtatagggaagaactaatttcacttcattttgcagctcttgagcattgaggttgatgattgctgggagccacagaggagttttccatgtgctaggaagattagacattgaagtctcccctaggaatctaagcccttggacctacacgtacctctgtctgccctgggcagctgtctccaggtggtgtaaaagcagcaggtgaaaaagtagattgctttcttctcctcccagaggtggtttgggattttgaaggcatctaagctcctgcgtatccctcttagttaaaagaggcacagagtaagctagctgcacctggcctgtgctttgatagagacgcagctcttcacttgggaacaccggaagcctcgtgagccccccaggtcttgcatgacactttgaataatctcttctgttcagccatgagtagtacgatgttactgatggcttgtggtctgaccacgtgcgtgctcattgtcagtctcattggcttttcctttgttctagaacatggcaggggagctgcagacagacaggtacagcgcctagctttacagttacatgcacgctgtgtcatcagtttctttccccccttcatagcagccagagctctaaacactcattgctaaactaaccccaaggcgctggtgaagtgttggactatacagggagccaaactaacttttatgtaattgtttaattaaaaccttggttttctaattgcagtctaaacacaagcgccttttgttaatgaaaggcaacctctgtgcttggtgttctcatacacggcctttcttttccactgttttcaactagaaaatcgacatttaagttcccaccacggggaaggtggcagttggcgtttcttgccattgggggagatgttccacaatcccttttgtcagtccttgtcaacaacttatctaggctgcagttgcctttctgatttcctattgcaatgagtcaaatttgtaagcttcttcacgtgctggaataattggaaagccagagaaggacccctgcgtttctctggcgcgagcattattttccatattcctggtgcagggtattgaaatagatatattttaatgtttgctttttaaaggggaaggtttctctcgatttccagatgaatcttggaacctttctttcactcctccctctgctgaggtgataagagctggctcagaggatatactgagaatgaatccgttttcgttcctctgtctctgcagaatgaattagaatttgcctgatttaataaaatggcttcatctgcctgccatcttttccatctccagagtatttcttccttagtggcctgcccttctataatgggtctcagctccatatctccttattacaggctggtggtttcatatgtaatgcattcactcatgctctcacacacacactgtttcacacgcgtgcacgcgctccagcgttgggggatcttgatggctgaaggtgtggaaatttgtcaccagatctcattttccccattgtcaggcatgatggttataattgatgaggttggtgcaatttgccatccatcggccattaaccccagccttgtggagttgacgtgaccacaatgtagaatatattttgggagaagagggagaggttgaagatggggaattgcagcataaatcttctcaatctgccccagccctctctctgtttaattggaacgtatttatctctgcgtacagtagagtattttgctatctccccattgccctcagatggactgataggagtttgttgtttgaatttggaatgttttttccatttgacaccccccccccacccaccaatttgtgttttaatttctatttcctaggttgattttttttttctttccattttgacactaattatgccagccgcattgggagtgcgcactgctgggaggtacccagctaagtgttaagaagggttttaaaaacaggctgaactccctcttaatgaggctcaatcgggctctcctccgggtggttttgttttgctgatctgtcagtttttcaaggatttaattgcacttttttcatattagtctttgaaattggcctatccaatcttgctataaaatacattttttaaaaaagcaaaaagtttgtggtttgtccctccccccttattgtttgggaatttttactttttgctctcatttgtccaggaccatcttctgccagtcgttcttgggacccagaaatagtgaagagccagaatgggagtggcaggaggggccttggagagcccggatttgtaggcctcagagggagtttccccattctttaagccttccctctttagggctttagtaatgcagcttggcttatatctcctcttccagatttgctcttgatcaagggcagggagagactcgcacacaaccgccatttctttcggtatagaagtgacagattccataaagtggtgccaggccggctaaccactgtctcgaatcctcaaacatgggaggcaaagaaaaggaaaagtccaaaagctagaaggcaaaagttagcaggcaggggagggagagaagcaaggccatatcctttatgctagtatctttatggcatagaaaacatgcttagagcaatcagcatgaaattcttaattgcttcgcttacttctgctctcctcatgggacagattgtgcaaatgctggagctgccaggaccctcatgttagcacactgtccctgctgcatacactatttttaactagtgctttgttttgcaaagatgcacaaagctttttcttttcttttcttttcttttttttttttccttctcaaggatgctaataaacagcggaggccataaagagctattccagccaccttgacagcagctacactttattaggctgtgcacctagctctctcctcctgccgctcagccttctgcttcctctctttggatttcttcattctctccctttcagcatgagttttggcttttaaaaaaaaaattctgtgaccaaaccaacttccttttcttccttccccgccctcctgaatctgatttgcatccttctactgccctctcttccaatgcctaccttcctcttttgagatttccagtctcctctcatgagaatgtaaaatccaagaaccagatctcagagatttcaaaataaaataaaagtaaactctgcttaaaaaacactttagcaggaaagccaggctaattgtaaatcaatgggtcttaaaatgcagcatcgatctccagttagaagtttgaaggggaaagcagtaattactgcaccagaaggtagtttttcctcttagtaagttctgggcagaaagaaggctcattagggcagcacttcagaatctgagtaattagtttaaaaagtacttttgtggtgttattcccttggctagaaattattggagtcttcacagatttatagctcaattctgataagatttgatttcttattgtgtttggtagtagaagaaccttgatcataatcacccaggtgaagattcagggaagcctggatcagacagtctttttagagtgggtggggtttaattctttaacaattcctgctattcatagtattgaaggtgtccaacttagagccttagcatggtggccctgttagaccacccagggtcaaccttgtcatccctcaggtgagcaaacagagtcaaagaggtgattttcttgtccaagtacatgttgacgtgatggttcaatgagaaagctctggacataacacagccatcttatgttacctaaagtggatctactggagggtaagttccatgagggcaggcttgtgactcacttgtccagttggatccagaatggctgaaacctaggaggcatgaacggatagtttaactaatgacttagtgagcaaataaaggaatagaggactcttctgttccaaagagaaagcttctaagctcttttctttggaggagaaaactaccatggggagcgttctgtctggttaggttatcaactgccactcttgagcattcaacattacagagaacagaagtagcccctctccctctttttttaaaaaaaggaaactttttataaaaggaacttggttttgcttctatgaggagtcatcaagagatctttctcttccctcattttttacttaaaagaaaatatacaacttaagcaatacttttaaatcatccattgttgcacagctgtctccattttgggacattatcttttttgtgcctgtgtagtagtaatagccagtcaaatgtatgtgagagtgttttgtccacttaagagatgtgaagttcttaaattcttcctggaaagtttcagttatctgtgctgtttctcaagggaggctctctgaggagtgcgctccacttttaatctagaaatagacatcagatagagcggtggtttgtaaaattttattagcggagccctcttttagaaaaaaaatgcaaacgaatttggacctagtatataaacaatgtttcaaaaggcttgaaaactatagttattttaggagttcagatttttaacatttacttattaagttaaaaaattagaacaaaacagagttgatcaacagatcaaaattaagaattgtggaaggtagttaaatagtatcaactaagcttctgttttgtttctatattttgttttagacaatttctgtataatcctctttcatacagaagtagttccaaacaggactggttttaatagcctgccttgcaatcccagaagagtcttccattaagtgaaaatggcagaagttttatgctaaagtctacgcaaaagctgtttaacttggccacgtaactagttcacctggccgccagtgtgttaaattttggcatatatcacatttgagcatgccttattattacagcattttaaatgaaattgaggccaggtgcggtggctcacacctgtaatctcagcactttgggaggctggggtgggcagatcacttggggtcaggagtttgagaccagcctggccaacatggtgaaaccccgtctctattaaaaatacaaaaattagccgtggtggtaggggcctgtaatcccagctactcgggaggctgaggcaggagaatctcttgaacccgggaggcggaggttgcagtgagcagagctcgcaccactgcagtccagcctgggcgacagagtgagactccatcttaaaaaaaaaaaagtgaaattggaatcaaaatgtgcagaacccttgtggtatttgggagctccccagagaggaatttagacaccattatattaatactgtaggaactctagtcagaagtacactgggacttttgccgttgcaagaacccaagagtactctctctggaagactcgccgtggtgttgagtggctgatgaagagccccttgtcggggtatctccctgtcacccacattgggtgacctttgcatagaatgtgcaatcctgtttcatgtaaagtcacttcgtggattgcagaggtcttggcctccccttggaggcctcttgtccctcttcttcctggtatctgttggtccccaccctgagagtgtaacatctggctggggcatctctctctggtccctgccctgtctgctcaggactctcctctcctccgtactgtgaacatggaagtgatgacgttccatgtggaaaaaaatggcactttctatttataagtgaaaggaaatatttctgctgtttatcctagaaaccccgagccatgctttcagacgctgagaattatgtccctgcaccgcagcctcagtcaggctcctgggccctgtcaccacttggcccaaagctactttctccccccaaccccatctgcttcccaccagttttcgttgcttgcaccccctccccttgagtcaaatgttcctgcttgcagagtttattaatagctctagcatcattgagtagtgatttttcttccttttttgatttattattttttttaattttaggcttttagaaacaaatctggaataatatttcaagctgctcccatctggggcaaactccagtcaatcctttgagcccaaagcacatcttagggggaggcatcctccacgtttcctcccaaagctgtgggcctggccgagcccggcctctttgctctggtgttaatgccctggtgatcactggtcatcagtagtccagctctaccatggtccatggttctgtggacccaccctatatccccagttccttgagcctcctctaatcaatgtccctaaaaacttctcgctgcccagagaaattttttccccaacttcgactctacagtgatataagtgctgttgaaatgattgactatgtgtatttcaacacacatgaaaatagcacttgtgtgcacagatttactgcacacttggtagtgacagtgggatggtcgttcgtcctgtggtaagtccttttccgtactgaagcgtaggagtgaagatgggcaggtgatgtttccatgtgggacctgtggtctgaagtgctaagtgaggtagacactggtgggtgtgactttgtaggtgtgacagtaggtgtgactgtggcttggggaggctggggtcaggaaggcttccccagggtgggcagagggctgatgatggctgtggcttgtgttttcaggctggtcccatctggagtgttgtccctagtccagtctggggcctgaatcatttctatcagtgcctaacctagaaacatctgatttctctaatcctcttgtttgctctgacagtcccccgaccgttcccaccttttctttcagcttatgtcccctgacgtagcttagcacttttgtcatcactggaacacggaaaggtgattttcagatggaagggtaggtgtgaattttttttttttttttttttttggtaggtgaactccaagtggcagagagcccacctggaagtcagctgagagctggagctctaagtaaaggcactcttgacagggctctgtctcctactctcgaacaaccagggaagtgaatggcagccgttggccaggaattgattgcattaattgatatgccaataagaacgcttgttacatccgccattggttaggaggccagctaacaagtccgctgatcaatggcaccaataaagatttcatccattaatgaggaacgtggtaattaatgttatccataaacctattagcctggctagctaatgcactggttagtgccatgagtggcagtgtggaaagtgggcagggcatgggttgggacttaggcaggatcgtgggcaccatcttggcaggatcgtggcctcatcttcaggcaggtttattccaaacgtaagcacatttcaacctcctggcagagagagaagtcaggctgagccggctgggccccaggctggagtatggctgagccctgcttttgtccccctacctgctgggaggagaccaagccacgtttttctcttgcagctcctctggctgcagagctttcccacgcaagtctctcaggggctgttaggggcgtaaatggaatgactgagttcccgggtcattccagtcccagctgggcacactgtccccagggacactctccgtcagtggctcacacgcactgccctgtgctcctggagggcgggcgttggcctcttctgggaaccatgagtgagtggtaaagtaattaacatcccccacccccgggcttcattaggaagaaaaattttgctagacgaaagaaagaaggagaaacagatgatttgaagctgtgcctttttccttcccccctggttttttgaaatgacatcagtgggttgtttgccaagcataacctggcagcccggcggctctgcctgcctgcctgagatttctggggaccgtgcagctcgccagctccagccgtggcagcatgccaaggtgacgttccgtgactaagcagaaacgagggaaagggaaagagggaggaagaaggtatgtgtggttggggagctgggggagagagtggtcctgggtctgggcgtggcatggggagatgaggaggcatgtctgggggcatctgatcaggagggcgggcaagaggggcaggcactggcaggccaggaggtgttccagtggcatagggggtgggagggggggcacagggtgatggccgcagacccagcctgggaggccgccgaaggggtctgacttaggagggaaccaaatgagccacagtgaaggtgacagcccagagggcctggaactgttgaggaggaggcttaggaagcttttatcagcatcaggcctgatactccacagcggagtttcctttgcattgttaggtattgaccctcagagaccccttgtggattccctaattgaaaattaatactagatcaatgccatgggcaatttgcatattgatcataaacaactttgaaggcaccgagtgtgcggcagatcaatagggctcgtgaataggctgcagagggagcacctcccagtacaatgcgctccgagaaaggttaatgatttaggaagttcctaactgcttagcgcagggaacagcccccacaccacacagcatccccaagagcaattagtgccaggcctgagcgcctgccctccattccccctcagcacccccatccccaggagcggagggagggccactgtgctggtgtgaggcaaggggctggcgacctgtgtttttacagttgccttttttggtgatggatgaagtcttggggcagtttattctgggaagctactgtaaaaggcagcagctaagttcaggctccaatcattgtcctgaccccttccccaaaacacagttctcctgatgatgtgaatggaatgagatggaggaggggaggagcctggctgcacccagcctcctccccctcgggcttcagatcaatgtggaacctacattaacgtttgctttaagccgtgatgggtttggccctggtttgcttcctgttccattcagctctcatctttgggcttttatgtcttcgcccatcgcttactctcccctgctttgcgtctgcttgtttttgctctggctttaggccttgccttttggggtgtccctgttgggtccccagcaagcctggaaaggaattcactcctctggggagattccctttacctgccacccctccccttctttatcctggcctccatccatcccctcttttcccttggctgcggaagctgtgtgtggatcagctgccctgggggtgctccgggctcacttcttaacattgcagcaaaacctggaacactccggggcctgaccactgagtttcttggagctcccagggtaccaagagatggctggtcctaggttcagggccagatgcagcctgcagaactaatgctgcctgcctgcacctagctgccttgctccagccctgagactgcagggtggtggcaccagtagcagagaggtctgcgtgtcactagggggagacacgtcttaggtagtgctgagttgagcagactttcttctacaacagccaatttgagaaaaataaagtccccccttcatcctcaataccaaattcattttgtactaggaagtgctagcttaaaatagccctgccgaggtcacatagttttctatggcttttaaatttacaaagtccactgaaatacatttaggtgcagggacaatgcatttccatagaagggacatgcagaacagtcagtaactaatttctgcatttgcaccgcagtaactaatttctgcatttgccattctgagccttgagtccttcaccccagtcttggtgctgccctgtcctcttctcagggagaggcttcagagcacgatggtcagatgggtcctttggtttatgggcgtccagactgtccaagtgctgcagcaccgcccatggcaaaggatagccactggtccgcttcccctctttgtgtttcttcaccgtgaggccagctctacccccacccctgccagcccccagtaaatggaaaggttcaaagagattttatctgtatctgcagccacatccgtatctgcactgatatattgcacatgcatgtttagggaaagacaggagtttttctactggaaatccctgccggggccaccagctaaagccgtgcaggttgtcccccacacaaacagttctctgctaagggggatgcataaagactgcagtccatcccagacactaccttacccagcagagggagtggtgggtctcaggaccatatgtgcccagaggaagaggtgctggaggagcaccttgttctgactttctcaaaggtacctttcatgctcacagtgcccgtggccctgcagtgggtagcaaggcctacaggatgctgcccaagacctctctgagcttatcccctgccttgtcccttctctccctgcttagcgctcagcgctcttccagcaggccagccctccttctgtgccctgggtctttgcacgtgccatgcctctgccatgtgagcctcctgtggctcacactctcacttcttccaggtctgtgtgcaaatgccaccctctctgagcttcccatgttaaggaactccctggattcctttttctactttatcgttgacccttagcagcctctgacttagaatatgctcacttactgagctgcttactgtgttttactctccccactccttcctgcccctgccccatgagagcaggggctttcctgttgtgttcacagccgtgttgtcaatgcctggggtaggtgccacatggatatgtgatgggtgggcggatggatggacagacagcacaagcacaagtgtgtgttctcctgtgaaggccaccatggttggtgcctctagaggtagccattaagcatatggtccttggcatcagctgtcacctcctagctatgtgaccttcaccagtaatttaacctctctgagcctcatctgtgaaatgagagtcctaatactatctacttcagctgagtgatgattgtgttgctattgttagatacttgctaatgacttaagccaatggaggctttccaggcgcgtggtattggtttttgtgatcaggctcttggtggtgaaggggtctacacaggcaggagaaagggaaagtcgtcagtgttttgtactgattggtctgggtcacagatgctttgcggtcagaacatttgggattggggcaaagaagatggcagccagaacacaggctcctggggcaggacgggggtgccgtgacacagagcgtgggagcacgtggcgtggggcagtgatgtgagttgggggcggagagcccacgcaggcctggttcagggccgggcgtggctgcagccctgccagcccagcgggcaggtgccgggatgtccctgtgcatgcgatgacttcattatggagcctttcattgacttggctgcactgtgctgatgaactgagactggggacaagagcacataattgagggaaataaattcccatcacaggccgggctgcagccaggagtgtgcgtcctctaggcgtgtgtgtggtggcagggggagggggttccagtgttttctcaggtgcatctccccttctttccttcccttccagaccttcacaagcactgggcgcagggggaggaagaagtgtgcctcatctccgcagtgctgcctctgtttcccccgcttggagctgcttttccagaagcaagcctctggtgtccgcaccttgccctcttttccgccacacggaggagcaggaacctgccggggcctccctcgttcccctcatgcacctgttcattctctcattcattccatttccctttgtttgttcaccttcagttctgtctgtgctctcggcttagctctctatgaaggcagggaaggggagcactgttactacaggacttaattgaaatagcatttcattcatctcggaaatgaggaaggggagggggcggggcagggttttcggggcagtctacttgcctctcattcgacacagagccaggcctgaagataccaatgccacaaatgcatagcaagatcttaagaatttaggaaccagagtcatttgcataaaactaaaccaaaaaccgcacaaccagccacatggtttaacgacctctaagccaatgtcctgctgcggtgcattttctaagaacggggatatcagctgctctggtcaccagagcatctgaggtcagtcattattagttgtttacagcaaagggacacccacccccccaccaccactcctgagccccagtgtgttttgggccttaaaatacatttcctggaatgtgaggtctgtgtgctgtgtgctgggggtgcatgtgatggttgggcgagggaggcaggttgcctcagttacaaagaaacatgggcggtgtgaaggcagagtagaaaagaaatggagagccctcacttgacaccctctgacctcagccattggagctgaatgctggagagccaggactgaaattgcagtcactttagattatttggagcgaggagaggcagggaaaaaagggtctgttgactacaggaagctgaattcttcctctgctgaaaagcttattagtggaaggggaaaaagcaattacttggcttttgctagttctctgtggctgggattcggggctgtgacagcaaccctgtcagcagtgccttggacctcaccctgatccagaatatcgatgatgagctctgccccaagccatttgggagcagtacttctgggattcccccctttccagaaaagagcatggaggggaggagtatgtgagtgagtgggtgagtgtgtgcggatgtaggagagggggagagagagctgtgtcttgtcctttctttaaatgtgatgcttttatttggggcttcatgttgccactgggcaggaagttaacagggtaccaggtgcctggaaacaggattggctggttttgttttgtgtatcgtggggtttgctttggttttggtgagttcattttttatccttgccatgccatttgtcttaaactgtaaagaaaaattaggcattgctttgaacaactatggtaccattattagaatccacctgcctcaacatcaccaccttgatggagggaagattcccgcagagccagcacccagggagcagggtgtgaggctgcaccgcccacactgcccatggcttctgtcttgtttgactgtgtaagcgtcaccccgagcacttcttccctacacagctgatggccttcatcctcctttagacaccctccttcaggtttcctcactgtgtggcttttttttttttttttttttttttttagacggagtctcgctctgtcgcccaggctggatggagtgcagtggcgggatctcggctcactgcaagctccgtctcccgggttcacgccattctcctgcctcagcctcccaagtagctgggactacaggcgcccgccaccacgcccggctaattttttgtattttttagtagagacggggtttcaccgtgttagccaggatggtctcgatctcctgacctcatgatctgcctgccttggcctcccaaagtgctgagattacaggtgtgagccactgtgcctggccccactgtgtggctttggagccctatcctgctccaatccctggtctcctagtctgtaaaattgaggtacttgtggtcagctcccccaaatacctcaaaacacaggtagaacctgccggtgaccaggcttttgcgaacagccttcattcctccttcccagatctgctgtcctcatgtttatgctctctttgtgtttggactattctgcctagttatcctttttatattttctaaaacacctaagaaatttctgcttttgccatcctaattgtatccagctaaattttacacaggtagatttttaatccaatgtcccttttatcttttcttgcttatatatctccattcttcaagttacctgtcttcaaggctgttttctgtcttaatttccattctcctggaacatttcctattctttttaacctttcagcaaagttctttagtagttgagtcaactcataggctagctcttcttaacagaaattgatccgttttttttcctaccataatatatatttaattttaagatataaccttacctgggtttgttttttgaaagttttcattggttgccatctaaatctccttcctccgacctcctcctatttgaagattttgcttggtaagtgaagaatcacttactttattctttctaatcatgggacggtcttatcttcagtgttgcactgccctttgattagttcatcttcacacctctggcttgttttacccttctttgctaaaatcttggccttacaaagtgaagcataacctttcatttgtttcgagtttcctttccttattctctcactgtccagtttctgtatttcactttgtgaaatgttgctggctgggcatggtggctcacacttctaatcccaacactttgggaggctgaggcgggaagattgcctgagccgaggaggctaaggctgcagtgagctgagatggtgccactgcactccagcctgggcaacagggcaagaccttgtctcaaaaaaagaaaaaagaaaaaaaaaacaaaaaaacaagttgctcacttatgaaagtttggggacgtctgaagtaaggatttttctgtcagcgggtttctagtgcttccgccaactgcagtgtgtacacggaaggatctcagcatcccagattatttctttaaaatgtaattgtgtgctacaaatttctatagatcccttatttctgtgtcaagtaccaactctttgtcactaaactgcaccttctgcccgatccctgatgactttgtcatctcatggcaacattttctttctcttaggtttcatgtatttgttgttttcgaatattcccaccactaaacaggatggggtgtgagtctagaatttaaattacttttgttcaagtgtttgtcttgatgactatcactgtgtgtttttgggccttgagagatattgctgtatacatttgtggaatggaatgtattgcttttcaagggttgctagcctgttcttaggtctgagaaacacctcacaggaggaaaagctaaatagatacacagcgagtcctgaggctgagtctacagggcagtttagtagctgtgggagatttgaggagcgctgctgtagctaaaatcattgtgaaagggatgtgggggtggcattttgttaaaccctagcaaaagaccgtttcattgtacaggatccaaactttaaaaaaacagaggctttggatccaactactggcatcactttctaagtttctaaagaggaggaggatccaatattctttctccccttggacacagaatagctgtacaaggtgcctattaaaaatgacaagttagcaattccatctgctttttcccccattaatggaggaaagctcttgaacgtaaacctttggattttctctgtacctcagcttcctgcttcactttctttgcagtttcccaggaaatgtcaactgaaacatgttgcttctgttgcctgtttgtttcaaactgatgcatgcttggggactggatggtttttggagagtagcccagtttttgactttccacgtgtagacgcaccttgaaatgtcttgggtctggcttctggcagagttaggctcttctccgctggcaccagggaactcgtggtaggcacctgaaggctccccacgatgcttgcagttgtaagggtcttttcttggccactccgggtgttcacacgtttctagcattgcattcttgaatgtgcaacctgtaaatacgtagtgacctttgtatatgcttgggtctggccaagggagagcagatttagctggtgtttttcctgggtgcagcattgcctcaagctggcctgatttctgttccccagatttggtttggaaagtgtaagccttttgtttgtgctttgtttttatgaatcagcttattttaccagctgtgcatattagtggcttatgatcatgcaaaacaaagctcattgacagtcagttcctcattctgctgtccactggtgggagtaaactcatatttctgcctgagttctgtgcttcgcaagggtgaagctgttttctgaataggttagagattcttcagacgctgtgggcttcagagtaaggtggcaaacagggaatccaagtccctcatttgtatcctcatgtgactcagacctctggagtcatggttttatttttctctgttgtgtgccatttgtttcgatggtcagacacaaaatgtttacctctttctttttctctttgcttttttgcttctctttgccccaaatagtccgtcattcccattggtattgtcaaactgtgtctccccagcattgcaaatgccttgggcctgcatggccgcccctccatctctccttccctggctgtcgttcttgtatagattgcatccatcaccgttgacgctcctgttacgagagccatcccacaaggtttcacttatgcccattaggttctaatcaccatcatttaatatcagttctggtacatcctgttcatttcccatacaccttcatttgtatatagatgcttaagtacacttacaggccctccttgactttttttcatccatatatttccagtattttccaattaaaaataaataaataaggaaacggattttttttttttgcattaagcataagatctctctctgacaagccaagtcagttttgattcagaaggagataccagtcttctttaatggaaactgttaaattttttaatttactctctatcactcatgtgtgtttatctgtcttgtcttctcccctcccagcatggaaacctggcagtgtttatttccggcaggttgttattgaaagacagatgcttgtagggactgctcagcctcacacctggaatgttaaaaagctttcaggcaggtctgctctgttgaaaaatgtcccttcctacagaggaaggggacaggagggaacgggtaccccatcagggaagctccccttcttcatcccccccacattgtcatgaacccccaattctgaccataaatctagacaccctagatgatgcctctgaatccacaaaatggttaattctgatgagcaaataaatactccatcgagaccttcttctatcaactccagcttttttttggggggggtggggctttatcaaattttctgtctttaagacattactgtttcctctctctcatcctcctctctttctcagtagcatactgggttggaatcatttttcttgactcctttgtttttaacgagatgggggacacccttcttggtatcaaggaccttctattttgcatgccccttctttctagaacattccagtttggtgtgaggttaaactgtgtaaaatactgtttgaaagaaaggagaaaaagagaaaggaacttgtcaaaatgcatttgttagatcacgttttaaatgaagtacaattgaaggtagtttttgtccaaagaaaggaaaaacccctgcaaatccgctgagctcccagagagcgcgcctcctttgtcgtcgcgctgacattgaagtgtaatttttcatggttatttggactggaaaatgggggggggaagggagagatgggcctgcgattatttcccataaatgacaacacaatcacatcacgctctgctacagacatgctcggggaatttgccttttttacatttcatgtgtgaaagtaacagcaacaatcatggctctgtagaaatccaagggaactaatccctgctgaattccgtttacttcagagttctgggacatagctagctttcttacttagcgtgtattccgagagcgtttcagggttgggtttgtattttacaaactggaactcacacctttcagttattaaaaaaaaaaaaaatcttcctgtgaatagccaccaggcgagtccgcgacatatttcgttccgttgtgctttgtcaccgcacatttacttttatcctttctggatttctgcagggggcaacccaggtgcttttgctaagaacacagataaatggaacttgttgcaatactggctctaggcgtttcctccctttttctcctctcttgacccccacccacccccgtaattcttgtgcggttttgacaaattgttcaaatggccaagtggccttgcctgggagaggaaaaatggcaggacccgtccctcaccacacaacggcagcatttttcacttcatgctctggcgttctgtgctgttcccacaggagggacggctgaaaggggaaattttctcggggaggccttaataggccctggccactttggactcgtaacaggctctctcctgtcaatgctcaagttggaggtgaggtaaagtaaaaaggcaaatggagaggctcccccaggcttgcattcttgttgagctgggccatactctgcccagcaggggccgaacacgcaggctgcagcctggccctcccttcccaggctgcctcttgccacacaatccccatttttcttgtttctgtaaacagtggtaagatcttcaaatatacaaaagcataaatggtctctattctccaattagtcatttttaataatacccagagttgctttcagagtgttgattcttagagcctgatgccaaaaaacagggatggtggtaatgggggacaggaacggggtcagggtgggggcggtaaggaggctgaattccttcagtgtggggttttcctgcagggcctccctgctgcaacccccttggaagctggcagctctccaccacctttcaagctgtccagaaactccaggcgctgtggccccaggtgtatttggtaaatgaccatctagtggtaaaaagaattcttgtggtaaaatgattacttaaaggatccatgtgaaaaagagtttgtaggtccaggcatagtggatcacatctgtaatcccaacactttgagaggccaaggcaagaggatcacttgagctggggagtttgagaccagcctgggcaacacagcgagacccctatctctagaatttttttttttaattatttggggatggtggagtgcacctgtagttctgctactcaggaggtcaaggaaggaggatcacttgaggccaggagttcaagaccagcctgggcaacatagtgagaccccatccctactaaaaatacaaaaattatctaggcgtggtggcatgtgcctgtagtccaagctactcaggaggatcgcttgagcccaggagtttgaggctacagtaagtgatgattgcaccactgcactccagcctgggtgacgaagaaagaccccgtctcaaaaaaaaaaaaaaaaaaaaaatcatcattggagccagggcgcatgtctgagttttccatgaccccagtttctttctgaccccatcttctccacttttagagggctgaaatctgtttgtgtcgttgtcatctttgagaaggcagttttgtttaaaacaagctagcagtttgttagcagtttggccactttgttttggtaagccaccagggtgggaaaattacctgtaggagcattaggctgacctctgactgtttagtccagcaggtggagagaggtctttcacatggcagagagattaagtgggtgagaaaatggaaaaggatgaaggcaatggcgcccctggagggagacctgcctctgtttttcccacactctgtcccattgacttggtgcacttcggtcctactgaagaggcagcttctagaggcccgcaggagtgcgggaggcccatttgcttatcatacacgcagagagcaaatgggcatgaatgtctcgagctttattcatgcgctggagtttgcccattggaaaagaaatgacatcctgagaaggtgggaaaatattacacttctgatgagtaaatagatgctccagctgtagagcccctgcctgctttctcctgcccccaccctcccacacacatctgcactcagtcttcaccccttcgaggtttcctgcctggactaccatagggttagttagctcaatatgtcccactcatcagtgctggtttggatcccaggcccttcctcttgtgatctggcgttttcctcagtaaatgtatatactctgctgagaagtagaagatggaatgggcaaagttggttggtgttttttttttaatttagatgattatccacagaggacttccatggagattggcaaattcccttttccgtgtacatacatgagaacatgcagtcacctttactaagatgctgagtgtacgatgtgtgatgagaacaatttgtatttgtggtaagcaaaaaccaccttgatttaagggaaaattcccgaggcagggcattgttacccagaagacctaatcgcttggaagttacctctcgggcatctagccaggttgtcagggctggaagaacaccatggaataaaaccagggagtaaatatttgagatgtgtctgggatgttgcagagtaggttgctacattctgggtctggctgtcacggtacaggtaggatatagcttggggctcatggagagtcactggcaggacttgtggtcactattcgatgagactccacttgctcgaaagtcacagagggagaatggcatagggagtggcccacctccatcggtgtagccacaaagattaccaccactagcctcttccttcctggcttagagagagaagacgggagtagaagtaacaagctgggagcaacacaactgcccgtccaccagcattgcagattgtgttccgttaaaagtttctattgtagcagaattataacgcactggattttatttgaaataagtggtctaggccttagtagtcatcttttatattgtgggatttgatttgacctgtatttgcaaaataaagcctgcatattctgtagaatatttgcagccagtagaggtttcccattgataacaaaatgccaagaggattggacacgctagagtgttctgccctcgttttccagttgtgccagccaaggcttaaagaagacaagtgattggtcagggtatacaatgagtctcaggatgccgcacctacacaggagttagaggaacgagagcgaggcacatccccgagtccttccttccacccaccacagagacaccagcaaacgccacttgtagctgccatcctccgtgtcagtcttgatggtcagagtgtaccccgcctttcccacctgcttcagtggtcgtccttgggttaattaggttgaaaatggagaaaggaaaagctttaactctatcttcaaagtaagcagataggttattttgtttttcaaagaagaggtcctatatacaattaaaacttgtttctggtaaacctcattccaggaaagatgagcttttaacaaaaggcttttgacagctgcaggctatttcattttttttaatgccgaatgaaaaatcaatacatttttctgggttatacatattcagaacaggcctgatatttccattataatggaaagtgggtgtctgtgcacatctcgcctgtcagagctgcaccgccgcattttccaagccactgctaaatatttcaaacctgatttgattgtggttcatgacagctaatgtttctcagctcttgagcctgccgacaggcaaacgcactttatttcacccccaccctcaaacatcccaccctccaaagaaaaaggaaagaacaatttcattcttcggggatcacagattggtgtattatttaagtaacatgatcatgtgagagcctcgggtacagataccctgattcttaggagaatttccaaatttctgtcacactgaggcactatgggggctttgtcaggtttggggaaggtttgaattaatctgcattatcctgttaagagttaggaacagagggactagtcttaatcattgattgactccccttccttcaagcttataagtgattcgtagaatacccgccgtggacacgtcacttggcccccattatttgggaaaatagtacctttttttttttcttttttaaacagctagaacattttcttgggtgatgcgtttggggagtgcatacagtgaggttgcggggttgaatgctggctttgtggtgatgccacctctatttttggcttctgcctggtgctgctttcgcgaaccaatttccaggttgttcataagattggtgcaaattcccatggggctgccagttggcatgctctcctccttcaggagcagatttcaccaccgatgggggaattgtgcagtcacctttaccaagatgctaagtataaggtatattaagagatcaatttgcatttgtggtcagcaaaaccactttgattgaagggaaattttctgggactggggtatcatccccttaactgaagctgtcctaggaagctttcccctttagaaggtatttatctgctggaattcttgcacttcagggctctgcacttagtcaggaagcctgagtgatgagcaggctggattttgccaggcactagtaagtaagtgctatctgggagaagcagttgtaaaaaggaggtggtgatggaaagagttttgttttgttttgtttttgagacagggtctcactctgttgcccaggctagagtgcagtgatgcagtcatggctcactgcagcctcaactgcctgggctcaagtaatcctcccacctcagcctcccaagttagctacgactacaagcatgtgccatcacacccagctaatttttgcattttttgtagagatggagtctcactctcttgcccaggttggtctcaaactcctgagttcaagcaatccacctacctcggcctctcaaagtgctgggatttacagacatgagccaccatgcccagccaaagaggttttttaaaggccttcagtcactgttgaacatggaaatgaaaggcagaagggaccctaggaagacactgcagttttccagtatttgcttttatttccctaactctttaacatgaaaacacacacaggagggggtgctccagtttgaggctactgtgggcttccgtatgggttttagagacaccttctctggtgtcttctaaaacacagagctgtctgggaggcattgggcctgctacctcctgcccagaaccagggcgggactaggggagtggggatgaccttctctcccaggtcctggccacgcccttgggaaagcattcctggtgtgctctggttgggattggaaataccattaaatgcttgaaggagaagatggttttgatttgtctgtttcagccttaaaaatggcacagtggctgttatgtgtcttggtctctttttctgtaggaaagacaggattttccagataaaaccgatcatcagtccatcaggtcttcacttgttcccaccatctgtcagtagctaatattataggggaaaaaaatctgcagcctctgtaataatgacccagccagttaccagtgacttcgcagaagaggggggaatgcaatccatgatctgtggggggaaaagcaaaaaacctcccctccattctccagcacgtgtgtatcaaatctacattcctaaagagaacaagggctagataacagccctaggagcttagcgtgtggacgcagatctctgtttcaaagcgggatgctattttgcccctggttcccacgtgtttccagggccgggagaccaagcccttccccaggcctggctcttggtaagcagcttgctttatgctttcggaaccaataaaacacaccctgcctgcaaagcatcgtgggcctgagctgtccagacaaattttcagtttgcatctctgttttttaatcatttctctacctttattggtattcagagctcacagttttccggttactgtcagcctgggctttcatccattttaaagagctatttttcctcttgctgttgatgatgatggtataaagacagatggtgtaactgcttatgaatgtcctattttatttctccaggaccagacagttcacttgaagacatatattatttccacatgctcaggttaggcggtccagactcctctgcctcctgcagccagctgcccttccgggcctcgccatgcggagggcgacacctgtaggtcctggatggaactgcagggatgagctggctgggctgaatgggacctgctttttaggtgggggtgggggactgaggacactgatccccttgaaagggagctggcttatccaggattttcgtaatcatttcttcttctaccacgcatagaacagccttttagtgaatgaatcacaaatgataatattaaacctaggaactcaagaagaggacttgatttgtaaatctttttaaaaaaagagataagcaaaataagttcttgaaataacctctttcgttgatcctctcatcggaactcagctgccttcattttctgcttgcagtagggcagggagggaagaaagcaaaagcccaagtgggctcacagaatgagagctccaggaatattcacaaagcaacatgcagtttccatgcttgatgcatcaatgatctgcttatacattacagtctctagtttctcaacagatttgtttggtaaggctcaaagaattggggtcagtgttgggtgactgtgagtttttagtgctctgctgtgatagctgcaggctgtataatgtgctggcttggagatggccccccagtgggtaaatcccttcccatgtctgctgagcagcaccttcagacactgcacatcaccatctcagggtgttctgtagtttgtaggtatcagactgtcttcatctaaggtggtcatatgtatgcactagagatgagaggccattgagccatctctttgcctaatcaaatttgattatcccatttatgctggagattgcaaattttttgtgtgtgaaaaatcagaccttggcgatgaccttgggcagtaggatataaataactcctacaagcttagtgttccaataatggaacaataggcataaatgtatcaacactacagatattttgtatcacagcatgtattgggacaaataagggtcctttaagggacctagctcatctgggtagaccgaatgcaataatattcattgaccgcacgctggtatcaccattcaaagatgaattttatcattatagtgttgaacaattttattgaaatcctaaaaatgtgcacagaacgtcccacctggacataatgaagatagttcctgtgtcacgctgtgtaatttgttattactctactgacacctatacatgtttactctactaaatgatgtatggtgtcaatgtggggctctatatctgattgacttcaagctgtggttgcctgatttttctctgtttgaactaagggtagggtagggaaacttgatgttgactttattgtgcagtgagacaaagaaggagacagagaaattatatgtggaatcctgagttggagatgaaaataaacagtaccgtatttcacctgtattcccagtgactgcctcataaactccctcttggtggtaaggaagaaagaacgttccgtgacactagttcagttttccagaccttggacctccatcatctcttgagtcaagacaatctgattctaaatagacatcttcttcctcagtgttttagaaaccctttgagaccaatttactttgtactcctgttacttccttcgtgagatacatttagaggctgttttctagacagtcagaaggcatgacatttagaaaaatggaaaagtagcattggggtagaggctgttttctagagggtcagaaggcatgatactttaaaatactgaaaagttgaattggggttggacagacctctggcggtgctggatagaggcctgatccagtgttctaagccagacccagtacttccttgctggggtctggtctgctgacagatgtgggcatccttgccctcacgcctgtgtacctgagaaaatgtgctcttcacagcctcctaataatttcatctttattaaaattatttcaccttggtttgtccactttattcattcccttagcccactcttactgaatgcatgttttggataatgtttcggagggccaggaaagcaagagagaagtgtctccccttctttccctcagcatctagagtatcttattctcttcttccccacttggctgaacgacatttgacttcataagcagcctagcgttggcagccgtcattctgccttcactgtagcactgtgtactgaactggagagaggtttcctgcattagttttaaacccgtagtgagtgaaggatggaattgcttcaaaaagaaagtgtacgactctgttacaaatttttatcccttactctacaaatctcacttcccaccactgcctcctggcatgttcacaagataccatttggtttctggaactcttcaaactgatgaactcatatcactgatattctgtgactcttcgcaacctgcatgacttccaacaattcccacacactctggcacatgcataggcactgtgagccctgtgaggggtcagtgactggggctggtctaggccagtaccaggaggctttgggaatggagctaggcatgaagtgaacaggtggccatgttttgcattttcaagtgtaaaagacttgcatgcaacttcagggattcaggtggagttactgcttcaaccaggattggtttttcagttagaactactcaagcgaagcattcagaatctatctggaaatacctaatggccacacatctggagcgagtcacaacctcataccaactgtttacccagaaggaaagtccccactgcttacccagacctcagtatatccttagcaccgtcagtctcccaggggcctctggaaagagaagggggacgagtcattggtgtctgttctgtcgttggcagttgtttgcaacagaggccaaaagtccttcatcttctttttatttttaacccttgacatgtttttcttctgtttcagaagaagccattgaagatgttgaaggacccagtgaaacagctgctgatccagaggagcttgctaaggaccaagagggcggaggtgagaaagaccagggcaagtggacaggtagtgtgtgtggctgtccttgagccttctcatctttccttccctggaagaatggagctaacaagtcagggagcggatacatccttagtctgcccagaaaaaggatgagtgggagggagatttcgtttgcttctttgagcagtcacctttattcttctttattatactacattatactgtagtttttaatggttaagctttttaagtggcaccaaagccagcttgcttattgagtatccaggtaagtgccaagctgtgtgcaagggcatctgggtgttggtcacatctctttggtggctcttcaccaaaatgcccttgatgtcattcttcctctattgaaggtccagtcgctggtcccacctgctcccaaggccagtggagagatttgtcatgtggaacttgatcagggtcacccctgattcttagcctcaagattctctaagggtcaggcacagtggctcatgtaatctcaatactttgggaggctgaggtgggaggatcacttgagcccaggaattcaagacctgcctgggcaacatagcgagtccctgtctctactaaaattcaaaaaaaaaaaaaaaatgctgggtgtggtggcacacacctgtagtcccagttactcggggggctgaggtgggagaaccacttgaaccctcaactggaggttgaggctgcagtgagccctaatcatgccagccactgcactccagcctgcgcgacagagtgagactctatctcggggaaaaaaaaaaaagattcccagctgagagtaatggctcacgcctgtaatcccagcactttgggaggctgaggtcggcagattgcttaagctcaggagttcgagaccagcctgggcaacgtggtgagacactgtctctacaaaaaattaggcattgtggtgcacgctggtagtaccagctgcttgggggactgaggtgggaggaatgcttgagccagggaggtcgaagctgcagtgagctaagatcatgccataacactccagcctgggtgaccaaaaaataaaaataaaataaaaataaaaaattactaagggagtcagcagtgaagggtggtctttgtcctgcatttgggggcctgggcagggccctgcacaggtggtgcctgccctgcatattcttcctgtcctccccctcccccagggtgagcactcatgtgctgaaatccacccaaaggggagacaagcagtgcagccaggcagggggacatcttacccaaagcagaagacattgaagaagccaagacaggaagtgctatttctggaaaaactggtgttgagagaaggagaacggccatttctcaagatgataagctttctatgttgaggggaagaagagctgagactaaaaaagcttagggtttttgaggaggagcaaagtcatttcagagaagacttaggggacagttaagccttctagaaaataataagaggaaatgatgtgacgggcaacaaaaatgattttatttggtcaacctaattcttactaccattattaatattacaatacttttgtttttgagaaaatgtttactttctggagtccgtattcgttgggcctttgttacttttccaggcatgactgttcttaaatcatgttcggtgttggacttcactatttaaacaagatacagaatcttggagagaggccagaagagagcaatgaaaatgactgaagggctgagaaatattgcctttgagaggaggctgaagaaatgggtcattcagcctagaaaagagaaattagagaggtagtacaatagttcccagatatcgggagagatacgcagggcgggtgatgtaccactgttcagtgtttcctgggagacacagagagggccatactgcagccgaatgaatgggcagcacaccaggtggattctactgtccactgtgcttagcattccccttcagactggcctgtgtggtgtccagaagcctaaactccagaaaacaatgagggtcaaacaccctaggcgatgtgtaaggtaggaccgaggagtggaggatggacatctgtgctcaaaggaaggccctgaatgtagtgggggacgtatcctcctgtggggctttgcctggaccaagatcccagttttgcctcaacgttgaatgagagctaaacaaatggttcacacggcaattaaacagatcgccaggtgagctggggaaaaggatttcacaaacacagtttgaagactgggtgaccttctgagccatctgtcctttgttgtcacgatttgggtgcttgatttctaatcctggctctgccactcattagctgtgtgaccccactcaaggtaccttgacctttctgtgcctcattttcctcagatgagatgaagattaaaaatagtacctatttctgtaggattgctacgaggattatttgactatgggaagctccgaacagtgcttggcatgttgtaagctctatgtaagttgtttgtttgtttaatggtttagtgatatataagatgaggaaaactggtagcagtttctctttgggtcctctgttgcaaggcagcatgtggctcctgggaattttgagctgagggagaagcaacatacaagcatttaatgggatcgtgcgaatgatgtttggtgcgtatgtttcgtgcattttgtgtgctaagggcactacggaaataataaacaggagccaccacttgcaaagtccctactctatgtgctgccttatgctagccactctatatgtgcctctctaatccttccaaccagtttagggcagcctttgttgagagcagttcaattaaatcttactcagagtgtttctgattcattgggagtgtgtcttcacagcactagtggacatgctaggcaatcaggagactactaaaagacgtaaaatgagcaccataaaaaatgaatgtccttaataaggttccactttctcatgcattcattcaagcaccaggcctacttaatctttacttccaaaagacagagagaaaatgaatgaatgagtgattgaatgaataactcagagatgcaccttgccagctgcacaatagtaaagagagaagggaaaattctttcccgactcctgcaaatgatcctcttttgatccgaagcataattttgtctatagtatctgagtgtgtaatgacaggctttattaaggtacttgggccgatttgatcttggaatcgatacaggtgccagcaacctcctctgagctttcttctggatccttattattttatatatatttttaaaactacgtttgttctattctctccctaaattgagctgttcctatctgattacatgtgacggggaatgcttcctcctggcaagtaaataaatagtgatttcacaatctgttatgttgattagtggctgttcatgatgcagattaataatatttcagatgggcctggataattggcattttctcagctactgattttgtagttttggggtttgtgcaggaatgggtactctgtactgaacactttcagctatttatttctacatttggagtgggcctcctggtttcctttttgggggttcctctttgggattcttttattcagatgtcaggtcttttaccctgggtggcagcacagcaagcaagatagtgatctgaactgaggttgggtcaattccacgatcaatggctgagtccctaccccatgcgaggcactgggcagagttccactgatcacaaattcagtgagattatagggcctgccttcagggaatctaacattcttctggggatttcaggaacgcccgtagtcgtaagaccgatattactatagatcagtgctgtcgaatggaacttttggtatggatagaaatgttctgcatctgaactgaacaataccatagtcatttaccacatatggctattgagcctgcaaagtgtggctggtaccactgaggaattgaactttaaattgtatttaattttaatgaatttagatttaagtagccacatgtgcagctatagataccccaaaggaacaaaactaaccctgaaagaatgcatcataggtacagcaactttctggtaattataacggctgcataaagctctaaccctgtgccaggcaccattctagagcttcacacctgtccttcccagcaggcatgccatgaattgctcacaggtacacaggtcctgcttcatctgtttatcccaatttgccatcattttctgtgtgtgccatgatgtgaaaaaaaggaaggtaagaatctctagcacatcgccaaaaggtatacagacaggttcagatttacacactggcttttgcacttattctaacttaggacagagcccaagctcttaccaatataccatctctcagagaaggatcattttcagtttgatcattagatctagttttcatctatgtctaagtataaggagtagcagtctcctgacattgtacagtgatcatagtaacacgataaccaccaggatgttcaaaatgaactggattatcaaccatggatatatgtcttgtaaggagctggcgttgtgctcagtctgaaagcgggatggtgatgtggaaagactctagatttggagtcaggaagcccaccagccagcagatgaccttgattgaggcacttggcctctttcggctcaggtacctcctctgtgaaacatggacaggggatatccactagtcccaaccgcctgagagttccaagagggtgagtggtagcacatgaacaggcccttgcgggcacatcttgtcaaggaaagtgtgatgtactcctgtgggccagtgaagggtacaggaaggttctttgttctcttccctaatgcacagccattgccactgtccaactttgtggttttctcttttgaaacatgaaaatgacccttgttctcttttaccagaatagatttgaatgtgtgtattctcgaatgaagagccccccgtgtcagcaactgagcaatgattaatgcagtgattatccaattaatcattatttgcaataagttaagtgatatacaattaatgtgatgctttatcaccaataattaggggaaaaattgaactcttggcaaagaatcatagcaagatggttatttaattcctgtagtcgtcatggtttccagccacagagtaccaggctgagtctagttaaggtaatttgggacgagatgaccagagggtattggtgcttttgaaaaatgcgggttggaggggaagcagggaaatagctcaacttgaaatgacaccacaataatgcttcaaaaatccctgacgttcatatttttgtaaatttttgagttagaatggtagtttgagtgttttcatttttctaaaggattggcctgaagggattttactttattaatttttttaaatctatgatgctcacctaacacagcaattagtgcagtggagcgtccctgatttgaatctatagaagattgctattaaaggaagtattaatgggctggcaaggtctgggtgactgttagggaaaagtacgtttatggaatatggtgctggcaggcatgattccaatcggatttgacatgtttaacataaatgtatagcgtatggctcctgctgcatatgaataattcctacagacctgctgcctttctaattactgaggttgaaaaaaagcaggtcaggcacatcctggtgcaaatctattaccagccctccccctgttttccctgttgtttacagctttgtataaatagagatgcctttgtatggggaacttagtgcctgaaatataatctgtgacaaagaatggaaaggggctgaaaaaatactttttttttcgtttttccaaattgagtctctaaggacaaaagaaggtatgtgctgagaggaaacgtgttaggaaaaatacaggactcgtaggagtcagaagccctgggttcaaggcctaattccgccactaagttcacctgcgtgacctgaggtctctggacctcagtttccaaatctgtaaagtggcaggttggaccaaatgggttattaacaattctggagcttcataaattatgactggggtagggacagttgtagagcattatagaatcttggagcatattaattactaaagttggaatgctaataactttccaagatttctcttgtctgtggctagttaatataccctggataaaaggctcaaggctttctcaatggaggtcaggcagcaccaaggctacttttcttgatggaatgtctgagcaccatatgcccttacctagttctgtgttcttgggacagacacactgtgttgtcagaggcagtgtgatgaggacatcaacagaggagtccttggagactcacatgggtgcctttgagtggccactcatatcccaaccctgttgttgactagaaaccaggccattcaacaccaccaccatacctctacaaaaatcattttggcctaactctgtatctttctggtacttggtttcatttctccacctcacccaaaagtaaatttgtctttgcagtaggatgcatgtgagggaatactgggagcccattttgcgtggcccctttgtggttcatggtcctgccaatggaaaccatttttggttttatgttttcacacgtagattggaattgtgtgactgtgtcaccttttccagagtcagcttgtgcccccttctctcactccccactcttttttttccaggccactttcagtatacttggctgcttaaagtcactgcaggcggaattctgtctcacaattgaaaacaaatcatgaactatttttatgttgggaagccaaaatagatacaggctgtggtgtatatctggacttgcccaaattccagttaattcaaaggtcttggctttgagaatttatgttgtaagtcataagagagatagggaccacatcagttgaacaaatattttcttgcacacatatctaaggcaggtacaggacatgcaaaaaaaaaaaaaaaaaaaaactcactttctagaagtgttgtcatatgtaatcacaattatgacacagtataatgagaactatcatcaaggtatagataaagggcagtgaaaatgtagattaaggagcaaatcattgttcatcactatagaaaataccttatagatttgcatattattcttacagagtggccatgttaatcttgcctgctttgttccagctttaacttttgtgccaattgtaaagtacctctgttattataatcatgattatttaaaaaaaataccattgtgcctttccatgggggatattagagcacgttcattaggttctcatattcttcttgggtccaatgctaccttcgttttgcagcctcgagaactaagcctcacagattgggaactcgggtgtcagagttgcagtcaaatcccaatttgccttctgagtcagatatattttctacattataaagccaaagaacatgtaacattatcactttctctacttttaggaaggttggaggaggagaacttaaattctatgcttctcttgttgtcagatagagtttgtcagctgtttatggttaggagctatgtggcaaccattgatttttgtaatccccagcacctagcaagtgcttaatactgtttagatgtttcgttaacaatcaattggtaaaatagcatgacataagtacctttaagtccaagttattctactttctgctttgtagacattaaatccatgggttaataggattgtttcatcctggtatagagaaaagacaaatttaaggtgtctttgcttgtcttaaaaaccaagtttcagtgttacagcttttagaatttgtctagcaggctttccgctcttcattggaaagcccataaaaacaaaaaaataaacaagtttctcccctcgttctatggttttatagccccagcagtattatttcccaatccttctaaaaaagaaaccatagcaacaaatgtttgcgctttcactatgtgccagactctgtggtaggcatcatatgcctgatctctggctagcggcacagaaaccatgtgtagacagtgttatcccattgacagatgaggaaacagaaagctcagtgtagtcagataggatgctcgaggtcacacagccaggatgtgaaccaactgtgaccagcgctacaaaatattgtgctttattacctagcaaggggggctgaatgatgccttcgggtaaagagaacttggccttaggcaaacaacaagtgaaaaaacatcagttcctgaggagtacctgaaggtgctccagaaccgcctccccatgtcttcacacaggtcacttatcctaggcctttggagcgctgtgagtgagctgaatgtgggaactcaatggagacggaaagcagcactgatattaaatataaacattacacaatgtagggtgtctatctctctgtactgtacaaaatgccaagagatgttgacagtctttgtagtgcttaaatctggaggggaaagtggagaatcattcccattttccagccttgcagggacctgagtaatgtctttcttccctaagtataagttctcacattttcctgtggaacctgactagtaaaaagaaaccctaggtggatcatgagggaaggccagtttgtaaggttctgataagttatattcagcagttctccctgtctgtcaccattctggacacacacccacattttacctgtttatgttcacaagttcactttcactcttaaaatttagtattttaggaagatagatttggaatggagaagaaaccagaagaatattgttatattgcagtgtctcagagtctagactgtgttggggctcaaagaccctaactaacctaattattgtttgactcggtggagactgaatggccctctgttaattaactttggccggatcctagaatgactcgcatgcgactggttttgatctatgtcctgcacctctgggctttttcctctgttggtccaaaggtttctgaggttccttcccactctggttgtcttcacagtcctgtaataaagccacagggaagcgtaataagtgcagaccccctagtgtgtccctggactgtggccacccatcctcacaagataccatggccatagctgcagtaagctatgccaggggaagacagcatattttgggggaaccaacaagaggccaaagacaggcaggttgactcagtacctcaaagtcaggaatcaggtcaaaatcaaaatcaggaatatttagcaggcctccaaatcctggcatgagccgggctcacggtggcagtccagtgcctataatttattaaacagaccaacagctgatgttggtctaaaccaggtggtggctctgttttgactggtggttcatttgcaaacctgacacacagggagcaaggtgtcttgaaattgaaatgtggaatggccttttgggaactcaaatcagtgtggttaagcagccttatgcatacttcagcaaggaattagtgcaacagattgatgtctctgatgtagggcttagcactatttttctcccaaaatacgcagagcaagcagcagcacccaccggtcagcgtgtgcccaccatcccaccttgaggcttccagagcctgccagagaggctgcttcctgcagagaaagcagaggccccacagaatggtgcctgaacccccattcccagattgctgacttgtgcaaatgggggctagcatagatctgtgcatgcttccagggctgaagcaaagagggccttcagctgctgaggcctgcaggtgcctgaccgagggaagccagcactaaaaagacgcttcctctttctgcaaggtggaaggagcccacaggtatttgccctcttttcacagaggctctccaggacaggacatgtggaaagaaagagatttctgtaaacaaggaagtctgtccttattctggattacgctaacagaacacatggagcttattccttctgaatttctggttttgaaggtgtctgcatttgttttagagtaagcaggtggcctgagggtgttttaaaacatctaggctatgagaccaaacctggctgtcatccctgagtttagatgagagtatcatgtcatcagagccatttaaagtggactgacagattggcccatgcttgctgggccctctcatttatttctagttagaccacaaagcagcgtggttcctacctattacacaaagccttggctctgaccactgttctcaaagtgtcgtccctggaccatcagcattacttgggaacttactggaaatgtacattatctgactcagacctactgaatcagaaccttagggcaggggctgtgatctgtgttttaatgagccctgcccgggagtctgacacattctggcatttgctgaacctcaaggctgcgatctcagtgacaagcgtgaggttttgagatcgacttcttaactagacagtaagtcctgagcccttgctgggttagggaggcatggagctttcctaaaggacagggaaggtgtatgacaggcatagggccctaagtcttggtagatgtaagcaagattgggggtgggggagagggagggagggagggagccggagaggcagggtcacgatgaagagtgatggaagacctggaaatctttatctaaactgcttaataagtaacacctgggtgaagtgtacatgggtcctctctatgctgttcttgagacttcctgtgaagctataattatttccaaacaaaaagtaaaatcgtaataataacaactaagagctgctggatttttaaagtgctgacctattttgttcatatttaagttggagaagaaaaatagcctttccctgagtaactcttatacctatgtgtagtataaatcaaattttctttgaaaccctttttagaaacaaaaggcctgtgaagttgatagaacctctgtgtcttgccatacctttgtaagcatattctacttttaggggtaggtgttttctagggatatacgggagcgagatagcttgcatttccttagaataagactgtgttttgaatagaaggttcttaacttcaccaggctggatgttgagacagattctgcttctttgattagggaagagagaagcctcagtttctttttagctgtggcctgaagaccgccccctgctgagtgaacatgtgcgtgcatctgcttcacacaaatccccttcccctcttcccctattcctcttggaaacatctctaagtgcttggttggaggcagaatgagaccatgcatgtttaaagaccaagttggcaggaaagcagattctttaaaggaactgttgttctctctattggggggaggaagaaaatttagctagatctttggccacttatcaagtgcagtagctccacaggagattcaagtaagaaagcccagcctgtcctctggggaaggaattgcaagcaaatgccaagagtaactctactttcaatgaaagtcagatcacaaaatccaaaagcacagatgaccctctggaaacattgcatttctgctgtctagtgggagcatgaggtatgagaagctgagagagaggagctatgggaaacacacatttcaccttccatttaattataattatgagctgaaggaccattttcagatctggtgatacatctgtgtcttgtgtgttggaatagttatcccaactcagacattaagtatggagctatgtgaatttcttttttcgctagtcaacggagatagagaaaagattgctgtaaatttctggggcaggtggcaagctggtttacggaatgtaaggcgatgagaacctctggcttacggaaagtagcatgaattaataatcatttaattggctcctccattatgttgctggtttgggagatggaaatttagatggaggggctgtcagtggtactttttagctaagagtctgatggttgagaggtgggggtggtggctgcctttggattccccacaaggttcaagtgtcaggcagcatcccagaccctcagtgggctcacctcaggacgccaaaaaggaagaggatcagcacttcggtgattaccacctccaggagtcactccaccatgaagagatgcaaaagaaacttcccagtaacgtggacagcttaatgcctgcccaggatctccccaagggagggaggcctctggccagagggagaatggtctgcatcgtaggatgcagccatgccaacagcgcactggtgtgtttagtgatgagaagatgaattttgcttaggaaacacagaaactaattctaccagtatgttggttttcttggagggcaagtggatatcttgaaaatgagggaccttaaggttccatgttttacttcatttccagtttttcttcaggcttatctttgatgaagcagcaactccacgccttacttggcttcagagttgtacagagttactagatgagaaatgaagcctgtgttggcattaagtccactgggattgcaagcacaactcttaagttttctgtggccagaatttcagtgattcggatgtcgaatttgttagcaaagattgggatcacatgagaatttgttctagcaagaatggttttatcagatgaagttataagggactgtgaatgttgaaaggctgtgcttctaccatctttgtccacttgacaagttttctaagtgatactgttccttaaagtaagtcacttcctacacaaagttttgctagccatattttcattattctatatgcttacaacgtaataaaaccatttcttgcaaattccaaacaaaactttgcatgaatgcttatcagctctcttccctattccctctaactaacatgagtagaggggtaacttttaaagtaattatttttagaggtttaatacttctaaaacaaatatgataaaatcaaaggatatctggaagttggtgtctccatgcataaatgattttccccctaagggagccatgtattgacaactgtgcttccctttgaaatgaaattcttttgcctagaatgcagaggagcctaagaggataaaatagacaatcatgaacaggtttgtttctctcagtatttgtctttgtgagttttagttggccaactcatcacagaatgaggagaagtggtggctgttggcccagagagctgacttttgaattttctgaactccataacagggacatgctagtctttcctgtgcctcatcagcacgcgttgggtagggccaccataacactaacaagcagagcaagtgctttctcactccctggaaagtctgtgtggcatggaatccatagctcacgtcctgttaagtttgagtaggagtttgacccagcatttcgttgtcacaatatcccatttacctagctttatagagtttgtcatctatagcgcattcagtcgcatgattccttaccacatttttatcccctttgaaatcccaggagcccaacatgttgcctatggaagattcactgagatttaacacatattttcatattttataactgccaaaatgagagaacttgcttttaccagcaaagtaaaaaataccatctgatgttttgcacagtatagagccaataccaactttttcatggacagttgaacttaaatgataactgtaatattaaaaataaaatgactatgtgaaaaacttaaagtgttccatgatgtcatcacctaaaggcaatgatcattttcttctagtctttttttctaatacctactttttacatagctgtaacatgggataatacacattttatcttcttttctgatttgcattctcaatgatttttccatattgcttcatagcaatcagttttaatgtcttctaatactcagtagaatggccatgccattgtttacttataccatgccctattgtaagatatctagattgtttccaaatcattttgtgattattgtacaaaccactagagttactaacgcttcaagttgtttgtttttttgttgccgatgtaaaccaaaggttccagacaccaattgtctaaactatgtcttgtctctggagtgcatgtatttccatttcacttatgtgacatcatcgcaggcttaaagtgaccagtaattgatttttaaaagtgttttgtatattgtgacatgtcttctagagtttaagtttagaaaagccttcaaagtgagaaaccacagtactttctctcttggtattcatacaacttcatttacttatgcccacgatgtatgctagtgacagaactgaagtagaaattgattctgagactctggcccttttgaagctgttcagagagaagaaacttgagagaacctctgactgtggtctgtgataaaccctcatccagcatagcatgttgatggagaacttgcacaactctttttttttttttttttgagacagtctcactctgtcacccaggctggggtgcagtggcacaatcatggctcaccgcagcctcaacctcccaggctcaggtgatactcccacctcagcctcctgagtagctaggactataagcacttgccaccacgcctggctaatttttgtaatttttgtagagatgcggtttcaccatgttgcctaggctggtcttgaactcctgggctcaagcgatctgcccacctcagccttccaaagtgctaggattacaggcgtgagccactgcaccttgccagaacttgcacaactgtttgcccatctacagaaatggtgtaacgactttggtacgatgtcttgatagggactgacattttaatgtctgaggtcaagcaagggaggggcatgtgtcagccatagttaactcttaggagccatccccacatcactcaggcaaacacaatgagattgtaactgggtgtttatagaatctgttataaggatggcattgctttatctttagagaaggggccagtgagctgcaggtggctaatatccacttctagacagatttgatctaataaaggtgcagattgtcctagatagaaactagatgaacctgaagtttgtgcaccagtggatgcagcatttcatgttaaagcagggctgttgtatcactgggaagaaagaaaaatgagtgagcaattggtgattttattttttaaaacactttataatgggtccttagctcaagctcacaaaagaagctttagaattccagagcagtttgagtttggaaaaaaaaaaaaaaagaagttcccctctccatgcagggggaaagaatagtggcttctgaaaccagaattctcacctctgcaacctcaccacaattcatcatgtgttcagcattcaaggaagaggatggactctttggtcctatgaggaaactaatgctgcactgggttactgtgtttgcttttcagctctgggagagtgagatgagtcgggtggtctcagcctcggtgcccattcatccacactattgagcaagtgcacaattgactcattccatagtagggggcaggcagattgagggcatttacaaggcagtcacagtcctgtaaaacaggtgttgtttttagtcaggcagagtaacaaaaggatggggatgggtgtatggaatagaatctatgtcttagtttgcctctactggaaagaggagcagatagcagctttttcctaactatatataccctgagcctaacctaatgcctactgattggagttcacaatagagaaggtaaagaaatggctgtgacaaataaacactggaagtattatttgatgccctcacccaccccatcttgagaatgcatttgaagagttaatatatagaagataaccactaagcaaaaatcaaaatgatggagaataaggaagtttctgggggcaagggaacttaagttcctgaaacattaattaaggactccaaatgtagatgtgttcaggagcggcccatcacactgcaaggtctcaaacctgcaacgcgacgttccataggatcaggtctgagcggggccaggagatgggaagtaggccatgggggaactggtctagaatgttgcagcacctagttaatcggcagccattccatcacattaaacatccagccgtcatgtattacctttcaagtgaaaatgaataactcccattaagagcaaaatgggtttgaagtcgattcgagacagattaaaatactgttatgaatgtgtgtgttgggaggaggaggatctgtgtgtaatatgctcgtccttgtactttttaaataatagatgtcctacaaacttatgtagaccaggttaccaagatactggggttaaaggtcacaagatgtgcactctgggaagagcatcaacttcctggaatatatttcctgcatttggcaaatttcttttcaaaattatattgtggccttatgattttaatgaataaaattgattgtctaaaattgtttattaaagtaatgacagcatcttggtgtccacatcagaacaaatttcaaacccaagcataaatggaaatatatgccagataactagacagggtaaaacagaaagcagtttaacagggaataaaaattgggctttctaattcagtgacctgaatgctgagtcacattattttttcatgagggaagtgggtatatatattttctcactaccacttttattactttttttttcttattgctttaaacaaaattctgaaaaatggagtcccatattcaaaacaaatgaaagagccaacactcagatattgaccaggttatggaacaaccagatccaaccatactgtgtttaagctggaggagccttgcttatcctggataaacccttagcctggctgttttcttatcaaagtgtttgcctctactggaaggaggagcagatagcaggtttttcctaactataaaccctgagcctaacctaatgcctactgattggggttaaaaatagagaagataaagaaatgtttcctttccatccttcagagaactcctcccaccagcacttccgtacgtgctgtctgctgctcaatcctcatgggccactcctctttaaatagcgtttggtttttttggtggtgtaagcaagaggggcatggaggcatggtttgggcaagcagataggaaactttccctattcccacccactctgaataaactcttgggtctggagcactggctagattatatcttggattcaggccctgcctagttccactcctcaattatttcttccccaaaagcaaactgctgaacccaaacttgatttttttcccccacatatttggtgtgctgatactcatgtgaacctttctcaaatcacatttttcatgttgccaatgctgtgccatgttgtgattccaagaggagggacaataaagttgagagcacatctcttcttacatttctgaagcagagcatgtctggtactgaggctggcaaagcaattggtgagactttcccacccaccctcagccctactgccccccacaagccagcagattgtatctagattgggggaggttagaacagactgaatttagcttaatccaactccagagccttttattccatttctttgccttcttttcctaatgttcagttgttaaagtagtgacagaaattcatgggggagaaagaaacacttgcttcttttccaacatgcttgataaatcagtccggatgttcatccttcttgaattttggtgttttaagaaaatcctgtgctataaatgaatgttgattttcacccaacacaaaccctctgggagctggcctggtctggctgctgtattgcatcttctactttctcttttagcatcgtccagccaagcagagaaggagctgacagattctcctgcaacctccaaacgcatctccttcccaggtagctcagagtctcccctctcttcgaagcgaccaaaaacagctgaggagatcaaaccggagcaggtgaggctggaagggactctgctggtggggaggtgaggtgttttagacattggtagggaacaaacttttgggtgggcgggcttggggcacacacagttgctcaaagcagtgggtgtgttccccacagatgtaccagtgtccctactgcaagtacagtaatgccgatgtcaaccggctccgggtgcatgccatgacgcagcactcggtgcaacccatgcttcgctgccccctgtgccaggacatgctcaacaacaagatccacctccagctgcacctcacccacctccacagcgtggcacctgactgcgtggagaagctcattatgacggtaaggcagccaggagcagcaccctgtggtctttctccagggtcaaaggtgatgcagtaacatgggcaagatactgtattattggacgagaaagtcagtgtagagttggaaacgtcagaaaacagtccttgttctgtgacctttgttgtactatccctgccttagacttggcatgaccatagcccaaagtgctgaacatgtgtttctcaacctcccttatcatcctctctgccctcaggggacagaggcatggattagctaaccatttatatgaagaaatcattattcaaattcttcaaacctttactgagcaggtcatgaactagattgctcttaccttcattatgtctcatttcatcctcataacaaactctgtttttgttgtaaaagggagccaggcacactagctcacacctctaatcccagttctttgggaggccgtggtggggggattgcttgaggccaggagtttgagaccagcctaggtaacataatgagaccccatctctacaaaacatactttaaaattagcaaggcacagtggtgcatgcacctgttgtcctagctacttgggaggctgaattgggaggatcacttgagcccaggagtttgaggttgcagtgagctatgattaggccactgcgctgcagcctggctaacagagggagactctatctctttaaaaaaagaaagaaaaaaaaatttttttgacacattcccatcagcagataaggaaactgaggctcaaagatgttaactgacttgatgccatttgtaaggagcagagttgagatttgaacccgcaatttccaactctagggtagggagtttctcagtggatactttgatttttaaagcaagaaaatggtgagctggatattgctgattcgtgaatgtgggttttgcatttgaacatgatattgctacaactgcagattttgaaagcatgcccctaagtgaccactataaacatggcctaattagtgtaaagatgtaaatctaattgtaatataaaaacttttcaaaatagtgccagtgatggtgatgtcctacttttgactatgttggtgctgctatgaaagtcatttcctggccaggcgtgggggctcacacttgtaatcccaacactttgggaggccaaggcaggtggaacacctgaggtcaggagttcaagaccagcctggccaacatggcgaaaccctgtctctactaaaaatacaaaaattagccaggcatggtggtgggttcctgtaatcccagctactaaggaggctgaggcaggagaatcacttgaacccgggaggcagaggttgcagtgagctgacattgcgctactgcactccagcctgggtgacacagcaggactccatctcaaaagaaaaaagaaaaaaaaggctgggcacggtgtctcacacctgtaatcccagcactttgggaggccaaggtgggtggatcacgaggtcaggagatcgagaccatcctggctaacacggtgaaaccctgtctctactgaaaaataaaatacaaaaaattagccgggcgtggtggcaggcgcctgtagtcccagctatgcaggaggctgaggcaggataatggcgtgaacccgggaggcagagcttgcagtgagcagagatgcgccactgcactccagcctgggtgacagagcaagattccgtctcaaaaaaaaaaaaaaaaagccctttcctgatcattagaggaaaaaccaccaaagagaattattctcacctctttcttagcattattttagcagtggagtaataagttaatttgattgccttttcacgtgaagattcccagagaggtagtctgttcacaactgcacgttataatgtgcaggtcacagacatatcacctccaggcattttctattccatttggttctgcaaacgttaatgaataacgttgtaagtgatgtttagtcatgaagaatatataattgatgatgcatcaagagaactttagcagccaatgggaagctcaaaggtgacctagccatgagttgcctttcagagatctttgaagttaaattaactttctgtgggtattttcaaatcagctggtgaacagtgtgtaaagattctctgtaagtgaaaacctccttctgtggaccagtgggtttctgtgttactggtttcctcagctttctcatcatccttggaagtaacaggcctcattgtacttcccatctgatggcctagaaccatgggagcctgaaagaacagaaagagatgtggggagggaagcattgtcaatactgacctacatttttcttttactcaggtgattatttttgctattttaatataaatctagtctagggactgtgggcctatagtaatctacatgactggtttacattagtaaaaatttcatttatatatccctagggactagagtataacttatatttcaaatattcattgtttgtcatattttcataatagcaatagcaaggtaaatttcaagtgacaagtgtggtggtcattgtgaatcttcatttaccaacagagtcttcaagggcaggatattacttctgtgtttgcttgggtgccaatccctaagagatttctggaagttacccattaactagcacctttggaagcagtgattcttaacctttatggagactctcatgaaagctatacaacagccatactgtattattctttgcataccaatgtttgataaccactgttactgaccctccgtcaagtattttgcaaatataaaattgtgtgtacaatgccagggagcataaggatatgtccatgggactggtcaatacaaactgttctagaacccctgacaatgtaattatgtaggagacactgctccctaaagcactgctgggcttggtaccttgtatagaaacctctatgttcctcatctttccacagcagaccatggagatgttttctagacatttctgagaagtgtgcagattgtgggaaatgcacttgtaataggaagtcaacttgttagcaacaagggaaagtcaatggattcaggaataaagttgaaagttatgagaaatgtaatcatataagtattttactttttactgaaagatgtatatgcaaggatgagttttctctttgcatggagttatggcatggctgtcagtattgaactggtttgtccagtcatggggatagtttgcattgagccaaactatgcatttctatctcaggcctttagttcagcaggaaaaaaaaaatgagcaaccagggttagagggaatttgtgggcctaccacaaggtgaacctgagatcgtatttgaggactggaatactgatgatcttgatctctgctctgatgaatcaaagcagatgccagtgtctttcctctgaaaaatttggtgtaaaaatggaatttgcaattgtttcacaactaagtgattataatgaacctatggttaaaatcatgccacgggagggtattttactgtcattttattagaagattggccccgggaaagtattggttaggctttctaacgatatatgtttgttcatggccaactagagcaggaaagtgaaaacagcatgatgaaaaatgcccctctaatcagggctccattttctaaaccatatcattaaggaatggccagttctacggtcattcatgctccaggagaaggaagttatgtctgctttgtccctgagtggctaggatgaatggcagcaagagtgaatcttctttctttccaaatgggttgactgagttagttgccattggctgcagaataggaaaagcttgcaaaatcccccaaatagatgattcctggcagacatggggtgtgtccggggtatttacagctgtaaattctggtaaatattttttgctgtctgtgtccaaagtctcaggatttagcttgagttcggttcagtcccactaaaagtaaattccaccctgataaatggaaacagattactttctacacaacgtctttctgttcagttgtaaatggagtgcgttttgaggaggcttcatttaataataccttatcagacagctttcaggaacctgcagtgtctaatatgtctgttgctatggtaacagctgcttgcttatgctctgcatctcatatctatgtcttccatgggcccccttcttactgatgagggggcttgagaaatattctccactaggaacaattgcagtgctggccctccactatggagaccacacccacagcacttcattcttcttggcctattggaaacagagctgcaaagagtacctctgcacacgtcatatcaaagaaggaaatctataaagcttaagggagatgagacaagggcccctccacaactggctgggcagccctcccccaatgtcagttacacataagaactctcacctatttacaaagaagcttgagatttcaaattggtgaaagagatgtaggagctgctgctcggtgcccttattttcccattctttcaggaaagaagggtggaaggcatggggcccatgtttctgtcccctgaatgagaataggaaagaccacctaccatgcatttcaatactcttaaattattctaattgatcactatctttctaagtgacaggacacaccactgggatcctgaagcactgatatggggaaattctctttgttctttcatcatttaacaaaatatgacctcataatggagatgggattggctcctgggcagcttaggaacaccttctgtagccctttgtcttggctccctttggtagttcttaattattctgtattttttgtacctgcacagtttcccttccatgctcctggccctgtgttgcctgcacttttctcggtatctcttttgagaccaatagtttgtaaccttgtgatttttttccgtcagcgtctgtgactctctatgcttcatgtgtgtctgtgaatctctaggacaggctggttatctggggctctagggcagccactggcctgggggcggttgcacccacctgggtaccagctctctcactttgcctgtatcttaagaggaaggtaatgaaaataatcagccttcattaattccaagccctgtgagatgatagccatttggagcctgtttgccaattagatggtctaaattagaagtgaccttggtatactgccactgcttccctctctgagtctaatgaaggttttctctccaattcattctccttctcagttctcacctctctgcgcacacgtgtataactcttcatgtgtttcctgttctcccatctaccttttcaatctttctcatcctcagtttcaaaaatctggttctgagctacatttgtttccagcctacatgaatgttaacacggccctacagtattttcttttgagcttgatgtatttaaaaattgaatgaactaccatacagaagcagttttagaaaggaaacaaggaggccaaagtgggaagatggcttgagtccaggagttcgagaccagccagggcaacatggcaagactgtgtctctaccaacaaaacaaaacacacaaaaaattgctgagagtggtggtgtgtacctgtagtcctagctactcaggaggctgaggcagaagaatcacttaagcccagcagtttgagcctgtagcgagccatggttgtgccactgcactccagcccaggtgacaaagtgagactatctcaaaaaaaaaaagaaagaaagaaaaggaaatgggacaaggagagaagaagctgagccttttaaaaagacgccatggcccagtattctccctggcatatgtagaagactgtaaagtggggtggggaacccaactctgaaactctactggcaagaggcgccctggtttgttggctgtaagtgtgcagaaaccagccagtgggccccagtggctgtctaggtacaggaaaggaagtgagcaactggcctctcgctggaacagctggctttagatataccaactagctagactgctcagccctaaaagcagctggcttttaacttcatgcttaatgttttgggcagaaccagtctcatccacaaggatgtagagactggcttggtctgtgccaaggaggtctgtgcctgaggtctctcctctttttgtctgaatttcttcattctattgattttcaattaaaagtaaaggatttgaggcatccttgggagcctaggtatcggcaaatctatactttcacctggaatagtgggcttttcagaaagaagtcctaaagtgagcaatgccaaggcggtaggaataagggtctcagagaaactaggttcaccacttttgctaagaaaatatctctgctggccaggcgtagtggctcacacctgtaatcccagcactttgggaggctgatgggggcagatcacttaaggtcaggagttcgagaccagcctggccaacatggtgaaaccccatctctattaaaagtacaaaaaaaaaatagctgggcgtggtggtgcacatctgtaatcccagctactcgggaggctgaggcagaagaatcacttgaacccgggaggcggaggttgcagtgagccgagattgtgccattgcacttcagcctgggcaacagagcgaaactccatctgaaaaataaataaataaataaataaataaaatctctctgctttccagcacacagaatgtgtctggggcatcgatctaacctaggtgagcctgtctgcaggtagcttcaagagatgaattggcatgaacggtcccataagaacttagcaaagggtgaccttggctgcacagggtgttatattggcccttccacatctgtgacctgcagggattggcataagtggcaggatggtgttccttataactccagattctaccaagaaattatatatttcagcagcccctcccaaatgtcagagtgggagactagtcccgtatctcagacacgggctgtataaggtgtgcccttgaggctttagggtccactcacctcatagaatcttgaaaagcattagaacataatccaaaataataatgaaccaaactaggaagagcttggaactatgtatttatgaacctatatgttacctctcctagtagatcaagggcagttcacttgagtacatggatttccttctggggagcttgtaatttcctaaaattatctggaatattctttctgtgaaagtattttcctaggagtctgcaacttgtattagatttctaaggcttttgtgacctctaaagggttatttattctgcatcataagccttttggagacaggaacttttgtctggctctctgcatctcagaagcatgcagcacatggatcctgtacagtgtttatttagtaaatggtggtcaattgaatgaactgagagtttctcaaggctactccttttcaactgtgttattttggaagtgcttaagcttgaacatttttagcatcaatgtggaacgcttctgtttctattatatatgaaaattacttaaactgggaggttttgagcactggagtagaactctacatttcttttgttatgcatgaaaacctgtttgttaggaatatatcagagccactgttggcttccaaattttctgcaccccagtcagctgatggtttcttcccaagtttccatgaaatgtacatgtactctgggaggaaggtagttgaactggctcagaaggtttgggaggaaaacgtggtgtctagaagatcaccatggaactgccttttgcatggcagaggccaaccttgagagacccaaaatgctgtaatggctgtaatcagttgaattttcttaaccagaaaaacttttgtcttctcattacttctcaggttcattagtgaatagagtgggggatataatttaatgtattaaatgtttattgatgtatggattatcggaataatcaatgtggatggtacattcaatgtagaaagtgtaggtgtttgggctgatttgtactgtcacctggccaaaccttagaacttttttcgtttggctcttgagtccatggctggaagtatggacattgtaggattgcggccagagaggggaagaaggaacagagagaaagcatgtatattgttctgcaggaaaattggtggtaggaccagttatttgagggcctctgaaatttggcacacttggcatgaccctggttatgctacaaccaggttttgtcttctcataaacctacatgtttcagtgttcctggcaaaagggaaggtctttacctgtgctcagcacagctgggatggattgattgattgattgattggagacagagtctcactctgtcgcccaggctggagtgcaatggcgcaatctcagctcactgcaacctctgcctcccgggttcaagcaattctcctgtctcagcctcccgagtaactgggactacaggcatgagccaccacgcctggctaatttttgtatttatagtagagatggggtttcaccatgttggccaggctggtcttgaactcctgacctcaaatgatccacccgcctcagcctcccaaagtgctgggattacaggcttgagccaccgcacccggccgacagctgggttattactttcccattttcagctatccattagagactatggctgggacagtctgaattccatgcagtttagtagccagatatgattgtaaaacaaagggggtgccaaggcaagtgttgaaggaagtctgcctttggatatatatatcacctcagtgagcagaaggactcctcaatgggctctgttggcaggattgtttatggctcttcaagataaagcatgaaagctttgagtaaaaagctttggaagctggtaggagagggaagaatgggcaaagggaacgttagtgtctgagaactgacatggggccctccagtagcctgtgtagcaaggcagcttccattctcaacctctgttgagacacatgcacagacagacgccacctgaatttccagatccttaggattctctttaggaatcttcctctttgcctcctgggaatttcttgcccatcaaaatttcatataccaaccccccctttttttcagggagaggttgggtacactatagatgagaaaaatgcaggtggataaaagtagttacttaaacacatatggggcaagacttacaggtttggaggcccagattaagatgcagaggagcatgtgaggttgatgattatatttcggggagagttaattgatggaaggtgaaggcagacaaagaaccgctgcttactgccttcttgaatcccaatcaggaattatgattaaagtcgcagcgagacaacagagggctgatgaattggtgtcttttttttttcttttttgccgtcattcacacttgattgacttcaacctttcaagtgcaaaagtctctcttttccattattattcatagccatctgagtttttctaattaaagtgtatgaaaacaattactgatccgtcgtactgagtctgttagaggggatgtctgccttactgtaatgtgtatgaaaagcccacagttttctataatgatgtgcagctgaggtgttagataattttattcttttttactctgtagggctttttttttatttctcatgattcatttttcataattcctaaagatcccaggaaaggactgatcttgcagctacaaccgagaaaggaggtgggggggagtcttttttcctttccctttctccccctcttacccccaacctcgtgctccccctcagctgaggactacaaattaatcggtgacctttcacttctcggattcccgctggactccccaaccacactagtcagaaatgccttctattaaaaagaaaatagatggaatgagtttggcaatctccactccattcttaacgattcatcaacagctagccttaaccagctgccgatgagctttgtgtgaggtgcagatgtctgtgggggcaagaatgctatgtcacacacattcacctgccacacacctgctcttcgtaaacacagcatttctcagaatgcttctccatggtacctgttgcttactttttgcacccgctggcatctgggttgctgaaattattctaatacccctaagtgtgatgaggagttatcctatgttgatgggggtggctgtctgggtttcctctagttgtcaagcttattgctgatgattctagtggacatctcagtagctattttgagcaaggctgggatcgtcacaccattaaaaattaatagtaatgtatttaaaatattatttaattttgaacagaaatctacgtattccaatctttgcaacagacagtgaagatgtctgtgcagtacggttgtgtttgatggaaaaataatgtctccaagtggggctgggtgccacgtagaaaggttagtggtgactgtagtttctggtcctgtaacttctaggtcagtccatttctccagctatcatcaaatgggaggtggtttctaattcatttgaaatatcatcgccacctacccttcccaccccatatcaggcaaaaggatattgcttctttttgaatgaagaacctttgatctttccattggatatcgagggctgcttatcacattaacataaggcaaatgataacttgtttggacaggcttctggccgtacggcagggaggcctagagaaatatctgaggctctgcccaaaagttgcagctgtttggatccaggcgatttccagaactgctgtattgagaaaaaatggccatggtcaaggtggggctgccctgttgtagaatgctgtgcaggccaccctctatcgctgggacgttggtcagaagttccctctgatgttgtataccttgggcagagactccagaagaaatcgtggcttaagtgagtcacaaaaaaaggcttgtttgtgcttgatgtcagcttgtaaagggttacaaatgttgttttcctggaaaatctgccagcatgtctgcgtgtccctagccttccctttgttctcttcttttcttcttaccctttccttcactcttactcccctcctcctcttgcctgaatacgttctgaaaacagtactacaatgctccctgcttcaagattacagtgtactttactaggtatgatttaattagggcccttattatgttttcagcagcttaaggtgggcctttcaacttatctacctaattggttgcacaagaagtttcacagcccatgacaaaacattgtcagtgatcaaagtcaaaattctgcataaaggaaaaatattaataagaagattattcttcaagtgtgcactgctaattatgtccagaatgtaaccgtagaaacacttttgactgatgtgagctttgtctaataaacatgaatcttcagtgagctatgaaaagtgagacacctctagctttacactggtgaaggctaattttgcttattaaataatttttaaacatttcctattttgtgtcgctttcctctccatttgactctccttgctcttgctcctcaggtgaccacccctgagatggtgatgccaagcagcatgttcctcccagcagctgttccagatcgagatgggaattccaatttggaagaggcaggaaagcagcctggtcagtatcattattcttgaccccaagaaattgaaacaagatggaatgccaaaatgttcatggagaaaggttttcaggaattctttacaatactcttaaggtgaatgtaactgatcaggagatgaggggcactgtcatcagctactttatactctgcttcttggcatgtatttgtatattactcacatggtttaaagtgagagaaaattagtatgagaaccagtggaattctggcacagacacacacatcttcttaaactatacaattagggagtgaataaccagagactcagtcagtaggccctaccattctaagccattaaacactgtatttctgaggacttaattagtagggacttgtgggttgatttttaggtacactggattagttgtctttcgttctgagttttttgggattggcttaggatgaagcacagagatgctgatggaaagaacattgttgtagacagtagttggtgccacatagtgtttcctggctagatgaatggttagacctctgtgaggctgtcctacatcgttcacctctaaggtgggaagagttctaagttgggaagagtttggccacactactgtcctgccttctctctttcttgtgagttttccatattagacaatggacaaatgacctgttaaagggtctcggtatttatgagtgtgatgatctcattgtagggaaaaaaatgtattttaaataattgaacacttgaatgttaattgcttattgaatagagatggcaatcagaagtcacattataacaagaaattaaatgcctaaaaatatgtatccccaaatttcttatattacgatgttcagcagttcttgtaaattcctcacaacttaggacagcattaattcacatattctacacttcagatctactgtgctaaatgcttattacataaaagatgaacataaaagggaaatccagtctaagatcagtaaccttcaaaccagctcttgagaaattgaggattctgagtcaagcaattaaatgctatttaaaagactgttagatctgtgatatgacatgggtctattatgcattgaaactttttgtatttccttttatccatctctgttcatgtgcaccctgtttataatatgtgctctattggaggaacaaaagaaagcaggaggcgctccgcagagattctgtcattcaggttgggcacttccctcatcatcagattctgtgttcatgaggcctgactaggtagaccgctctgggtgccatccttgaaacaaagccttctttatctttgggtttgattttttttttttttttaacagaaacctcagaggatctgggaaagaacatcttgccatccgcaagcacagagcaaagcggagatttgaaaccatcccctgctgacccaggctctgtgagagaagactcaggcttcatctgctggaagaaggggtgcaaccaggttttcaaaacttctgctgcccttcagacgcattttaatgaagtgcatgccaagaggcctcagctgccggtgtcagatcgccatgtgtacaagtaccgctgtaatcagtgtagcctggccttcaagaccattgaaaagttgcagctccattctcagtaccatgtgatcagagctgccaccatgtgctgtctttgtcagcgcagtttccgaactttccaggctctgaagaagcaccttgagacaagccacctggagctgagtgaggctgacatccaacagctttatggtggcctgctggccaatggggacctcctggcaatgggagaccccactctggctgaggaccataccataattgttgaggaagacaaggaggaagagagtgacttggaagataaacagagcccaacgggcagtgactctgggtcagtacaagaagactcgggctcagagccaaagagagctctgcctttcagaaaaggtcccaattttactatggaaaagttcctagacccttctcgcccttacaagtgtaccgtctgcaaggaatctttcactcaaaagaatatcctgctagtacactacaattctgtctcccacctgcataagttaaagagagcccttcaagaatcagcaaccggtcagccagaacccaccagcagcccagacaacaaaccttttaagtgtaacacttgtaatgtggcctacagccagagttccactctggagatccatatgaggtctgtgttacatcaaaccaaggcccgggcagccaagctggaggctgcaagtggcagcagcaatgggactgggaacagcagcagtatttccttgagctcctccacgccaagtcctgtgagcaccagtggcagtaacacctttaccacctccaatccaagcagtgctggcattgctccaagctctaacttactaagccaagtgcccactgagagtgtagggatgccacccctggggaatcctattggtgccaacattgcttccccttcagagcccaaagaggccaatcggaagaaactggcagatatgattgcatccaggcagcagcaacaacagcagcagcaacagcaacaacaacaacaacaacaacaacaacaagcacaaacgctggcccaggcccaggctcaagttcaagctcacctgcagcaggagctgcagcaacaggctgccctgatccagtctcagctgtttaaccccaccctccttcctcacttccccatgacaactgagaccctgctgcaactacagcagcagcagcacctcctcttccctttctacatccccagtgctgagttccagcttaaccccgaggtgagcttgccagtgaccagtggggcactgacactgactgggacaggcccaggcctgctggaagatctgaaggctcaggttcaggtcccacagcagagccatcagcagatcttgccgcagcagcagcagaaccaactctctatagcccagagtcactctgccctccttcagccaagccagcaccccgaaaagaagaacaaattggtcatcaaagaaaaggaaaaagaaagccagagagagagggacagcgccgaggggggagagggcaacaccggtccgaaggaaacactgccagatgccttgaaggccaaagagaagaaagagttggcaccagggggtggttctgagccttccatgctccctccacgcattgcttcagatgccagagggaacgccaccaaggccctgctggagaactttggctttgagttggtcatccagtataatgagaacaagcagaaggtgcagaaaaagaatgggaagactgaccagggagagaacctggaaaagctcgagtgtgactcctgcggcaagttgttttccaacatcttgattttaaagagtcatcaagagcacgttcatcagaattactttcctttcaaacagctcgagaggtttgccaaacagtacagagaccactacgataaactgtacccactgaggccccagaccccagagccaccaccacctccccctccaccccctccacccccacttccggcagcgccgcctcagccggcgtccacaccagccatccccgcatcagccccacccatcacctcacctacaattgcaccggcccagccatcagtgccgctcacccagctctccatgccgatggagctgcccatcttctcgccgctgatgatgcagacgatgccgctgcagaccttgccggctcagctacccccgcagctgggacctgtggagcctctgcctgcggacctggcccaactctaccagcatcagctcaatccaaccctgctccagcagcagaacaagaggcctcgcaccaggatcacagatgatcagctccgagtcttgcggcaatattttgacattaacaactcccccagtgaagagcaaataaaagagatggcagacaagtccgggttgccccagaaagtgatcaagcactggttcaggaacactctcttcaaagagaggcagcgtaacaaggactccccttacaacttcagtaatcctcctatcaccagcctggaggagctcaagattgactcccggcccccttcgccggaacctccaaagcaggagtactggggaagcaagaggtcttcaagaacaaggtttacggactaccagctgagggtcttacaggacttcttcgatgccaatgcttacccaaaggatgatgaatttgagcaactctctaatttactgaaccttccaacccgagtgatagtggtgtggtttcagaatgcccgacagaaggccaggaagaattatgagaatcagggagagggcaaagatggagagcggcgtgagcttacaaatgatagatacattcgaacaagcaacttgaactaccagtgcaaaaaatgtagcctggtgtttcagcgcatctttgatctcatcaagcaccagaagaagctgtgttacaaggatgaggatgaggaggggcaggacgacagccaaaatgaggattccatggatgccatggaaatcctgacgcctaccagctcatcctgcagtaccccgatgccctcacaggcttacagcgccccagcaccatcagccaataatacagcttcctccgctttcttgcagcttacagcggaggctgaggaactggccaccttcaattcaaaaacagaggcaggcgatgagaaaccaaagctggcggaagctcccagtgcacagccaaaccaaacccaagaaaagcaaggacaaccaaagccagagctgcagcagcaagagcagcccgagcagaagaccaacactccccagcagaagctcccccagctggtgtccctgccttcgttgccacagcctcctccacaagcgccccctccacagtgccccttaccccagtcgagccccagtccttcccagctctcccacctgcccctcaagcccctccacacatcaactcctcaacagctcgcaaacctacctcctcagctaatcccctaccagtgtgaccagtgtaagttggcatttccgtcatttgagcactggcaggagcatcagcagctccacttcctgagcgcgcagaaccagttcatccacccccagtttttggacaggtccctggatatgcctttcatgctctttgatcccagtaacccactcctggccagccagctgctctctggggccatacctcagattccagcaagctcagccacttctccttcaactccaacctccacaatgaacactctcaagaggaagctggaggaaaaggccagtgcaagccctggcgaaaacgacagtgggacaggaggagaagagcctcagagagacaagcgtttgagaacaaccatcacaccggaacaactagaaattctctaccagaagtatctactggattccaatccgactcgaaagatgttggatcacattgcacacgaggtgggcttgaagaaacgtgtggtacaagtctggtttcagaacacccgagctcgggaaaggaaaggacagttccgggctgtaggcccagcgcaggcccacaggagatgccctttttgcagagcgctcttcaaagccaagactgctcttgaggctcatatccggtcccgtcactggcatgaagccaagagagctggctacaacctaactctgtctgcgatgctcttagactgtgatgggggactccagatgaaaggagatatttttgacggaactagcttttcccacctacccccaagcagtagtgatggtcagggtgtccccctctcacctgtgagtaaaaccatggaattgtcacccagaactcttctaagcccttcctccattaaggtggaagggattgaagactttgaaagcccctccatgtcctcagttaatctaaactttgaccaaactaagctggacaacgatgactgttcctctgtcaacacagcaatcacagataccacaactggagacgagggcaacgcagataacgacagtgcaacgggaatagcaactgaaaccaaatcctcttctgcacccaacgaagggttgaccaaagcggccatgatggcaatgtctgagtatgaagatcggttgtcatctggtctggtcagcccggccccgagcttttatagcaaggaatatgacaatgaaggtacagtggactacagtgaaacctcaagccttgcagatccctgctccccgagtcctggtgcgagtggatctgcaggcaaatctggtgacagcggggatcggcctgggcagaaacgttttcgcactcaaatgaccaatctgcagctgaaggtcctcaagtcatgctttaatgactacaggacacccactatgctagaatgtgaggtcctgggcaatgacattggactgccaaagagagtcgttcaggtctggttccagaatgcccgggcaaaagaaaagaagtccaagttaagcatggccaagcattttggtataaaccaaacgagttatgagggacccaaaacagagtgcactttgtgtggcatcaagtacagcgctcggctgtctgtacgtgaccatatcttttcccaacagcatatctccaaagttaaagacaccattggaagccagctggacaaggagaaagaatactttgacccagccaccgtacgtcagttgatggctcaacaagagttggaccggattaaaaaggccaacgaggtccttggactggcagctcagcagcaagggatgtttgacaacacccctcttcaggcccttaaccttcctacagcatatccagcgctccagggcattcctcctgtgttgctcccgggcctcaacagcccctccttgccaggctttactccatccaacacaggtgggttctgctctaggcgattgtttcagggctaaatagctgcccagtcagcattctgttatgtggataccacccaaaccctctgagtgctgggcagatgggaagcttacctttctagttctttaaaagcaacaagacttcagttcgttcctgttgagtctcccaagtactggtgtgtcagggatgggacctcctggtcggaacagtctcctttgaaaccactcttatcccctataatagggaaaaacttgagggtcctggcatactaatttctggaatatttcaagaaacaagtttttatcatagaccctttcattcagtccttgtggaaatgctgatcctgtctagatatttgttgtaaatataagacacctgagttagtcctagctaattctggattatgccctaagaaaactggtccaagagcatttaaatcaactctttgccctcacctggggtccctgccttcttgagagagctacggtggcaaaagaactgctatcagggccgggtgcagtggttcatgcctgtaatcccagcactttgggaggccgaggcgggcagatcacaaggtcaggaaatcgagaccagcctggccaacatggtgaaaccccatctctactaaaaatacaaaaattacccaagtgtggtggtatgcacctatagtcccagctattcgggaggctgaggcaggagaatcgcttgaaccctggaggcagacagtggtttgagattgtgccactgcactccagcctgggtgacacagcgagactgtctcaaaaaaagaaaaaaaaaagaactaccagaaggtcttatgtggtagatccttaatgttggggttctcttctagccagaacaatagtggctgtttttaacaagatggccgttctacttgagtgcactgaccaggaatcttgtattgggcaatgtggttctgttaaaatactgatgcacatttcagaggtcctcagtcacctcttttttttccttttgcccatttccttttccttgctcctgatcactgagaatcatacatatttgttgctcttatagtctcacttaatagggagttttgcagttcttcctacatacttctcttgtttctccttctctgtcctcacatcttctctggatccagccatctttgctaaattggaccttcacctccagggtcctgttaggcttagacataagtctgcaaattccccccacaatggcctgaattgattagttccagttcaccaaaggagaacccctcctaatgctaccttgccttcaaaatgtgtccctgttcccaggggttaaagcagctgtgctgcttcccacagcaatcttagtttctggttgaattagttccacattttacactttgagtggtgttttaccaaacataaggccactgcattcctggtccccatttcttattcaaagagaataagaaaagaaagcattaagacatagaagttgttgcttatatgtgttgacaagtcatgtcacagaaagccagctagacataagccaggaaaacaaactatggaaaatagagaagcatttaattacccctgcagcccaggaccctggcagaggggcttgggaaggcttaacacatcatagtaatgtgaaaaaaaagtagaatcagaatgtatgatttattccgcttgttttacagatgagaaatctgagggccagagaggtcaagaccattcaacaagctagggtaggagccagagcttccacccaggcctctgggctcccaggtgctatgtgctccttccacaacacccaatatgagccagtcagtcaacaggtatatgtttagtgctactcaagttctgaccacttagagtggactcgagatagaaagataagctcttatttattcagggcagcagacatgccccagttatcatcacctgaccgtaacacagttctcaaaaacaccggatctggaatgggagggaaggaacaaacttgtgtttattaaacatctattatatgtcaggcccaatgctaagctttttctatcaatgtggtctttcatttaatcctcataaccatctgttatggaaagctgaggttccaagagttcaaccgaaagtcccagggtcacacgtctgatgtgtgtgaccataatcccacagggtcagtgtgactccagatttgtaggagtaagtctaggggggatgaagtaccttgcctgattctgatcttacagatcagaaaaaggatgtcacagagttgtgagtgtgttgagctactgtgtctagcatggctagtgcaaggcttggtaaatagtagagattcgtaaacgtttcttaaaatttgaacctcttatatagaccatcagttgaagacacacagtttaaggctttttgacctgaatctttctcctagaagtctggagccatggggatggggaaatctctaaatattccttccttgccccactgagagcagacccattgcctagtggagacagagccatgtcccaagtttagaactcataatctactctgtcttgtttgtgccaatttaaccaacaagtctttactaagcttttctgagtagagtcacacatatcttctctggtgtcttatgtgcactgaggacactgcatgatgagatgctgaaggaacctttctccttggctatccagtattaacagctgtttgtctgggattggcaatttgaagcagtcttgttcttttcgtctgaaatctgagggttttgatggtgaacactaccatgatagccagaaatctgcagtcttcccccaagtctgggcttcagagtgctttttcttgcttttttttcctcagtgtcatgttatggaactccttccccagctttccagcaggtgaggtccagatgaagtaagattttgattttgcattttggtgtcctctgaagagatgtatataccatcaagtttcttggatatggtgaatatagaggtgttctgagagctgttgcctgtgggatcctcctctttgttttctcagcttttcatcgtccagcacacactgcaccccacccccatgctgtccttacctactatcttgctagtctcaacacacctgaagcttggagtaccatccgtagcaacaccctcttgcattaccttggacctggtgactcaaaccaggagatagctatgggtcagggagggtattaggctctcgggttggtgaaggcgttgcagggagtggtggtagattaggggtatgatcaaggatgggattctagcccatgagggcctggtgatatggtcagacctttgctatccataggcagtggtgcttcgggtaggttgtgatgtcttgggaattggtgtcagtatcttgggctattccacttctgacatggcttttctgcttttcctgcggttgtttctcaaccatctacagtcccactggccctcctgtgtatcattcaaacaggggcaggaaaagaagatggtcgtttctcccgcagattccagattcctattcctaggcggttatactgttgagtagacttgttgaagcaggtcagctgggccaaggcatggaagcaattttccctgaatggattgttcttatttcttcccaggcccttcctccacactttcctattcatcatcttctctctaccctccgaaagcatccagtcagctgcagcaacagaggtcagagaggaggaacacctgtagagcctgttttgtttttgttcatgtggccgtgctagctttcttgccttcgttctctcttctcctgttgccgctctcctccagataacttctctggggacctcgtggccatactatttttgtgatgaaggcctttggtgcaaatgggccccagctagaaacagctagctttggggcctctagactaattgcagttgggcagagtgaatggtagctgggagtacttggcaaagaaaatgtgaactagcgggtgtggcacattgggcaggaaggtgttggaagttgtttggctggaaggggaagtatgggagctagccaggactgaatcttcattagaatacaaggttgtccagccctgagcctggtgggatacttctggaagttgtttggctgaaaggggaagtatgggagctgacctaggactgagtcctcattagaatacaaggttgtccagctctgagcctggtgggatacttctggaagttgtttggctgaaaggggaagtatgggagctgacctaggactgagtcctcattagaatacaaggttgtccagccctgagcctggtgggatacttctgttggaaatgttcgttttgagaggatccttcaagccttgacatctcaaactgtgtgccagtgacaccggtaaaacgtcttgagcttcagccctacccctgcccagactgaccggtgatttctgtctccattcctttcagctttaacgtctcctaagccgaacttgatgggtctgcccagcacaactgttccttcccctggcctccccacttctggattaccaaataaaccgtcctcagcgtcgctgagctccccaaccccagcacaagccacgatggcgatgggccctcagcaacccccccagcagcagcagcagcagcagcaaccacaggtgcagcagcctcccccgccgccagcagcccagccgccacccacaccacagctcccactgcaacagcagcagcaacgcaaggacaaagacagtgagaaagtaaaggagaaggaaaaggcacacaaagggaaaggggaacccctgcctgtccccaagaaggagaaaggagaggcccccacggcaactgcagccacgatctcagccccgctgcccaccatggagtatgcggtagaccctgcacagctgcaggccctgcaggccgcgttgacttcggaccccacagcattgctcacaagccagttccttccttactttgtaccaggcttttctccttattatgctccccagatccctggcgccctgcagagcgggtacctgcagcctatgtatggcatggaaggcctgttcccctacagccctgcactgtcgcaggccctgatggggctgtccccaggctccctactgcagcagtaccagcaataccagcagagtctgcaggaggcaattcagcagcagcagcagcggcaactacagcagcagcagcagcaaaaagtgcagcagcagcagcccaaagcaagccaaaccccagtcccccccggggctccttccccagacaaagaccctgccaaagaatcccccaaaccagaagaacagaaaaacaccccccgtgaggtgtcccccctcctgccgaaactccctgaagagccagaagcagaaagcaaaagtgcggactccctctacgaccccttcattgttccaaaggtgcagtacaagttggtctgccgcaagtgccaggcgggcttcagcgacgaggaggcagcgaggagccacctgaagtccctctgcttcttcggccagtctgtggtgaacctgcaagagatggtgcttcacgtccccaccggcggcggcggcggtggcagtggcggcggcggcggcggtggcggcggcggcggcggcggcggctcgtaccactgcctggcgtgcgagagcgcgctctgtggggaggaagctctgagtcaacatctcgagtcggccttgcacaaacacagaacaatcacgagagcagcaagaaacgccaaagagcaccctagtttattacctcactctgcctgcttccccgatcctagcaccgcatctacctcgcagtctgccgctcactcaaacgacagcccccctcccccgtcggccgccgccccctcctccgcttccccccacgcctccaggaagtcttggccgcaagtggtctcccgggcttcggcagcgaagcccccttcttttcctcctctctcctcatcttcaacggttacctcaagttcatgcagcacctcaggggttcagccctcgatgccaacagacgactattcggaggagtctgacacggatctcagccaaaagtccgacggaccggcgagcccggtggagggtcccaaagaccccagctgccccaaggacagtggtctgaccagtgtaggaacggacaccttcagattgtaagctttgaagatgaacaatacaaacaaatgaatttaaatacaaaaattaataacaaaccaatttcaaaaatagactaactgcaattccaaagcttctaaccaaaaaacaaaaaaaaaaaaaaaaagaaaaaaaagaaaaagcgtgggttgttttcccatatacctatctatgccggtgattttacattcttgtctttttcttttcttttaatattaaaaaaaaaaaaaaagccctaaccctgttacattgtgtccttttgaaggtactattggtctgggaaacagaagtccgcagggcctccctaatgtctttggagcttaaaccccttgtatatttgccccttttcaataaacgccccacgctgatagcacagaggagcccggcatgcactgtatgggaaagcagtccaccttgttacagttttaaatttcttgctatcttagcattcagataccaatggcttgctaaaagaaaaaaagaaatgtaatgtctttttattctcaggtcaatcgctcacactttgttttcagaatcattgttttatatattattgttttttcagtttttttttttttttttgttccagaaaagattttttgttttgttaacttaaaaatgggcagaaagtattcaagaaaaacaatgtgaactgctttagctttctggggatttttaaggatagcttttctgctgaagccaatttcaaggggaaaagttaagcactcccactttcaaaaaaaaaaaaaaataataacccacacacacaaagagtgttgaggacttgtagcttaaaaaaaataagttttaaaaactgactttctgtatttatgatagatatgaccatttttggtgttgagtagattgttgcattggaaatgaactgaagcagtatggtagatttaaaaggaaaaaaaaaaaaaaaccttttgtgtacatttagctttttgtatggtccagctgacagctcctcatttgatgttgtcttgttcattcctagcagatgatagattgcaatccgttgattcgcctaagcttttctccccttgtcccttaattccactttctctttcttgtcccttaattccactttctctttccttctcccacctcccgtcctataatctcccacttaaggtagctgccttcatttcttagagggagctgcagaattattttataaaactaaagaaagaatttcaagggattctaggggtcattaggatcctcacagattatttttggttggggagttgaaactttttaaaggcatataattctagttacctgtgtctgttagctttgtgcatttattttttatttatccttcttttggcttttttttctttgtaccccttcttttcctccttgtttggtaggagcttcaaatattctttttttttctatactaaaggatttgtttccatttgtgtaattggctgtgtacttttcttttctaaaaaaagtttttggttagggatttggtttttggttttgtgtttgttttttctttcctctctcagaaaaaaaaatttcatgctttaaataaaatccaaagacacaccctttcactgctgatgcagaaaaaagggaaagggttcttgttacttgagaatttgtttctgatttaaacaaacaagacttagtttaataaaagaaagagaaaaacaaaagattcccaggttgttatgtgcttcttctgcaagcagagaggcaaatgttaatgacaattccatataccaaaagacacattttttacttcaaagttttgtccttgtgttaggcagtctgagcagcgagtgatccagagcgcagccaacaaagcagcagatagcagtgtacagaaagcaaaaaaggaactgtatgtgaggcacttgtttctgttaatatccatattcctgttaacacacaccctttctcatgtaaaaagaaaaataaataaatggtctgaactttgaaaactttgtgctgctaaaacatagattttggagacaaataaatagatgctttgctgtttcactttcatagctaaacatcaacagaaaccatctccccttgcccccaaa

SEQ ID NO: 15780 - DNA, 13445 bp, Human
aattagtggggcatggtggcgctcacctgtagtcccagctacttgggaggctgaggtatgagaatcgcttgaacctgggaggtgaaggttgcagtgagccaagattgtgccactgcattccggactgggtgacagagcgagactgtctctcatttatttaaaaaaaaaaaaaaaagtaaacaggagtttacaaactaaacaagagcttacattctaatgagagacaaagaatgaacagaataagtaaattctacaaactattcacaagtggtaaaaactatggagaaaactaaagcagaaacacattagggggagaaagacaaaattttttcaaagcgtgagaaaaagcccacctcgagagcaacatttgagcaacaattttcatttgtaatgagaaaataccgacttcgtaaggttgttacaagccttgttaacacagcatgggcctcacctgaaagcttgttagaagctcagaatttcaggtcccatctcagacctacagaatcagaatctgaattttaacaaggtcccctggtgatttgtaagcatatcaaagtttgagaagcattaattaaaaggattaaatatttgcgtctgaaccagggctggcatattataggcactcaatagattcaataattcttagttttctttccccattaacataacccttatatctttctagttataattaagaatgaatggccaggcacagtagctcacacctgtaatcccagcagtttgggaggctgaggtgggaggattgcttgaggctgggggtttaagaccagcttggacaacatagtgagacaccaactgtaccaaaaaaaaaaatgaaaaaataaagatagcattgagtctcttcaattaattatgaatattaagcatatcctgccatttacttccttgcagatctagcagaaaatctgaaaataaagccaagttgcagacagaagacaaagataaattcacatgcagacaaattcaaactcctgactacattaatgtctctcattggtggccaaatttcagtctaatctttgctaatgtttttcaccacccacaaataagagagactgagtgtgtcccttgacatttggagatcaggaagtccaccttaaaaagacaagaggccaaaatgttgggaaaatcctctggtgataaagggaaagcaaaaattgtttaaaaacagaacaaaatataagtaaataattcaggttgcttaagtactgttttcgtttacagaaacagcaacttcaaatgagacgatataaacctgtatgatttttcttataatttgcctcctgcaaataagcttaagtctttgtctaccttagtcttctctttcctagctacatatcacaacatacttccttactgccttccttccgtcttttcttcaacgcttctgtaaattttgatttcaaaagcaacggcacaattgcgttcttctagccctagttacgcagtaatataacgacaggtggaaacctgcaggttgccacgttcattgcaaagtgtccacagtaaagataaaggagaaattcccccggcaatgaaaacgagaatgagataaattaccaaattacattaaaagcgtgctcttatgttagagatttaaagttcctctcagaaatcgcggaggattttgacctgaagcaaaagtgaacttcttccgggtggtagaaaagtaaactgtcaactatttactttgggggggtggcggggggagggtgctgggaaggaattgaggcgaaaagcctctgcaggtgacggtacaggccaataccaggaggtcaagtcgccggtgtcccttcggcccttaagtccagggaaacgcacggcgagggacgaggggcgattcccgcctttctccagccctttctccgcccacaaatgacggcggtggcgaagatccgggcccgccgcgcgaggcactctgggagcggaagaaggaggccgcgcgagggctgacgaaccggaagaagaggaactgggcctgaaagggtaccggtgaccgctactgctgccggtgtttgcgtgtggcagggagccaggcctggcgagcggggtgtgtcgcgatgccggagctggcagtgcagaaggtggtggtccaccccctggtgctgctcagtgtggtggatcatttcaaccggtgagcgagcgccctatagctgggccggcggcgcagccgctgctgagtcacgggcacgctggagatggcgcggcggccgcggacgagctggggacgcagatagggcggctggtgacccttacttgttcacgagtccagaccagcgtcggctcacgatgccggagtcatccagcctcccgcccctgccccagccgccgccacttcggggccttggctgcctgttccgtttagcctgtttgttttacagagttccctttccgagttcgttttgccgaagttcgttttaccgaaatctggatgatgctgggggtcgggagatgcggctagctttagttggccctgacccccgcccccaagctcgtgtctgtcacttcgttttgaagttcgttttgccgaaatctggataaagccagggtggggcggaggcgggctagcttcatttggctctgacccccgaccccagggtcgtatcttcatttgactcagttgatttcactgaaatgtgaataatgcaaagtgactgatgtctggatgatgcttgggtggggcggagtgggctagctccatttagccccgccccaaggctatgtttatcttcgtttgaccgaattggtttcaccgaaatatggatgatgctggagtggggtgcagggtggctaccttcatttggccctgaccccggccccagggtcgtatttatgtttatcctcgtttaaccaagttgatttcaccgaaatgtgaatgatgcaaagtgaatgatgcctggatgatgccggagtggggctaagggggctagcttcaatttggccctgacccccgcccccagggtcgtatctatgtttgtcttcatttgaccgagttcctgttatcgaaatctggatgatgctcagcaccccgaagggcttcctggatcagctgtggttttaacccattaacatttttaaatgggaatctgattagactccgtctcaaaaaaaaaaatgtatatatagatgaggtttcagtttttatttaaaacacgaggccgagcatggtggctcacgcctgtaatcccagcattttgggaggctgagacgggaggatcgcttgagcccaggagttcgaagctgtcgtgagctgagatcatgccactgcactccagcctgggtgagagtgagaccctgtctccaaaaaaaaaaaaaaaaaaaagaccagttggagatttgaaccttaatgaataaggtaaggaaacatctcaaaggtcatctagtaagctcattgtttgagggtgtacatccaccacctcttggctttggagttgttcatcctgctagacctgttgcacatgtttctaagttttacaagattgttagttgaattggcaaatgtaaagacccagttcagagcatctgctataaagccattcttgcaaagtgtccattctcccgcaacttgctgtgtgcaactaattcagctggatccggaaaaggaccctcagcctaggatatgttggcttttctacaggagaggaattactatttttctcccatgggatactaggggcaggcactatttcagtgctattcaagcacttgttaagagcactagctttcaggctagcctggtagcacatgcctataatcctagcactttcggagaccgaggtgggcggattgcttgagcttaggagttcaagaccagcctgggccacatggtgaaaccccttctctaccaaaaaaaaaacaaaaaaacaaaaattagccaggtgtggtggtgtgtgcctggagtctcagctactcgggaggctgaagtgagaagatcacttgaatctgagaggtagaggctgcagtgagcgaagatcacaccactggactccagcctgggcaacagagtgagaccctgtctcaaaaacaaagaagagcactagcttctctatcaagtaagtgtagggttttaaaaaacacaaatggactttggtagaccaaaacaaaagcccacgagtatggaagtttcccttgaagttggaaattcaatttcccccttacccccccacccccaaaaatgagaggcaccagaaatacagaatcattaactttgtttgattcaaaccccaaacctagtaaccatttatagatttgccaactatatgctaagaaaaatactacagttaaaccaatgtgaaactagcagctgttaagaaaatgtaattaacagtggcttttgtctttccttagcatagggttgtatttctgtgtcacacatttgctagtggttaaaaaatacttcttgaagaccaaggaaatgagagtgtgtaagtgatgcacttgtaactccttaggagaaaatgactgaggaggtttgaaatggagataaaaattctcaagtaaaatctttctcattcagtcctcctctattcattcatttattttgagacagggtctgccgaggctggggtgcagtagcacaatctcagctcactgtagctagcctcaaactcgaccttctgagctcaagtagtccctgcacctcagtcccccagccccaagtagctgagactacaggcacatccccactatgcccggctaagttttgtattttttgtagacagggtttcgccatgttgcccacgctgcccatgctcgtctcaaactcctgagctcaagtgatctgcccacctcagcctctcgaagtgctgggattacaggcatgagccactgcatccggcctactccatcatctttattccaaaaaagatttcaggatgggaaaagtttaaaggtgaaggaaagctgcaaagaaaaagtaaagttaaatgtggtagcaaagcttaaatgtgttttcagactaagatctgggaagctttcattttcttcattttaaatttctgtgaagtttgaaattttcccaagcatgtattacttcacagtcaatgttaggtaaaaactgccagtgggtgtcagtaccaagtttatgaattaccccttatagttaatatcaacctaaccctattacattggtttagggagattagttcccaggtaaactaaattgtatctgtgccattgatatttcccattgagtatcttattgttgggttcatgtttctgtgcgagcctatccacactgaccatctgttttctcattcagaatcggcaaggttggaaaccagaagcgtgttgttggtgtgcttttggggtcatggcaaaagaaagtacttgatgtatcgaacagttttgcaggtaaaagacaaattttatgtttttccgagcatgattaaaatgtcagtttaccctttaaaaatataaacctttgttaccgcttttgactacaacccagagattgtcttaaaattgctgaagtatagaaaagagaacctgaagattgcacactagaccagacagtaaatattttaaacttgcaggccatgtggtctccactgcacctgctcctctctgccattatagtgcaagagctgctatagacaacatgtaaacaaacaaaagtggcagtattccagcaaacctctataaaaacaggcagctggcacagtttgtcagcccctgcactaaactgtttaaccacgcttcttataggtacagtaaggagagagatggggaactttacccctttatgtgaatccttacaagaacgtacccatgtattactttaatgattaaaggaacaacaataaagaagatgatactggatgacctctggagtagagatcactaactctagtgtctaaaatgaccagctagtcatgtcatttgccaaattgaaaaatatcaggaagtaactggacttctagaaaactgaaaagcatgtgtcttttttaaagggggcagcccctacctggctgtagctggtagttgccaggtattccagttttttaagagaagctggaagtctggatttttatgtgaattctcccagtttttggggcagctcaaaaaaaattttttaatactttgctgggcaagtgaaacacgtaagtgaatcagaactggcctaggggtcttcaattgtgacctgtgttctaggtttctatcaagcaccctaaactaactttttttttcctctttagttccttttgatgaagatgacaaagacgattctgtatggtttttagaccatgattatttggaaaacatgtatggaatgtttaagaaagtcaatggtatgtcttgatgttctaaggtgttacagcatagaattgaactgtgtgtatgggggtcttctgttcgcttttctttaacatcaagggccctttcacttagctacacttcagtaagactagtggtagtagaggaataaggtagaatacatgaaaaactagagtagcaatttaaggccaaataggcgacctgggtttgggtacaaggggaaataacctctcattgcggcagaaaagtgaagaactatccagtaaagtcagtcttccattagagttttagtaccaccagggtaaatatgtctggaattttcaaagaggtaaaggacataactactgatgttcttatcctttttgagggagttgtatagatcttcatgaaatagttaaagcctgctaatttttttccttcctagccagggaaagaatagttggctggtaccacacaggccctaaactacacaagaatgacattgccatcaacgaactcatgaaaagatactgtcctaattccgtaagtggtgtctatttttaaaactcttgaatgattttttttgccagccagctcaagtaagagcatcctgggaagaatttgagtagcaaatctgcttactgctttatctccataaacttctgttgatttgtagtgctctgtgaagtatactgtgacctaatatatttgataaataatagtttatacctgctaagtaccaggtgtatgagtttcgtaatcctctcggtaactgtatatcctctttacaaatgagaaaactgaggttcagaatggttaggaaggtctggtaaggggtgggactgggattgaaattttggctgtgttgactctaatgtccttgtgctaggcactgtactgcccctcagcttattaatgaaggggatcgaaaagcagaagaaatgatgagatcatttgaagcataaatgcatttttgctgaatattctggttcatttctaattgattacaagaaatagctttagtaattgtgagaagaatgcctgaaattaccccttttgtgctgggcgtgagatgacttgctaagatgtgtttctctgccaggtattggtcatcattgatgtgaagccgaaggacctagggctgcctacagaagcgtacatttcagtggaagaagtccatgatgtaagtcatcttgctatgaacctgggaggttagactgctacttattgggtgattagcttttttttttcaattttcaggtcaacaaatcctttgtctccgtaacaaaagaaggtagtttttttccctttgacttttttaatcaccacattttggaaatggagaggaacatagaaatctaaattccaaccaggcacagtggctcacccagtgctttgagaggccgaggtgggaggattgcctaagcctaggagttgaagaccagcctgggcaacatagcaagacacctacaaaaataaaaacattagccaggcatgatggtccatgcctgtattccaagctactcaggaggctgagacgggaatattgtttgagcccaggagttcaaggttacagtgagcaatgatcacaccactgcattccaacctgtgcgacagttgagacgctgtcccccaaaaaaccaagaaatccaaattccccttttacaaatgaaaagtttaagggatgaattacggtctccttttgaatttagatatgcagtatttatccttactttcagttttaagatttagaaaagggtattttaggatagctctgtgcaaatgttccttgcatcgagctctgtcttcctggggcttttctctttgcctggctaccagggagcttagagccaaatgtattgcctaattgcagtagggctttcatccctggttttgacccagttgtttttagtgaatttttctcctgcctctttagaaaaggaattgaggttgctcgtacacatgcaccccagtgaagcaaggtgtttttagtaggggataaaggggacatatgggtcatgttacaaggtgaagctcaagaagaattagtgcctgtaaaggttaccaagaaatcccacaacactgttaaaggttctgaccatcctggcatccaaagcaaagaggagaatgccccttgcaggattaacactatcctaaataaaataatcacggctaacttttatagtacttagtgtgagttgagtgactttcccaaggtcttggagctcgcctattacatacatggcagagccaaatttgaacccaggtagcctggctgtggagcctgtactcttaccactatgctgtccttcctcccttacagacagtttacagccttttgacaggagacgtacagcctcttctggcacaaggtctgagaaaagtatcttcgaagtcccttcaggatgtcactgggtgaccaccatgaaccatgtccccaatggatcctttgattaattcagaccaccagaaagccaactattctgattgcattggtttgggcactgtggaatcgtttgatccaagagacaaaaaagggctaaaagttttattttctggcatgaacttgcttcagtacagatattctgtatattgtccattctagaaagaactatatactttttttttttttaagacaatctcactctgttgctcaggttggagtgcagtggcgtgatctcgactcactgcaccctccacctcccaggttcaagtgattctcgttcctcagcctccagagtagctgggattacaggcgcccgccaccacacctggctagtttttgtatttttagtagagaggggttttcgccatgttgcccaggctggtctcgaattcttggcgtaccaaagtgctgagattacaggtccgtgcctggccaaagcggtatacttttaagaatcaacctgagacctccctgtgcgttcatgccaagtgtgggcttgagggaatttccagatttttctcaacgcacagtgccccagcagactgcatcactgagcagcaccacagtgatgttagctttgaaggctaagctttcaaagtaagccttacccacccttgccatagaaaattctcagtcatgcactcattaaatgagctgacttaaagcaaaagactcagggtgcgaaaaggaacacatgtcagttcgtttgtggaaaataaataattatagttaggcttcctctcccaggatggaactccaacctcgaaaacatttgaacacgtgaccagtgaaattggagcagaggaagctgaggaagttggagttgaacacttgttacggtgagaccctagtacagcatcaaaatcattcactgcccgagaggtcacacagtgtaaggaagaggtctgtgtcgggaatatggagacctggggtctcgtcctggccgtccactaacaagtctgccattctgagcaaatcacagtccctttccagacctttgttttattgtctgtaaattgaagtgtttgaactacatcaactgtaaaatgtcttgagttacaatttatgactttgtggatagcataccttgtctggaaactataatgttgactgacgggaagagaggtatgaaataaatgcaggcctgcactctccactaggtgtccttctcaacaaatgtagcccattttctggagagaatcttcatcttggagtagcttttgttttaaaatcctatatctattataatccttatttgaaaaaggttatagttttatcagtcaatgaggttccttctagttctaaaaattaccatcttagttaagcttctcaatattctggagatgcatgtagagaaaatgccatccttttaggaacaggaaagctgagagagacagcttcagtacaaggttacccagaaagttattggtagatctgaactgttgacctaagcaatttttttttccttaagtggaaatggttttattttagctcccttttataattgttttttgaaaaatgtcctgtgatgagaaagataaaatgtgttccaaatgataacgaaattaaggtaattgataacgaaatctttatcaaatggggaagtgacatttttcttttaaaaacttgcctcacccaacaaagctaggaattttcttagaatgtaagaacttgcctgataacatggtaccctgatgccttttcctgccctttttaactgtgggttattacagagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagaaagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaactaaatcagtgtgctgctagagggttctttttcacttgacatgcttattagaaagctgacccaacaagagctctctgcctccggtcactcttgctgtggtgctacgtggaagtgaatggagactgatctcaaatctgaactgcagctttcgctgctgtgagttggggatatgatagtcagctcaggcttcagattgtatgagaaaaatgaagagaagtcaacaaatattttggtactcttcattcatttatctctaaaaccaggagttgaattttcctcatcttgaaagactcttggggtctgtttctggtattttacaaaattgctaagtggaatgcatgaattgcattatgttctctggtaacacgtagagttcagacccttctgaactctgttgataataccacaccatgttctggacccatagctctggcatcctcaggggttgtgatccagctccatatattgtttaccttcaaagatacaattaaatggcttgatttttaagctgtgttctagtcgtttttgacttcgggagtagtgatctgtagtttccagaagcagccaagacagtcttcgattggagctgccttaagttctcttgcacttggtatcatttatgaaagagcatctcattcccctaaatggaaacaggcagtctgctgtagtgaggagagttctctgagcccagaagacccgggttccagtttgtacctcagatccctcatttatgaggtggtaggttgcagtcagtcatctctgaagtccccagaacagtgtttcaaaagggacacatttaccacactgcagcaagttgtaagtacctcagaccacaggccaaacaggcatgttactaagaatggaacaatgtttcccccaagataagtgcacaggactcctagaggaacaaattaaataaggcactaaatcatttgacatacagtagtcacggatattaaatttcctctcttgaacagatagaacctctcaaatgcactacgtggattattcatcttcaaagatataagaatacaataaaatagcacaaaaactcagttgcatctcagaaaccacttcatgaggttataatgccttaaagtaatcagaagcatcgatttttattccatagacctgccaaagagctagttagtgggaatttgggaataggtagagcttgagtatcccttatctgaaatgcttggaaccagaagtattaaaagatttaggaaatttttttttttaatatttgcattatgcttaacggctgagcatgcctaataggaaatgttccaatgagcatttcctttcaataccatgtaagtgctcaaaaagtttcagattttggagcatttcaaatttttggattaggggcactcaacctgtagtaaaatgtaaaatggctcttattcagcataaatagaggcatgcccccatcaggggtcatttcagagttcatcaagattctgagataaaaaagcatggtacagtgaaaacaacaaaattgactttcctgtttcagaagccaaaagtcagacggtttgtatctaattgaataaaagaaacttgaagtacgtaagttaaaacttgaggtgtatcccaaaccatgggagcgttgaagaagcttttgagatctgggtgccatgtttggaacacactgatgtgacaggttgcctggaccacaaaccctggctaggaaatgggcaagagcaagacccaggcatcgggggagagccaggtgccatggtgctgaggctctaagcaagggaacgcaacgtcatcctaaggaacgggtcctgtatgtaaggctcaggggccagtgcacacctgaattgacaccgcacaggattcaggtctgcctttaagaacataatgcagggttgggggcagtggctggtgcttgtagtcccaacactgggaggctgaggcaggaggatcacttgaggccaggagtaagagaccagcctgaacaacatagtaagagccatctacaaaaaattctaaaattgcctgggtgtggtgggatgtgccttagtcctagctactgaagaggctgaggtaggacactggagcccaggagctcaaggttacagtgagctgtgatcacatgccactgcactccagcctaggcaacagagcaaaatcctgtctctttaaaaaacaaaaagtatcatttggatttaaaagactttcccagggtccagtgaactagcacaatgccacagacttgtaagttggtcatagtttgatgaactgaaatgtttattgagcatctaagaacataggaatccccaggccttattatttttaatagtttggcccacatacggacaaaactgacttctaccttcctaacagaaatcttccatttctacttatgaagaaaatagcttatagcctgtggagtcacttaggcatattttctaaggccaaattgctgccatcatgtagaagagggggagcccagtagtgctaccgatgaagtcttgctcatacaaat

SEQ ID NO: 15781 - DNA, 64047 bp, Human
atgggacatcactatgttgtgaaggctggtctcaaactcctggactcaagagaggcttctgcattggcctcccaaagtgctgggattacaggtgtaagccactctacctggacacaacattttatttgaaataagaaaaattttccctcactgggaatgctgcagttgaactagttcaaatccataaagaatggaagactgcccagtggtcattcattcacttattaattctagatgttaaattttctagggtgggggaatgtgctcctacattcaaggcattcttgaatgtagccaaactttgtagtttagccaaacttcatagctaatagccaaactttgtagtttagccaaactcttctagcagcaaaacccatgacactggaactctgttcttcacactggtcatttgtaatagaataacagagctttagcactagataggttctgaaagatcattgaatctaatcctctccctttgccagtgagaattctgaagcccagatttgttgatttgtgatcgatagtgtcaaagacaggcctgaaacacagatgtcctgggtcctagaggtgctgtttgcccctctccatatttcttttgttccagaaaacccttctccaaaactggccctaataatcagaggggaaagccatggcccctgccttggggacagcatgggttggcacagaaaagaggtttacaattcagcaggaagtgttgtgcgtgcgcgcgtgtgtgtctgtggaggcgcagggagggtcacctgagcttgccctgggtctggtcctgggctcagtggcaaattcaacgctgggcaggtggcctgaggacaatgacggtgccagctgtgagtcagacttcctttattcataaaatcatgttcctccatgcagtgcttctcaacctggctgcacgtcaggagccacctgggtagctttgtaaaaaccccaatgcccagttggtttgcaccccctgagattctgattaaactgttctggagtccatctctctctttttattatctatctatttatttattttttaatttggcggctcctctgggacttctcatatgcagtaggggttgagaattgctggtttctttggccagatgggaacatgcaggccaatagttacgcacaaacagagcagcagagcaggacggtgctaaggttggaaagggtgagtcatgaaagttcaggaaatcagaataggaaggggtgagaatcctctcatctgggcttgtggggcaggagagaagagcccagtgggcaaggtccagtgagtgtgcttagaactgggaagatgaggggaagggtaagcgctgggcggcggtgggcaagatggacgagattaaacgggagcgaggatttcagcgagagctttggcgacacggaaggctgagaatcggagggagcctgtcgggcgaaagcgaaggcggctgctgggcaggcagccgaatccggctggagagccgagctggtgagacctacaggaagtgaagggagtcgctcagggcgtggcgcaacgagactcttagaagaaactctgaggcagagatggggggcctccgcccatacggagacacaaggaagtccacatgcacacgcacgagcgcgcacatgaacacgcacaagcacacaaacgcctcctccgggcagggcacacgcgcccgctgcacaggccgaggccctggactcggaggggactgcagagccgacccacaacccgggccccgatgcccctcccggccgcgcccctacgactgcttgcgcaacaggcggcggctccagtgggcgcccgccgcgcgctgccggagcccagcccagcccggcgcgcccgggaggagggagcagggagcggggaaggggtgtgtcccggctgcgtgctgggactgcgagggtctgggaggggcgaggcgcgggggcggggccgcggcgcctataaagtcgccctccgcccggacgtaaacaaacctcgcctggctcccagctggtgctgaagctcgtcagttcaccatccgccctcggcttccgcggggcgctgggccgccagcctcggcaccgtcctttcctttctccctcgcgttaggtaagcccgcgccctcttctcccaggcgcgacgcggagcagaaaggggccgcccgtgcggtgccgctggagcgccaggaccgccctttgtagccccgcgtactccaggagtaagcgccccggagctgcaagtgcgcggtcaccccggggcgcgggcgcgagggggctttgggtgcagacaccgctgaagtggggggttcaattacggaaagggaggaaaaaaagacagggtcccattcatctcccccctagctggggattggggttctggaggtcgggaagggggcgatgagacggtccgaaaaaataccaggatagcgtttcctggcgtcgtctccgaatcccagctggcgccgctggcaggggtgcgcgctggacgtgggtgcagaagggactaggtgagtgtgtgtgtgtgtgtgtgtgtgtgtgtgtgtgtgtctgtgtctgggaacggagagattgcgcgcgagtgtgtagatgaggggttggtagaggtgagtggcgctggcaaggaggctggagaggggggcgtgggtgtgtctggcttgcagactgggtcgggaacgggtgtggatccgagaggctggtggcgcttcagtcccgtagcacacacagggcggtgtgcatgtgtgagtgtaagcgtgtgtgtggggggagggtccagggtgtgtcacagtgcaacacgcgagccggagcaagtgtctgcgagcgccactgggcagggtgcgcccccggaggaacccgggattggcgcatcggcggcgtgggagaagtgacctgggcgagaggggtctcgcggacatttggcggccccttgagctggctggagctaggagtggcgtcattttcgcctccgcccaccctcccccgctttcctcccctcccctgcctctggtgctggccgctcctgccctccacgggggaaaacagctggaattacttcgacgttcctgggggatccgccgcggtctctgattcagcctcgggaggagatttcgggctgggcttggggaatgcggctggttctgggggaaacacgctgtcacgcctctgtcaaattagtagctggagctgggatttagtgggtcggttccttacccacccctcccccatatcccccgcctgttgtccctgctgtccctgggggtcctgaacagcacgcctctgtggcttggaagtgggagatgcctggcagtgggtgggggaggcagggcccttggttatcttatgcccatccaagaacaccccttcctcacggacgctgggggcacttcagtttgtttggtttctttaagctactgggaaatatctaatattcagaagtcagccagtggccaggcaggagggcggtagacatccttataatacccatcagctgcacgggaccttctcctaagctgcctcaaaagaacatatctaaatacaaaccccctgttcttgctgcagaaatgtagtttcaaggcgaatttttcagtctagactcttcctgttgagaaattctggcgttcttattgagtttcacaaatgtgattgaaataagcaaggtacagagggggcaaaccccagcgcctttcttggaagggctgccttctggtggggaagacacacggctggagacgcagaccggttctgtgtggtgtgtgtggcggcagagccagccccaggctggggtggcacagtgtcggggatgaaggaaggtgtaagggagagagagggttttggtgtggatggaaaactgggtgttcccctgacctgtgacttcttagctttgtgggaccgtgtctcccactgcatctgggcaaggaggaggatttgcctgccctgccctgtaacctggcccctggcccagcgcctggcaggtgggaggagttgaaatatgcacatgggatgaagtggatggctctgggtcttctgccccattctcctgtgaaccagcaggttgagtttcgggcgaggtaatagactgtgcatgggtggaggtgttggcttttgcttttgagggatcctggagtgtctgtttgggtctcttgtgaggaagttcttttggagcaacaaagtttgatcatttggaatggaataaaaaactcacacaggacctacctagtccaacttctttccattttacagatggaaaatgaggcacagggatggggagggatgtgcccaggccgaactgagctggagctcagctttgtgagaggctcctgggtgggactgaaggcagtggaaagggttcctggcaggattttgcctgcctgctatggaggggcgaaaggaaattgcatcttcattgaatttctggtgaggaaacttttgaggccaaaggggcagagcggaatgattttttttaagtgtaaatcaggtgttcttgagagattagcaaagccagcctgaagggcaggggcttagaggctgcagccccctgagttggcctttgactgaatggggctgccccccccccatgacagaagacagatctcaactgagctgagggcccccctgggttacgttgaaatccgctggcctgaacttgcctcctcatggacctgaaagaaagatagcattgtgtttttcgggtggcccaaagctgcagttcttccttgggacccaaccccagagaatcccattccagatgtgactcagaggccttgtcctgggagagaaagcgtgatgactcagcatctgagactcaagcagggttcaggtttgactcagcctggaaggaaggccagggagggacacgacatctctctccctccagagcagccactgtctccctccatctgccttcatcctcgcaagaacgttgcctggatcgtattgctccattgaatggatgaggcaactgaggccaggagagtttcaggatttgcctgttgccatatggctcaggtgggagagccagactttgaacccggacagttggacttcagagcctttgttttttttccatgacaacatgttggggcgcctgaagaaatcaggctcaaatgaaaaggcagtcaggagctccatgcctcagtttgcttttctgtaaaatgagagtaacagacatgatgccatcagaatgtgtaaatattaatctgtgtaacctgagaacagcactgagcatgtggaaaacagcgtgtaggtgtttgccgtcagtagcacccgcagaagacattctcaaggcatcttcttggcaggcagagtctgggaccctttgtcctaaacctacccaaggctgtgaaagtgcctgcaaatgcttgacctaggtattgctttttgctaagcttatgtaggttgcataatagtgtcatgaaaatcttgtctgaaatgcacatttccaggcccggtctcctgcgattctctctccatcaggggatatgctgttgtttcaaagctcctttggctgggttgggaatggggtatcctgcaggcagacagagttgagaacctctgctctggaatgacaggggagagaagaaggaaggtgtagtcatacatgccgctgtaccttcaggccaccctgtgtccacagtgccagggaattagtgagtgctcagtaaatagctcttgtttgctatagtgccttggaggttcaatgcatcacatcagctaactgaggtagaagacattctttccacctctcaggtcagaaaattgaggctcaggctggtgactcttctgtccagagtccagtgagtggggttctgcccaaggtgagcctcctgagccctttccaccctccaacattgcgcttggaggccacccacaccctctgggcccaccttttgagaaggagcttgtttcctggatccaccccaggctgttgttcctgcctcccttgatggctgtgtgatggaagtactgcgtgtccacttgctttttatctttcaacttggagatagaggcaggctagatagcggtcttggctgagaacttagcccaggcaggtaggcagaagggctggggacactgaggccccacaggaaggcggctgcagaggtagagggccatgagtaggtgccaacctggagccgtgttctcggggtgggggccatgtgaaaagaaacctgggctccctcgggtggggcgtaagccccagcactacagaatgggaatggattacacaatcggggccataagcaggtctctttgacccagatctttgactttcccacctaacattgtttgcagacctgcctatgccctacctgcctgggctccatctctgaccttttgagtccagcgggttttcttgcaactgagctggtagaaagtgaggctccttaacagtctgggggccttgagtgccctccccagcagtttaatctttcctttctttaaatctgtggggagactttctgcagctatacattttaaatctgcatagagttctgtttgaagagaggtgggtgggggcccaggtctccaccttgttctcctgccttcaccctctgccccacccccacggaacctaagaagattccaagtaaccctcttcaaatatggatgtgagagggccatttaagaggtgggtctatggcctctctcagctgggaatgcttaccatctctccttcctcctttttaatcatggaactctcctcctttctccagaaaggcctccttggctgtcctctgctggaggggaggctgggttgggtccttcctgggacctgtccatgtctcccatgaaacctgagagcctgtccttagtaggtgttgtgttagtggtggtggaaaggacatctccactgattaaggaagtaacttggaccatcttgcatagacaagatcggaggcccattccggagggtggaaactgcaagaccattctggggaaggatcctgttagcgtggctagcatcccatctcgggacaaagggttctgtatgaggaagccatttcctcgtcctctgctaacactggctccgtttgtgtgatttccacaaattatctcagaccatccagcgcagctcatgcctgtcttgcaatttcacaaaataatcctctaaggagaccagtgtcctcctttggacttccagttattcacctcgtcccctcagacggtcgtcttctgtctgccaaacaaattactcgtgctgccaaaactccactgagaatctccaggaagatctcggttgtattgcagaaaagaggtgggccctgacgagattcctgacacctccctcttcctgctgttgtgtttgggacactcttgctgacctccctggtgctgtgctcaagttgaacacacagcagttcagtttcagctccagcccctctggacccacacccagggagtgaatgcggctttggcttgtttgagagggagacagtggggttcaccttcttagtgatccctttttcattccttgaatatcaaacatcactgatgcctcctgggtttcaggctccactgcaaagtacaggggccctcgaggagttcctactgtggttttgttctctgacatttgtactgtttccttgattctgattgctctgatacatttccctaacctctaaactagggaactttcttgaaggtccagtgaatccacccatattgtttgctgagttgattagttaagaaagacagttcgtgaagactgccaacttcctcaccctccccagggccttgagtttcagaagggccagaaaacaccaagagagcccatgaactgctttgtagcttgacttcaaaatctctttgggcaaagaaatgacaaaggattgtatccacagtaaggcagggctatccagggcctatctcaaggtggttttccttgaggttcaggcagaaatggtgctgttctcggcaattttctggggaagttgctacagcaaacagccacagcacatgttgattttttccctccttttaaaaatctgttctataaagagcacaatgtgctggagagaacactggctttcatgtggccttaaaaccaggcatgttacagagggtggaatctgggccagttgctgttggtgacaatcgatgctacccttgtcagcaattcccgcctgctctccctttatctgcttcactgaaggcctccaggggactgttgtccgccctcccccgagggaatgagtgccacacctgcacccacaacaaaccagtgagtttttcacctttccctcagtagggaggaatctagacatgtggcctttggaagtcaagtgggcctttgtgtttgtttttgagcctcaggttacccatttgtgaactgggtataatacccagcctctcccggggcaacctccttgaggagcaagtgaaacagtgtgctgagtgaatgcttttccaaagcattgagttggccgtcttaggaaggtactatgggggagctgaaaacagagaaccttctgggtgttgtgaagggagaaaagttcaagatgctggttttgccaaaagctcaagcctgctcatgatggctcagtggtgactgcagggtggaggagaggcatgtgactgtcccagctgacctccacacgctgaaagcctcatggtcacgtgcagcccaccttacaacgttgtatctgggccacgggtggtggtgaggactgtggatatatttagggcaatgtgagatcattgtcaacattccctttaaggttgctttaaccttaaagcagccagcttgatgcttgctgacttggggcacacatcttaacctcttgatgcctcagtttccccgtctgttaaatggtgacatgctggcacctccctcctagggtttctgtgaggcttaaaggaagtaccgggtttagagtccagttagtgccacagatactgttcctggtgctgtttttgtggtgtgtctgtgtagggttacattgttgccttcctgtggctgctcttcctggtgggcggaacctggaacttctagaacagatcatggatgtttctctgctggataccccttcagcctcaccctgtgggagttgtggcggggcccaggagagtttgctcaagagggtgtgcaggtgggtggcagagctggagcaaggcactagtcttaacagacaggagtctgaggctggcagaagtgggggccttggtccaaggtgcggggctaatctggccagagctgagcctggcagggccttggtaagaccctgtggcccttttgtcttggtgaagcaccttcctgcctgggtttccatttgcctgtaagtttgttgtggacagcgtgatctccatagacgtacactgtgcctactttacagatggagaaaccaaggcccagagaggaagtgacttgctcagagtcatggaataggaaagtggcagggtccccatgccctgattcctaggccagcgttcctgctgccccactgaggtttttgggaatcacaggctctgtgtgtccccctcagtcccccaggggctgttgaacagttctcaagtggtgtcggattactgaagatgcctctgcccactgccctcccaggtcccagggtcacgggtcacgttcttttcttcctcgggcagatcctggccttggctttgcctggcacctgtgatccagctctcctctgactctcctgggtctgctggactggaagggtatttgtgtagcccctcttgggccctcattactcattgacagacagtgctggtggagagaagggccccagtggtgacgcactgggcctgataatcagaaaccttggtggcatttgctgagcattttccatgtgtccctctcctcgctgggactctaggactgaaacccaggccacatcctcacagatgtcctggcatctccaaggcaaccctgaaaggaaagtatgttgatgaattaagcaactgtttgcttaattctccatgccattcttgaatttaagccccactgctgatcattgggagcaggagttagcatgcccattgacagacaagcaaactgaggcaaagaggttagatagccaggcatggtggcatatgcctgtaatctcagctactcaggaggccggagtaggaagatcacttgaacccaggagtttgagaccagtctgggcaacatagcaagaccctgtctctctaaaaaacaagatgaataatacatttttaaaaagagattcgataaattatgcaggatcacagagctaataaatggtgacaccatggcctgcaagccttcccccagctcctggctacctttcgcttctctggcattggtcttctcggaattcctcccaggcaggtggatgggaaaagaagtgaagatacaggctggcagctggtgctgtgacctggagccctgtttttggtgctaagctgggttttagctgaaggagacctgctggaggggtttcttctgtgcttcttggggagcaaagatggccttggagatggagacacggtttgtcagtcccaagccactccaaaggtggggctggtgggctaggagtcagccctggttcccccgccatgctgtgtgtggccctgccttgccaccccacctgctggaggacctctttgatgctttctagtgggtcccaacattctgtgattaggactttgcatgaggcagagggagggcaggagctggagtccagcaaggacctcaagcccagggacaggctccacctgccacacttgctaagccgtgagggcctcaggtgcccgggaggagggagcaggagtggaagcaccagctcgagccgccaaaccaggtcacgtatcacctgccatttcctgctggcagaaggagatcacagacaccagaagacagcagcttctgccagaactgggtccttccatgattctcaggtggtgactttgaatcccagaaaaagtgttttggggagagtggagtgaaggaagagtgtgaacattggatctgactccactccagcccctgtgctgcagccagcagggtgagctcaggacagctggcagccgcttgggcccagccccctcctccgtgaatgaaggtggtggggagtgcacgtgtgcgtgtgagtgcgtgtgagtataaatgactgtggatgtgagagtccatgaaagtgagaatgtatcagtgtgtaagaaagtgtgagtatgtgagaatgagtgtgtttgtgagaatgtatgtatgtgtgagtataagtgtgtgaatgtgagaatgtctgagtgtgagaatgaaagtttgcaagtgtgtcagtgtgagggaatgtgtgagtgcatttgagagtgtgtgtgtgtgtgtgtgcgtgtgtgcacgcatgcactagattaaataagaatgcatccaactgacattttctggatactgttacctactaggaattactaaaatcagctattccagaggagggtggatgtcgcaccaggggacatttggcaacgtttgcagattcttttgctggtcgcagcgtggggtgtatgctgtgggcatgtggtgggcagaggccagggatgctgctgagcctcctcccgtgctcagggcagcccctaaggcagaggctgcttgtggggcccaaatgtcagcagtgctgagctgaggatctctgtccaggaggcacagatgctgtcctggatgctgtccagacagcatctgctctgccctccagggggacagacagacagtggacacagcccagatgcagcctgatgagtgagcccaagggagtgcctgtcccctcgggactgtgagctccgtgggggcaggaactgggtctgtttgctcatgatccccagatgagtcccatagccagtctcatcaccatagctggtgttatttttgttctgagctctgtgttgggcacatagaacctagtgggtagaaacctctgaataaatcctgagttttccatcctgcttccgtgaactcagatgttctttgagggccagcctggtggcgtgggggctgggagtgggcagattgtagggagccaagtcctggggtggagtggggttcaggcccctttccctggcttgagccgaagcaccttggctttttaaattttaaaatttttattttttaacatttttatatgttgaacttccttacatgatttcctttggataaaagctcctgcaaaaaaagtttgaaaagttttttggttgaggcatcagggacaaggtaagggctgcttgatgggcccaactcgggagaactgaggtgagggagccgctctcctcccaccctacaggctggccagatggtggaccgccagcagctggctgggtcaacctgcagagagcaccttctgcagtccttggttcatgcggccttagtattgcaggacgcgaccaacatgcaggctaccccgaggcctgcagcccccacagtccccccagactagtgcaaagctttatccagtctcccggcagacttcagagtctaggacacttcctaaatggttcaaaatcaatggaatcatttgggggacaataaataatgtcactagacattgccaaatgtcccctgggagagaaaatcccccctagtttagatataccccgtgatcatcctcagcagttttatctctggacttcccaaaggcctttagcagtgagggggctgggtcagagaaggccccaccagctcccaaaagcagatgctcaagaacttgatatttctaggacacacagcgatttttttaacccattgcctcatgtggtctgggaagctaagctgtaggaataaaaaaggtgccgggtagggtaaagaggtttcaccagatagaggaaacggggaaggtggacatttctgtcttttctgttctggagaacgagagagctggtggagactgacagacactatgtcctaatgtgatcacggtttctggaagccaaagagaactgaccaaactgggctgaaccacagcatttctcgagtccttttaaatgtagaatttgttttccagacattgcactcttggggtttagcaatgatttaaaagcgaattttactgaaagcatgctgttgagctacattgctcatttattcagagagggagttgcagcctgactttctgcctaggagagtctctcgtgctgggagctagaggtagagaaaagaacaagctacctgcttgatgaagctcacagataggactgcttgaacccacctggtgggacagtgagagccccctgacttcaccctggcgcgctttgctgagcagggtatgctaagaagctcctgtgaaatgagaagtcctttcactcccagaatgaggggtggcgttggcagggccctgggtttctggaaggctccctaggccatgtaggcgaggtgtcccacaggccagggtcttgggaccacgaacctgctgaattagcaaggctaacagacgcgggcctttcatgcctcctgcctccaagctggcagctgcccaggaatgctcacaaatataaaaccgactttgtttcagaatgttctggagcatagactccaaagtctgtataaagccattcttgtggggctggttatctactggggaaaatcatgctggggccccagaccagagcaccccagtggagagcaggatctgcccacggaatgccatgtgttggcacaagggatggacccggggtggattcggggtggcccgcacttgccggctgacctctaagaggtgtttcaccaggttcttgggagttcctgggtcttcagaggagccctaggcaggaatttcagaggcttgcattctctcgaccattgcatccgaggggccttgggcagtgcggggcccaggttcccactctgaagctggctgtgtgagggctttggtcaggcgttttccattcagaaagtctggatctgtgaactgggtgggtggcctgggctcttccctcttgtcacttacttcttctccgccggtcctctgctgctgtctgtaagacttgaccttattctgcattttttatgcttcaccccagggattgatgggcatttagtttttctaacttgactactgatctagaagaatacatgcttatacttctggtttctagattcagctcttggaggcatgcttaatagatagcaccacctgcccaagccttgcaccccagggagtcagtggcagcattccaagtcttcctgggctgtgcttcagtctggttttgcagcccacacttctgcacctgccctgtgttagagcacaggtaacccctctggtccatcccctgctttgatccaggaagtgctttctgccttggaggtcttttttcttacaaaattgtactgtgcgttcaaatgcctgccaaactccttgacttaaggttttcctctgcccctcttcccttttagcaggcagccgagagtcctgcaccgtggggtgtgtatgtgtgttcacgcgcatgcgtgtgcctgtgtgtctgtgcgtctgcatcaccaaccttctgttagggctaactgtgaggctgaagcttgcactatgcctatacgtggtaagcatcgtgtgagcttgtgttcccctttcattgtcacacgggggctgcctgactttgggatcagcaatgcaggtccccttctagaatgcagtgagctgcatcctgggtatggtgggtgggcctgaacttggtatggggacctgtttgtgaggctgatctatccatttcattgggagggtggtgtctgtgagcctcagtatcctctcccaggaaatccactgcgctggccccaatgggaagactgggttgggtccgtgggctgtgtgtacaaggggcctcctcatcccctgcagtgcatcacgagggaggtgaagctgctgggcagagcgcaggcctggccttcttgccattggtcttggatttgcttcctttaggaaacctctcagcaggaagtgttgaccttttggcctttgtctccttgcaggcaggtgacagcagggacatgtctcgggagatgcaggatgtagacctcgctgaggtgaagcctttggtggagaaaggggaggtgagtggagatcttcctggctaccccatcacaggcacatgtgcacatagacacacacaggcacaccggagctcacacttgtacttatgggcatgcaaacactgcacaaatacacatgtatacagcatacacacggcatacaaacatgctgcacacacatgtacatagcatacagacacacatgcgtacacacataacacatttgtccactgcttccttgaaatgcaaagttgtgagaggctctggttcaagtcccataggatcgagggctgggccccttgcccacttctctgggcctttctgctctcatttgtaaagtgaagacatcgaaccagaggttctctcagctttcccgtctctaacattctgtggttatagaacatgcaacatggggcccagttgcccatagggactgcctgcctcagctctcattaaagccacatactctggggccgcactgtctgggcttaaatcccagctgtgacactttgcagcttggtgtccacttgctaacctctcagtatcttcatattctagttcttcatctgtaaaatggtgacattaggacttacctcatggggccaagtgaggatggagtgacctaattcatagggaacagttagaactttgccatagaggagatgggcaatgcatagtcactttttcacttgctattattatctttttgggcaaacctcttctgtcaacagagctcttcctgttggaaacagaagcccctgtctataggctgggctggcagggcccagcctgggctgattgttctgaagatgaatgaacctttacatttgcacagttgacaccgtagcttcaaagcatgtttacatcccaattctcacttagcctcataactgcctctgatatgtctttttaaaaatgtggaagctttggtccaaaagtgaagttagtctaaagccaactaaatgcttttaaaagtgataattaccatgcactaaccacatcctgcatgcctgcttctccgccgaccgtatttcaactttggttcatgcaggtcccaggttctgtgatcgtactcattttgtagaggaggaagttgggtcttagggaggttaatttgtcttctttgcatagttacaaagtgtgggacatggaatcaaacccaggccagcggacgttggtgaatagactgttcatttaatttccttatgactctacatgtggctgctctgttttaggttcataatttcatagacttttctttacaaatgtgtgaggcaaccatctcttttccccttttgcagatttaaaaataaaaacaaactggtcctagacaggaaggggattggtcaagttcatccagatagctggtacaactagagttagaaaccaagcctggggaggctacagatgcttgcttatcattccacactaaggtctgcaaaccttttctgcaaagggtcaaatagtaaatatcttaggcattgaaggccacatgacctctgttgcaactgctcaactttgccattatagcaagaaagcaaccatagacagtatacaagtgaatgtacttaatgtgttccaacaaaaatttaaaatgtggtgaggcggattgcagtgtgccaacccctactgtatactatgcaatttctaaatctgtgtcctctaaactctgggtctgtgacatagtcttctgaaatagtcaaacagaaacttctagatagaacaaatacatatcaccatattcttatttctcccttttaaaaaaccctgtgaaaatagtatcccacactttgctttattcacttgacatttctgggagatcttttcaacatcagtccataatccacttgcttttctctttttaggtacatagtattccactacatgtatttgcccagtgcccagtatatgaacacatgtgtctttccagccttttgctattacagacagcactgcaagaaatttgcacccttgtatctttcatgtgtgtcattacatacatgtgcaggtacagccctagaaaaaagttctcagaagtggcatcgctgggtccaagggtaaatgcatttaaaacaacattttttatttatttcgggcagcctactggaatccttagaacattttatgtatgaaacacatgtctaagagcttgcccattcagggttacatgccagtgcatctctcagtgaatatttaccctttctttcaaggtttagacggaaataaatttctttcaattccttagattgactcagcaaagtatttagagttaggcttgactattgggaagttcttccttgtgtctgtcctcaatctagattgccactatactctgatgacgttttgaaggttggtgtttgctgtacagaatggctttccccattctttcccaccagtacacactcacatgcacatatacacacacagggcaatggtataggtgccagccacgtttgtttccacttgaatttacccaaagtccctgatgttcttgcccacagctcaggggatgtggggctatttgaatccccagcacgagggcctgtgttgtcatctagtcttccaatccctgccatctaatgggagctccattccatcatcctgttcccctcatcgcttttgcatttcgctctgctgagccgtcttgttttctgggggtttgtggtgggtgaggctggggctcagttttcacagtgttgggactccatctctgggtcagtaggaaaacatgccagcaacatctcttagaaatgttggccagccaagactccagttggtcctccgagtcacactttcaccaggccagaggggacacaagacttttctctgtcttcctgggcctgtcctgccatggacagctctggtaaaagatagaatttgggctgaaactcagattttttttttttttttttgagacggagtttcactcttgttgcccaggctggagtgccatggtgtgatctaggctcactgcaacctctgtctcctgggttcaaggaattctcctgccttagcctcccgagtagctgggattacaggcatgcgccatcatgcctggctaattttgtatttttagtagagacggggtttctccatgctggtcaagctggtcttgaactcctgacctcaggtgatcccgcctgcctcagcctcccaaagtgctgagattacaggcgtgagccacagcacccagcctgaaactcagaatttttagattgagggaaatgcttagaggtctccactgcctcttctactcacaagagactgaaatttaatccaggtccagatgacagcagccatggaaaaaatgtaaggaggaccatgatgtggtcaggtttgagttttaaaagtatagcacatgggtggagccggggagaccagttaatagtcagatatcacatttctgtatctctcaagcttgtgatcagcttagaccttcagctttttatctatcaaggctattgtcagaaaggagtccagttaatgtgtctgcttttctgctggacttctattttgagatgaaaaggaaagtctcggctgggcacagtggctcacacctgtaatccccagcactttgggaggccgaggcaggtggatcatgaggtcaggaaatcgagaccatcctggctaacatggtgaaatcccgtctctactaaaaatacaaaaaataaaaataaaaataactgggcgtggtggcgggcacctgtagtcccagctactcaggaggctgaggcaggagaatggcgtgaccctgggaggcggagcttgcagtgagctgcgatcacaccactgtactctaacctgggcgacagagcaagactccgtctcaaaaaaaaaaaaaaaagagaaaaggaaagcctgcctttgtgaggaattaaggagaccccacaaaggaggaagtgtaggtacagattcaggtcatagaaaggcccatatgtcccaatattatttctcttacagagaaaacagatgaaattgacaattttttttgtcttttcacagaccatcaccggcctcctgcaagagtttgatgtccaggcaagtagaggatgtggctttccttccccttcctcatcccgtcttctctttttcctttttctttccattggtttaagtagatcattgtgcaaacattgcgggcaaggggagagaaggcagtggtctcagctaggtcctcaccctcagctgctgctcccagacagaagctgacttgagtgctggccagagaatcaggaaccagtcacttcccacgaaagcaggacagagacaccgcctgtttcagtcccaaagagctggccagaacggtggggcgtgtgtggggaaaatggtgtgatgctgggctggcttgggaccctgtgaggggagggaacggaagcaaaagcttgatgttcttggctccacttgggaaactgaaaccagccttctctgtggtttactggcccagaactgaagtatctccattcccactcaggattgcagggtgggccagggggtgcagctcagctgtgtccaagaataggctctcaggagaacgggctgggctctctcagccgagggctgggtcagaacttcaggaaatctaagtcctggactcgttagccccaagctggggtgggtcccatgctgtgctggcctctggagggtggggcagaaagcctgagcatatggcgagcttgtggtctccttgaaggaggagaggcgcactcctggaccagccagagagccagaggtggctgaggtgttctcacctgaaccgctacccatgtgttgcacaggtgtccccagtttgggacccattctgcactctgcatctcactcctctattctacctccttacctcaaaacaactccgcttttcctcttgaatctctgatttcatgaatgctcccccatccatcccgaggcgaggaatcttgcactgtctttggaaggaaaggaaaggatgggagaggggctggaagcattggctagtagatgatcgaggctttctataccaccaccaaggtgtgtattttctcatcatcctggttgtgtcaggctgtccctagagatcaccctgacctcagtgtttaagaagaagggccagatgcagtggctcatgcctgtaatcctagcactttggaaggccgaggcaggcagatcacctgaggtcaggagctcgaggccagcctggccaacaaggagaaaccctgtctctactaaaaatacaaaaattagccaggcatggtggtaagcacctataaccccagctacttgggggctgagacaggagaattgcttgaacctgggaggcagaggttgcagtgagctgagaccacgtcgttgcactccagcctgggcaacaagagtgaaactctgtctcaaaaaaaaaaaaaaaaaaaagaagaagagagacagcactgggaagtgacttgcctggggtcactcagcagtgattggggaagtggtgccagactctgggcctcacctcttccagccctgagtgctccccttgctgcttgtgtaggttttaatgatgttggtgagggcttcttacctgccaggtgctgtgctgagagcttgccagccaatatctcatgtaatgcctcaatatctcatgataacaggagaggcaccattagctttatttttcagatgggtatactgaggccagagtggagggactgggagccacacctagctctgcctgaccaggaaggaagcccatgttcttcccgcaccactcatgtgctgaggtccaggcttctcccatgccctggccagagctccatcccgttcctctctatgttgcaggacgctgggcatgcgaaggtgctccaggagggtgggaggtgaatgtactatcttgaggtttatcaagtccaagccttcattttacagctggggaacctgagggacagagaaagggggaagtcactcattgagggtggcatggtggggcagctaagagttatggtagcaatcctctttttcaccctcctgagaatgggaaaaaatgcacccagggaagtcagagctgcaatagatgcagtggctgtggcaccagcaccatggccttggttatttgactggttctctgagctgagaacagctggaagttagccccaggggtcatctgctcattcagggatgggccgggccaccccagcctccctcagcctgatcgaagctgcccttgccaaccttccctgtggctgaaatgtcagctccttgtgttccccaggggagcggcttgctggcactgaggttgtatcttcctgcagtggggatgtgattgtccatcctcctcaggtgaaggccccattccagagccaggaagagtgaagcgcaagccccatgggtgccctttcctggtgattgacccttagcacaagatgcttcacctctgtttccccacctgtgaaatggagacagtgctccaggcttgttaagtggtggtggagagaggacactgacaagggccaatgatgtggtgcttcccgcatcagtgccgggccaaacatcacacaccctatccactaactatcatggagtgttttcccgaattatttttgctgttgtggaaacatacacgtaacatccaatttaccaacttaactacttttaaatgtacagttccgtcatattaagtacattcatattcctgtgcaaccatcactatcgtccattttcagaactgtatttatttatttttatttctgtttagacagagtcttgctctgtcatccaggctggagtgtagtggtgcgatcttggctcactgcaacctttctttacctcctgggttcaagcaattctcatgccccagcctcctgagtggctgggattacaggtgcccgccaccacaccgggctaatttttgtatttttagtagagatgggtttttccatgttggccagtctggtctcgaactcctgacttcaagtgatctacctgcctcagcctcccaaagtgctggaattacaggcttgagccactgtacccctggaactttaaaacctgcagaactgaaactctgtcccattaaacaactcctcattctagctttaggcagtcatccttctattttctgtctctgtgattttgattactctagattttgattcctctaagtacctcatacaagtgcagtcatacactatattattattataaaactgtattaatttgcattgatttgttctttgccagtgtctggctggtataagttagcatcgtgtcctcagggttcatccctgttgtagcaggtgtcagcatttccttcctttttaaggctgaatcatattctgttgtatgtatgccccacattttgcttatccatttgtccgttggtggacactttgggcactttgggctattgtgaatactgctgctgtgaacatgtgtacagatatctctttgagatcctgctttcagttttgggggacatatacccagaagtggaattgctagaggtatcagtccattctcaagctgctataaggacatatcagaaactgggtaatttataaagaaaaagaggtttaatggactcacagtttcacatggctggggaggcctcacattcatggcagaaggtgaaggaggaaccaaggcacgccttacatggcggcaggcaagagtgtgtgtgtgcaggggaactgccgtttataaaaccatgagatctcttgctctttataaaaccatgagatctcttgagactcattcactatcacgagaacagcacaggcaaaacctgaccccatgattcaattacctcccactggttccctcccacgacacgtggggattatgggagctacaattcaagatgagatttgggtggggacacagccaaaccctatcactggatcatatggttattttggattttaaaatcttggttaccaattctgagaaacctagaaagcatagtttatctgctccctgtgaagataattcctcacatttttgtttctctggaaagtctgcaaaacacttttacattctcccatctcaggacacaggcaactgacctactcccagggaaggtcaacctatgtggctcaggctggggtcggctaaggcgctgccccttaggacatcattaaagtgggggccacacagagaagcctttggaaggatagagcagaggtcaggataagatttcccagcattgtgcaccagcctgggctgagctgtctgagttaattccccaagctgtcctatgaggtcggagcattttccctattgtgccttcctttatttctttaacaaatgcccactttgtgcctggcattagtttaggtgctggggatgcagtgatgagcatgacaggcagtgacctgtgttttcaggaacctaaattctggaataatagctcagcactgccgagcacagaatgtgtctggcagcatgccaaatgtgccccacgtgtgcttacggcgatcctgtccccatcctacggagagagaggacctgaagcacagagaggttagggaacttgcctgagatcgcagagctggaaaggggacctcaagccatttgcttccagggcacatatttgaaaccaatcccgattcctcagaagaaagagtcaaacaaacatacaaacaagcaaatgtgagcattccagcttctgtaggtgctttgaagataacagtgaagggtgatatggagccaggtgatgggatagggcatggctggggtgctgtcttaggttgaggcttttttttaagtggtgacattgcactgaagtctaaaagatagatagagccagtcacgtgacaaagagactggggatagatcattccaggcagaggtaacagcacaagcaaaggcctttctgatctgaattctgaaatttccaagggcaaaaatgtgttattcctgtaagctgttaacaggctcagtgttcccagtaagtcacaatatttgagctgaaatctgagtgttgaatgacacttttcaaggttgttaccaaaagaaaatctttgtctaaaactgtattcatttagatttggcttcttagattggaaggtgttagggactcaagagattgatgaaagcgtcccccagattttcagcagtctccaaaatcttgggtgtagggttgctgtagaatttccttcagaagatgcagtgcagtgtgacgacggaagctctctggggcctgatgggttccagggccaggaactgagaaggacagagctttggtcaagggggcctacagggcatatcagcccggggactggtcagcataatctgacctcagattcacatgggagttgcagcaaagcgacaggacagcacctgtctgccatgcacttcagtgtcctctgatgagccaggccagcactgagggcctcccacgccctcttgctgaatctttggggacctgtaccatcatccttcctttacagataaggaaactgaggctttcccaggggcggcagctgtgaagtgagccacattgagcccagggctgtctgacgtagacagttctctcaaccgtgatgcttgagtatagccctgttcctggaaaggctgatcaagcccttatggactagattgtggttcacctttgacacgtctgcttgtcaaaaaatctagccaagcagataatctaagcaacacttcattgggcttatgttcagcctactgacaatgagttgttgtaggactcaagagttgctgtgccttaatggcaaatgaattttatctattcatttagttggtttcttacctgcttgttaaaatagggctccctcctgggcagttcttgccctgggcatagcttccctcctggtccagtctaaggagtctgagtcgctttattttgtgtatctgaaagcagccgatgtcattccttgaaaaataattactgcttcagcactttgactaactcaggcagattcctacttcctttaccaatgtagtcaataatttaggcttttattgtttttgttttttaaatgaatcaaaacacacacactgagcccagagctcagcactgaggagctgctggcggagtctgcattgagctgctgggtggcctgtctctggagacagctcgcctgccagagcagatggcatcaggccttatctctccatcactggcatcgcctttaggcggtctctttgttttgtcctgggtgatgttcgggcaaagtgattggtgatttgcatatgaggttctgccagcgctgtcaggcccccacctggctctggttcctgaaaagattccagaaccctcagggcacggggtgggcgggctgctggcctaggtgtccgggttgcaggaaggacacggtctgatctggctcggctgagaggcctccagcatcaggttttaggcaattgtgtttgcagatttgatgagtagggagggggggagtattttgggttccagcttattttctttggctagaattctagagtccaagacttctgctccagttggagagctttgtggaaggccacctgggggagggaagaggaggaagaatgaatatttgcatactcattgtctcagggcttccctgctaaggtgaggggtgttggcctcttttgcagatgagagacccatttgaagatgttagggaacttgccaaagggtactgtagagatagtcctagacttagatccatctgcttccgaaaaatgttatagtcatggaagtcgtaatggctggcctctcttgagctctgctgtacgtcagaaaccgtgctgggctattttcctgcatccgctcatgtgatcctcatgaaaccttgttgagggaggtatccttgccatctatccttgccatccttgttttatgttgaagatacgaggcccagaaaatctggagggatttgcccagtgtcacgccatggtgagatagatggtgaaagctgattcaatccacacgtctggagccaaagttcatttaacgagttttggggaagggacagcagagttgacttcatcaccgataaattgtacctcgtgggccgagtgactttctgtggcttcaaattgctttttctgttggatttgctgcttctaattccctccacctggatcttgagttattcagatggttagatttgatttggtttccatgggaatctgtgtttgtgtgctcaccagggctctgtgggaaatgagctgatgtgacccacagggcctccgtgtggagtggtggagggggctggggcagcaccagggccgggcagggctctggaggtctggctcccgttctgctgcaaggcctcttgttcagcagagctgagctggtcttagggatgtacaatcccattcggtgggggggctgttttccctccttttcttggaagcggaccagctcacagggaaaatggaaatggtgaccttttgctaatttctctctttccacacagttgcttcttgttttcatgccccatgactgaaggtgggcagaactcagacagaagcctggaaatcctaaactcaccatttcccattctcgccctcccccagccctacttcctagcaaagccattgggacttagagcaaacccttagagtgacagatggcaggaacgctcatctggatcagcacaaaatgagactttggaaaataaacacagcatacttctgcaattctgctgtgggtttcctaggagcaccctccaatggaacaggagaggtggggctcatacccaggcctccgaggtgtgtccaggccaggctctgccaggctgacctcactcatctcctggtgtcccagaaagggtgcagtgagcggcagcgagtgcagacccagccctgtcatttgctactcgcgtgtccttggccactcgcttgacctccctggggcttagtttcctaatctgtgaaacagtggggagcatcgctgtccctgagcacattgcaaacactgaatgcacacagcagcgggctcagctcacaggtctttgtcgccctcccctgctccatggatgatggggtctgctccatctcttcaccctaatccaaacaaagatgttcttcctaattcttgtttccttggagaactgaggtcttcagcgtgggttccagttgcatgctgtattcccaggctgacaccttctgcccactgcagcctgttccctgaccctctgtaactttgtttaattctcttgacctgatgtcaacataaaagaagactggggaatgaagcgagaagtgacaggcccagcttgacctcttgaaggtcttccattgtgtgaggcttgcaggggagtcttggctttggaagcccaaggacctatctatcttgaatcttaattctgttatctcattgggcacctatacttcagccccaaaggctgttcaatggctgtcatgatatagcacaggagacaaagctggctttatcagacttgctcagtaagtgggtggctgtctttttatcgtgttcctcctggctacacacacacctcccctggttatctctggtactttatgtgttctttactccttttttttttttttttttttttttttttagacagggtctccctttgttgcccatgctggagtgtagtagtgtgatctcggctcactgcaactgtgacctcctgggctcaagtgatcctcctacctcagcctccctagtagttgggactataggcgtgagccaccatgcctggctaattttattttttgtagaaaggaggtctcattatgttgcagatgctggtctcaaactcaaagttacaggtgtgagccatcacacctagcctatgtttgttacttaatggaatggatcattaagatgaatggcactgctgtgtctccacctcctcctccatgggcataggcgatgaaccaggaaaatatagggggaggagtgtatcattttatgaaaagatggtggggagggggcaggcccctgacattctctcttgagcctctgttcccatgatttgcctttcttgctgccatgggccttgactttatgctgatgagccatagtcagcttcctggacagctgttccagagggcaccgtaactgctctggccatgcttggaccccacttgctagactgagggagggtcgccaagcccaccaactgacttagatcctgggtatgcggtgatcctcttagagcctagaacggtcggcatctgcccagggcctgctgggaaggaggggattaccaggggcagcggggagacagtcacagctggcctccagagcccctccggatcatccagagagttgacttaagccagtggggctggccctgggagcttcacactaatcatctctggagcggttgtccataacaactgacatggagggaaatgctgcagcttgcaaaacacattcaggtctgtaccatggttttagtcttgggagcatcttaatggagcaggaggccttgtcattgacctcagcttacaactgatggcagggattgtcagagaaggctgataacttggccaagggcacgtggtggttatatcattaggataagtattgctcaaaaaacagtgctgtgccaaggaaatgtttgctattctcaccaacctagaaagctaacaccccagctatgaatgtcacccagcccagctggagttagtccttacagcttcctactgtcacctgagcatgcggctttggtcctcagattggtaggatagccaccgaacccccaagcatctcatccatgttccaagtaggatgcaggcaggagggtgaaaggacaagaatcaaaaggtcaagtttgaccctttttaaaaaactctccttgaagctacaggaattttctgctggcatttcattggccagaactgaacctcctgaccatctttggttacaagggaggtgagtaaggaaggggaccactttatcaggcactttgctgcttagtacatcagttggaattctatcctcaaaaagaagggaacaacagatgtttgggatgccaaccaacagagtctgccatagttttaaagctcccaagccagggttgacagccaaagagatgaaatctttaaggcatgcttggtgttaggtcctgtttccccacttgacagcttccaggcggtgtagaccatagtggtacgtgccatggttgctacttgccagcatataggcagtgtagactgtaaatctctaagtgtaccctccgggccagactctgtcaattggagagccagcctttccctctgggaattggcggcctggctggggaggcagctgttacacatatatttgtaattgtggtcgtgctgcaaagaagagaacagggtttgcatggcatgtgtatggtgggtagcaggaaggaggaggtgacgtctcatgtctgtgctgaggtgtttccagtgttggcacacttcctcacaaagacacacatgcgtgcagtttgggggcaggtgcctgttttaggaggatgggagcagcagatattatttctcgattctgtttggtagtggaacagcctgtgctgcatggatggccagtccttggagacgctggggaggtacgagtgttttgcagtcaaataagtgtgggaaatctgacttgctgcatcccctttagggagtcacagtgcacgttgcagagaaaggtttccttcccctcttctgcccagcacagaatgtgaaacaggatgttaaagagaacaggctttggatgcagacattcgaatccaagcttggttcagatcctgccccattattccagctgtgtggccttggatgaagtccttaatctctctcagcctcagctttctcatctctgcaatggttgttccgtgtatttaatgagaaaacacgtgtgagaaactcaaagcaggcatggggtaagatgcagtggctgtttattactgcccccatccctgccatcacctctagacttgaaagagcagctttctagactcttccagagcaggtgagaggaaagtgtgtgcagccaggtttttgtcttttcatcctcttgtctggatcaggccctgtgagcagggtcttctgtggcctggtcctgaactgtggaagagctgggtgtggggctctggatggtggaggagttgtgtttgtgttgccagccttgtcccagccagaagttggggggtccctcatgagcttcgagacaggcaatttgctctctcaggcaagaggacgaacagtgcaccttgcagttctgatgttctgggttccttgtgctttctctttgggaaaacatagaagacacgggatgggttcctctctccagaacactgagtgattgatccccgcagggacagaaggacagaacattcctttgggactgaataggacaaaggcctgtgtttgtgagtgttgtaattctcccattcaatctcagacagtcttcttgactggcttagaaccgcgtgcgtgcacgtgtgtttgttggtgggtgtgtttgttgtgtgtgtgtgtgtgtgtgtgtgtgacttaggggatgggacttgggtacagggaagatgacaacacttgcttttttcctcctcctcctgtgtgtgctggggggccaggaactgagtggaggaccgatgggggccagcagaccctggcacaaaggagcaagggcccagcggagagagttcgaatcctagttctaccaccacaaacctatgaccttgggagagtcccttcaacttctttacctataaaatgggattgatgggcctcccggtggcatggaggtctgataccctgccttactcttcgtaggcgcttagcaaatgttctccctcacctctgctcacctatgcctgggaagcagccctgcccctgtgtgaccttcaccacttcacttccatgttctcagacggggtctttgtccttcccaccaaggctagcaatgtcgaaagcctcttttttgagtcctgctcaggctgaggtttggggcagtgatgaggcagcagccagggtcctgacactcatgagctggggtgaagtgttagtgctctgtgaggctctcaccaaccctgggggtcttatcaggagggagctgagcatctcatggccaatccaagagcagagtggggaagatcccaacatggatcgatgcccttaggagagaaagttcctttctagggtgtaatgctcaccatcatctgtcgggatcagatctcttatccagcagataccgggtgcccactgagagcaggcagctatgcagaggcctgtggacagaaagtgagtgagacctaggcagcctttccttcttggactgaggaatagatcctccagtttagttctggttccatggctgtataattttaagaccttcaaagagatgagtcaaaaatctgctacccactcgcaactccgggggctgccagggacattcttgatgccagctggggtggcgtgtcccatacctgctgccacattagtaccctctgctgcctgcaccgggagtccccatcctgcctggtgctgtgctctgggctccgtgcaggtgactcctctcctgctatggagtctggggtgcaggcggccctcccagctcaggggtgaggacctggaggctcggaggttggggagtggtaggacttggatttgaactccgatgtccgtggcggtggggacaccgcctgccctggcctgtcttttagagggagccatgtgggtcagctggggagacaatgaagaatgtgcccccacaaacaaatggacctttgttcccacagtggcttcagggctgggctgggcccagcagatgatctccggccccctggaagctgggccactgctccctcatctatggatttttccagtgcctgttatgggcaggaaagaagtgttgggccctgaggggcagagaggggagaagggagatggggctgagctctgtgtgccaggggacttaacggtgttgggggctaatgcaggtgccaggatgaccccgtgctgggcgggcccgggtgctcccagggggctgggcctggccctgtacagtgcctctttatgtgtcaccaccctcacctggtaaccactgctgcgtccctgtgccattcaggaacagggaacttttaggtaaccttgaggagggcggaaacccagggcaggcgagtgaagtggcaattgagaaagagtcacgaccaccctctgcaggagtttagatgaacatggcaggtgagagattggtccatgagtgagctggggtgcttgtctcctttctgcagaagcacgatggtggcctggggctggctggcttcggggttctccaagtgagtgtcgggaacccctgcactcctccgctggggagggggaggtggtgagttcttgttggaaactcagtacggagctttcatacgctgcgggggaacctgggaattggatgccatttttctttatttttgaacttgttcctcaggttgagaatcgttggtcttaagggattcaggaggctttcctggtcccattcccagcaaccccccagtgggttaaatcctctttctcctttctcagaggacccagaggaactgcagccccccggggccatttccactgcccccactagcttgtgagttgtcacccactcgtccctgcggggacaaaggggacctggcatacaataggtgcctaatgaatgtttctcagatgaaattgaactgccttaagtatcaggggtaagaagtagcagaggtggaatccgatcaccagcgggtgtggatggcgtgggggtggctgcctcgtaccacttcacggggggtcactcacagatggagcagcctacattctctgggccttcagcacctctaggaggtaggaagggccaggctgttcctgttttaaagattcaagctggggaggaggtgacttgcccccacagggtgcctaagtggtgatctgtcccatcccttcttctcaagcgtgagtttgtgaacgctgaccttcctctctgctgccacacggcagtgatctgtatgggtcgcatttctgccagcttctagaagcaggttcaacagcatttagagtgttctgtgttccacttcactgcctcatttaatctttggaaaatcaatgcagcgtgctgagctgaggtggcctcgtgaggcctgagtgtgcgccgcttgcgggcgggtcaagtgctgagaagcctggggccccgcggaggctgattgtctgggggacctgcctctgtgctgcctgcccgtgtgactctgggatactgacttcacttcctcagccagctgggtcacatggctctggcagggctcctgtgagggtgaggacatggagggacatggttcagcactgccttgacacctggcaggtctcagcagcctgatggccttgcctcctgctccccaactgccctgtgggagcagagcccagagtggggcacttcaaaggggaggtcactgctctcagatgtggaaattgctcaagggagatgagtgactggggtcctcgggaacttctggttgaccttgaggagggcggaagcccagggtaggcatggggtgaagggtgagtggaagtgacaattgagaaagagtcacgaccaccctctgcaggagtttagatgaacatggcaggtgacagattggtccatgagtgagctggggtgcttggaaccaaggcagggtgccttttttttttgttttccagaggaagaaaggtgagcaggtcttcagctgttaggaaggtttggtgcggagaggtgcagggatgactgggagtaagctggctgggggtcactggccgagctggagagttggccttgacccaaagaaccatctggctcaacaagaaggaagggcaggagggaggatgggcatggtatcattcagaatcttttggtcaactcaacatggcttacatgggattggaagttggtgggccgtgtaactgaaaatcccaggtggtggatgccatccccaaaccgtctttcactcttttccatccctgggctggccatactttcaggcaggcccttgcctcacggtgacaatgtggctgctacagatccagccctcccaaccttgctccatcaagtccgatccagttccccaattactagaaataagtgcagctggctttagttggcctgagccaacccatgtgttctttcctgatccagtccttgcaactgggaggtggagtgcatgaattggccttgacttgtgaaacgtggggaggggggtcactgtcaacagaacacttaggactgagggtgagggttgggtgggttcctgaaggaaactgagggctgttcttggaagtggggagtgaattctgtgtagccccaagccagcagatgttagtcacaggtacagtaacctgtggggccagtggggcctgagggcaaggaagcaaggaagcgcaggcttgatggcctgttttccagatggagcaaacagtccggggcagagatggtggcgggcaagccctttccccagcatttggtgcatttaacagcgcagtctgagccaggcctctgtcccctgcctcctgggagtcccctcctagccctggtccttggagtggcttctggccagagagagctgctgcccgaagccggggctcttatggccagatgagaagagagcttcctcaaaacacagttggaaacaggctggctgtcttcagccacgcggatgccatgaaccccacatgaccagcccactgtctgctgtgtctcctcaggagcaggacatcgagactttacatggctctgttcacgtcacgctgtgtgggactcccaagggaaaccggcctgtcatcctcacctaccatgacatcggcatgaaccgtaagttctgaggagctctgattccctgtcagccggttcccaagagagtggcggaaaaaggcagccgagaagggctgatggccgggagctggtggtttctttttgcctgggacttcctggggctgttctgggaagaactcttgccacagcctggaaaagccagaaatgcgctgcatgtgggcacggagttgtctgtgtgcccggaggcgctgggaacacaggaagctgtttgctatctgtggcagtgacttctatattaatgcacgcatatggttttcagtcttttcacagaattgtgcaacgatcagcacaattttggaacattttcatccttccaaaaaatcctgtaccttttatctgtcaccccaccctcagatgactgacccttcattgactttccttttctgtgaatttgcctgttctggaattttgtatacattgaatcaaataatatgtgatttttttttggtaactggcttctttcttagtgctttcaaggtttatccaggccatgcattaatatttgtatttcctttattcctttattgaataataatattccattgtatggatttaccacactttattcgttcttttttctttttctttctttctttttttttttttttctgagacagaatctcgctctgttgcccaggctggagtgcagtggtgcgatcgtggctcactgcaatctccacctactgggttcaagcaattcttttgcctcagcctcccaagtacctgggattacgggcacccaccaccacgcctgactaatttttgtatttttagtagagacggggtttcactgtgttggccaggctgacctcgaactcctgacctcaggtgatccacccacctccacctcccaaagtgctgggattacaggcatgagccattgggcccggccatctattcttcagttgatgggcatttggggcattttcactttttggctgtgtgagtaactctgctacgaatgtttagactgtgaattccaagattaccaggagggttttcttaggtgggttccccatttttcatagatgagaatggaatggaagctactgaatgttgaaatttcatggaatagaggtgaattcttctgtgaggaatcagaagacacaggtttcactggtcccgtaatttttatgaacttgagtattgcaagcttgcttgatttttgacgatggactgcctgattttcatttgtttctataaagcttattaataccttattaataccttgaggctggggatggtgtcactgaaatccactgaaaacactttttcacttcattctcaccttcttttatctcacttcttcccctgtctgtttcccttatatccattttgtaccaggtccatgctaggtattttgatttacactatctcattttattgactctgacaaggaactggaattgcatatggcagcgtctctccccattcggagaggctcattgttggtttataataggcttaccactgtaacaaaagatgccaagccctctgtggcttaacacagtatatgttttatttctcgctcatgtaacagtttagtgggtgtttagtgggacatgttctatttggcaattcaaggacccaggctccttctagcttgtgggtttgccatcccctggggctgcagagccttctgctggaaactgtgcttctggcaggtagatgagagaagagagaaacttagaggatcttagagaatctgggtggcaggtatggtgaggaaatggtgacggtcacaggctatcggccagaaacagatcacatggctgcctctcattgcaagggagcttgggatataccgtctagctgagtgcccaggaggaaaagggacaggaggtagggtgagcagcccgacttccttaggcttcagcagtgaggagactcatccaggccacatgaaaggaggaggcacgcctcacctcccatgctcctcctcgtttgaaaattatgtgtgtcctggaccagtaccccagatgggagggtatagtggacccagatggaaagagaggatcaggagggcaaagccatctcatgccagggccatcctgaccctggctgactggaggagctacaggagccagcctgggaaccccttccagcaccaactgcaagactcatctgccagctaccactcccttgccccatgaaacttactcttgctttttatcagcagaggaaagtgggcatggggacaaaaccaaaaaacaaaaaacgccaacatctgtgttcttctaagttcacttcctacttctgaataggaatgaaacaaaatgaatgtgctttgccaccgagacacctaatttttttctcatcttacttttttctcttctctccctcactgctgttcttcagacaaaacctgctacaaccccctcttcaactacgaggacatgcaggagatcacccagcactttgccgtctgccacgtggacgcccctggccagcaggacggcgcagcctccttccccgcagggtgagaggcctcttgccctatgagctctacagggtggaaactgggtgtcggggaggggttcaggtgctttgctcttttaaatactttttaactgtggtaaaatataaaacgtatcatcttaagcactttttaaattgtgggaaaagatacataacataaaagttagcactttcactatttttaagtatatagttcagtggcattaaggacatgcagacattgttgtgcagccgtcaccaccatccatctccaggactttttcatcttcccaaactgaaacaacatacttatcagatactatctccccattcccccagccttcctgcaaggctggcgttacgataggtgtgctcagcctggacaggacttcagtggaggaggacttgacaccaccaaatagtgtgaagaaaaacctagaagtttggggagaaacagagagggagagaagtaacattgatggagcccttcctgtgggctaggcttcatcatttgtatctaacactgggcttaatccttacagctagctctgtgtggctgctgttgttagctccattttccagacaaacatattgaggcatggaggcattaactaccttgctgaaggttgcacagctgaggccgggcatggtggttcatgcctgtaatctcagcactttgggaggccaaggtgggcggaccaccgaggttgggagtttgagaccagcctggccaacatggtgaaaccctgtctccggccaacgtgatgaaaccctgtctccactaaaaatacaaaaatgagctgggcgtggtggcgggtggctataatccctgctactcgggaggcttaggccagataatcccttgaacctgggaggcagaggttacagtgagccaagatcgcaccactgcactccagcctgggtgacagagcaagactctgtctccaaaaaagaaaaaaaggttgcacagctgatgactggggagttggctttgatcctatctactgagacgtgtatcctctttggaacatcaggctgccttagttgagagtatttgcactgcctggcccttgtcagctcgtgatctgtatgggcatggcctttcaatttccccttgtgcaattatggtcaagcttgttggatcccccaatcagcatcatgtgggggtggcagacctcagagataacccctcttgtccctgcacctgacctgtgtttaaactagggcaggagcaggttcttgggcttaaagtcttccagaaggggccttcttggcatttataaatagatatccttttttattagtgttcagaattatccttaataattaacctttatcagagaggaagggaagggacagccaaccgtatggggccaggaccaaaaattaaaagtgtattaaaacagtgggacgtggttaattgttaaccagcagataaagccagaggtgtgtccgtaaatctttggttggaccagttgtgtgaaagacttgggggaaagcagagactcttagttccccctggtgaagttttacaaatattctgaggcctgagccccacccccaggaatttttattccgttggtctgggtattacagcgcattttccccctagtttactatgtggttttcgtgtgcatctggtgggacccactgtcagagtgggacctgacttgtttcttcctcctggagtagggcagaggagagtgtggggcttgggaggggtgagggagcatctcccaggccctttaagggtgagccccctgtattctgaagccgagacagcagagcagggtaggggatccctggctgggctcctcctggccccggtgtccaccacctacacaggagggaccttggaagtagaattctgctgcttcctcgcctcacaccagccctggggaacagggaagaaacagagggccctgcaattaagtggcttctccagtgtcacaccttaggagctgctggctccaaattgagccatggccatttcagaggagcttcatgtctttgccgcacttctgccctgcggcttctcagctcagtggctctgttgatgtggagccacaccatacgggctctttctggctcttcccagggcgtccgcatacactgcttccctgcccacacgctttactcatcaggttcccatgaccccttcagcgtcacttcttccaagaagccctccctgatcatctgagcacggcaggtctctgtttcgataggctttgttatgagtaacaccccctgtttctgttgactcgagggctggctcctgtcctggtttgcatctgctttgctcacagacccctgccattgcctcaccaagagcccggcatgtgtgaggatcaatcactgctttgcggatggaactcattcatgcctgttttaattccttctccctgacattggaattgtgaaatgccttctagtcagtttctgcaacaccctagacccaaaaccagacaaacacagtgaggacatgtttctggctaaccatctactgctcttgtgaggccaagtgtctcatctctcagcctcagtgatgtttataatcttgctatgaggggaaatcctagcagcctcctagagttattgtgaaaattgaatgagctaattcccagaatgtgtccatgggacctggagcgtaggaagcaattgatagagtgtgctgcaggggtcttggaaggaggatgcgaagggactagacttgggggtgggggggtctgggtgcatggggcaggctgctgcatggtccccacccttcaagcgtgtccctgtttggattacccgtttctgtccgggcgctcactaatggcttctctgtgtcatccccaggtacatgtacccctccatggatcagctggctgaaatgcttcctggagtccttcaacagtttgggtaagagcgaaggatcagctccttctctgtctgcagagaagcctggtttctagcatcttcctgccccttggctttgatctggactgaccactaaaattaaggttgcaatttagagatgaggcaagaaattagctcgtcactctgtgaacactgttcttcacacagtctctgagctctagtctgtctcctctaacttcagttttcctcttgcgtgaatgttatattgcatgatggcagctgccccacccatttgctcttgcctcctgttcttccattcccttctctttcccatggaatgttctggaatggagttgcctgagtccttagcttttctctccacaccctcatttttccagtgttcctctctgtcttgagctcttcaaagaatgataacttcatggttcttgctcaatttgttttcattccaagttttagaatccaaaataaagcttaagagtgggaagaaatgatgccgtaacgggccttcccgtaaatgtcagacggtctctcagagcctgggtggcggccaggagggaagtgaggagaaggggcgcggctctccaaggtcgaggtctctgtccagtcctaaagcatggtgacctcagagctgtgcaggcagttacggcagcatgctcccgcattgcctagccaggcggtcaccctcaggaagttctaagtgggtccttggaggctcccgtcactctgtccttgtgtgacatgcatttgtatttttgcttccaggctgaaaagcattattggcatgggaacaggagcaggcgcctacatcctaactcgatttgctgtgagtgctttggcattttttgaaaatcgcattttaaataacattttaagatgaaggaagacattggaaaagcatcaaaaacccaaaagggaaaaagaaatgacccgtattctccacagttgtgtgtgtgtgtgtgtgtggtgcatgggtactcgtatatatatatactcacagccttttctcttcctccactcaaggatgatactggacacattcctttgtcatgggctttgtccgcttagccatctagtgaggacgctcctcactcactgagtactctgctatgacactgctttgtaacagctgtacaggtttttgtagtcagggcactcctgggtcataactgattctaaactagaatcagacacgggaagttttcatgacagttgtcattgttatttctctgggctcaggtcaagagccactgttcctttgtatcctcaccgagcaattgtgtaagaatgcaacaatactcattttgtacatccattggtattttgactacctattatttgctgggctttgctggaggttgggaatactgacatgattctacaacatccatcttacaaaaaaaagaaaggaatgctgacatgaatacaaaatggtctggccatataggctctcagcaaattaaaaatggtctcaactgtaccccaggtgtacatatctatatctgtatgtatctgcatcacataatgacattttggtcaatgacagactgcacatttgacagtggttccataagattataatggttcatttttactgtaccatttttatgtttagatttgcttagatacatcaatacttagcattgtgttgcaattccctgcagtattgggtagcgtcatatgctgtacaggtttgtacagcaaacctaggagcaaagggctgttctatacagccttggtgagttgtagactatactgtctaggtgtgtgtaagtatactctgagatcttcacacaatgacaaaatctcctaatgatgaattttctcagaaagtatccctgttattcagcgatgcataactctgtctctctctctgtgtgtgtgtgtgtgtgtgtgtgtgtgtgtgtgtatgcatgtgtttatcctggaagtaagtaatacagttgttactgccacaactagagagcatttgtgctgtgcgccttgtttgattgatgaggtcgatggtgtgttacacccatttgatagctggagaagctgagcctccgtgggttgaagtgacttgcccaaggcaggcctgcaaagcagcgggcttcctacttctcctgcacttcctctttctccttcccactctctctaggacccgataccgtgtctgctgtgctggaacctcagttttgcatggggtggggccggggagcagcagcctgctctgctgcccacactgcctttttctgggtacttctctcaagctttggtttgccttggaaagttcctagtgtttcagattgctgggatgtctgtctcactttgtgtcttgaattgcagctaaacaaccctgagatggtggagggccttgtccttatcaacgtgaacccttgtgcggaaggctggatggactgggccgcctccaaggtgaggtgggggcctgtcaggccggcgggatccctgcaagaagagggacaggtgcacacagcctctgcctgggggatccctggagctacgagctctctctttacccactcctccactaccctctactgcccactccagttccctctgctttacttagaacagtacacatgacctcagccgtttgccattcagaagacttaaataccaccaagctgtctaagccagggaaagcactgggacacaggtccctgaggcagcttggagaagcattgcttggattaatgagtattagctgggtacataacttgtgccaggctttggtcaagatgctgagcatcttgaagaacaagacttcttgagatgaacaagacaaaagcctctaggaatgaatcttaggaatccattcacatattattaaagaaaaataaatatgtatttagtacggactgtgccacagaattttacgataataattagctaacgtagattgagagtttaccatgtgctagtttcattctacgttgctgtgtgtgcatgatctcagttaatcttcatagtaactctaggaggtgagaatttttatcaccgtttcagaggtaaggactcggtgtggctaaggggattgtccagggtcacataaagctaggcagtagaacggggactggatgcagcttgctttgactttgtggttcgtggacctgaccacccgtgcccctggggctcctgtccagggtgggagacaggcaggcctggcaagcagggtaggctgcctggaggagaagggacctgtgctgtcttgggaagctctgtcctggctggtgtcctaaggttccttgtttatcttttaaaaattatcattgtggtgtttttgtttttgtttttttccctgtaaaggcctcagtgttggccaaggagagggggaggtcattccagttgaaataggacagagtctttcaagctgaggtgatcgcagcttctcattctgcaagtgcatttttgcccaattttgggtggctgccagggaccgatggtttgaaggggccctgcctcttgccccatcccctgccctgtaccagccactgtgattttgcatttgttctttgaacattcctccagaatgcaggagcccttccgtccagcctgtatgacgttctggagtggaacacactccctgttttttatttgattttccagcaaaggaagtgacattccagtcaacccgctgggcttcatgatagctgtcctgagtgagactcgaaggtctggggatgtcgaccactggctaatgtgaagcctgaggattgtctttaatagctgtactattcccttcagtacagctttaatagctgtactattcccttctttttcaactccagcctttcgattaccaggcattggtattagatactgtgatgtgtgcagttacttcttgcagtccttcccttgaccttgtggccttgaagttcctggcactcccagttccagattagaagtctgagacccagaggtatgcagactgcccagtgccacacagctaggctgtggcaggcaagggccagccaaagacccttaggtctagagcttctctcctactcatttttgcctaatgcttaggtcagcacacatttatggagcttctgctgtatactaggacttatagagctcctgctgcaaacctagtcactggggagaggtaggaaaagaagattgtcagtgtctttggtaatatcagtatacttagaaaggggaaactggcttggagatgagagaggagggatagttgggagccaagcatatcttggggtatagactggggagctcagtgtgtttttagaagaggtgaatggatggccctctttgctgaggacttggtgaatgtttggagcagggtaagctagcagtagctgggtctttattcagcacttatttgctgtgcatcttgtgcatgggcctctgaaaataaggaactggatatagtcccaggccctgcatttgggggatcaggtccaggagggaactggagacaggaactgagtttctatcaagggggatgtccttgaggcctgcatgtaggggggagtccagcaatgccaccctgcacccagggaagtggggttttgctgaccttgttaactactgttagctcctggtttctcatccacccactttactcctttccagatctcaggatggacccaagctctgccggacatggtggtgtcccacctttttgggaaggtgagttgcgtggtctggcaaatctgttgttcctgctgagcaaggcattgtgtggtgctcagcacagggccccatgtgggggtggagagaacaagacacaatcaactgggggccaccgagctggtgctcatgagataatgtgacattattcattcataagcaacaagtcattcattctctctcttttttatgtgtcttttaaaaacagctgattgaagtacaattaactgcacatatttaaagtgtacaattgacatgcatatacatttgtaaaaccatccctgtaatcaggagaataacgtctccatcactccaagagtttccttgtgccccttgatagtcctcctctccctcctcctcaggcaacttctgatcagcattggcctctatagattgctttgcaattcctagaattttatataaatggcattatatagtaggtactctttttttttttattttggtctggcttctttccctcagcataaccattttgagatttgtccatgttaatgagtggatcaatagtttattcctagtcggggtgcagtgctcattcctataatcccagcactttgggaggccatggcaggaggattgcttgagcccaggagttcaagaccagcctgggcaacatagtgacaccttgtctctacagaaaaattaaaaattggccaggcatggtggttctgcatgcctatagtcctagctacttgggaggctgaggcaggaggattgcttgagcccaggagtttgaggctacagtgagcagtgagctgggatagcccactgtattccgcctaggtgacagagagaccctgtctcttaaaaaaaagtttattcctttttagtgctgagaagtattccattttatgtatgtgcaacagtttgtttttccattcacctgttgataagacctttgagttgttcccagttctgggctgttataaatctggtcagtagcaaacatgtccgtggagttagctgtgtgctgggctgggctcagtcctaagagcttcacaagtgttaactataggaataggattccacccaggtgctctgtgacctgtgtgataaattctgttctcattcccagtttatggaagaggaaacagaccagagaggttgagtgacttgcatagggtctcaaccagggagaggtggggccggtattagaacctatgaatctggcttcattctggtcaccacagcaggatggcggctgcctgtgctgctgcctggctctgagatgagctgctcttctgcagagttaccccactaaaggggattgagccaagcccctcacagcatgctagaagtgagcagtcatcttatcagcccagcctgcctggccccagacactggttttgtgtctctagctggggccagctaccctcgggaagggtatgccatgggcttggttgcaagcccagggtctggaaaaccccttggttgcctgaaattgcagtgacctgctttgcttacataccactgtctgcttctgagctaacatgtgtgaccatctgacactcccatgagtcctggggacacagcctccactctggagctggcgagtacaccaggggaacagacgccccactctggagttgacgagtgtaccaggggaatagaggccccactctggagttgacgagtgtacgagggcaatagaggccccactctggagttggcgagtgtacgaggggaatagagtccccactctggagttggcgagtgtacgaggggaatagagcctccactctggagctggtgagtgtacgagggaaacagaggccccactctggagctggcgagtgtacgaggggaatagaggccccactctggagttggcaagtgtaccaggggaacagaggccccactctggagttggcgagtgtacgagggaaacagaggccccactccggagttggcgagtgtacgagggaaacagaggccccactccggagttggcgagtgtaccaggggaacagagaccccactctggagttggcgagtgtaccaggggaacagaggctccactctggagttggcgagtacaactgctaggtttgcctgttgtgttggtttcctgtggcttctgtaacaaattaccacaaacaggatggcttagaacagcgaaagtgggatgagcagggtggctcacacctataatcccagcactttgggaggcttaggcgagtggatcacctgaggtcaggagttcgagacgagcctggccaacatggtgaaaccccgtctctactgaaaatacaaaattaaccggatgtggtggcacgcgcctgtaatcccagctactcgggaggctgagacaggagaatcacttgaacctgggaggcagaggctgcagtgagccgagatcgcgccatgcactgcagcctgggtgagacagagggagactctgtctcaaaaacagagaaaaaggaaaacaaaagtgtattctctcacagctctgagtctagaactccgatgtcaagcgctggcagggccgcccctccgccacaggctccaggggaaattcgtccttgcttcttactgctccaggtcgctgtcggcattccttggctagtggctgctcacaccactctctgcctctgtcttcacatggtcttctcctctgtgtctgttttatttctccctctccttcctcttttaaggatactttccattggatttcatcccggctcatgtaatccaggattatctcatctcaagatccttaattaattacacctgcaaaaaccctttttcccagcaagtttgcattcccaagttcaagagatttgacatggacatatcttttgagggccacagtttagcccactagagtcctctttccccttttacgattcattccacagcgtgtgacacattttccctgtcctgagtgtgtaatctgaaactgataggaattgggaaaaattcacagccactgtctctgtttcactggaggagggatgtcagacatagcgttgagcatctgatctgattataccccaagttatttggagactggttggtccggccatggtgtctgagggtacccccagatcgctatagttggttttgatctgaaatcccagcgtgattcctgactattttttccagagtttgctcttagtagccagttgacctccttgctgcctaaatgatcctggactgtttgatgcagctcaagcttgacaccggctttctttgacccccaactccaacttctcatctggttgccactggtcatatcagacccttgtgtgaaacctacagtgtctgccctcgtacaaatgagaaacagagcaaacaagttgtttgtcgcaaataacattcaaaaagcacccagagacggggaggctgaggccgacttccccaaggctctggttggccgtggtgggagttgcaattgcccttcttttcagtaacttcctgtggcatgagttgattttgcttttcaagcatgaaaaacttcttttcagctcttcccattggaaaacaattactaacatttgcctccaatttttactgttagtagaggtgagaacacaacctccattaagtcctacaacctagtgaagtaggcaacattctctctcttcccttttttttttttttttttttaagagatctgaggctcagagaggttgaaagatttgcctacgaaagggacagtgatgaagctaagctctagatccaggatgtctgacttcaaattgaaactcccaaagtaatgagtttggaagggtggggtgtggcctttccaggatgggggtcttttctgctcccagcggatagtgaaacccctgtctgcacctggttgggcgtgttgctttcccaaaggttttttttttaggtccgtcgctgtcttgtggattaggcattattatctttactttgtctccaaataacctggagaatggagagagtagtgaccagctcagggccacagtgcgatgaggaccatcttctcacctctctaaatgcaggaagaaatgcagagtaacgtggaagtggtccacacctaccgccagcacattgtgaatgacatgaaccccggcaacctgcacctgttcatcaatgcctacaacaggtattgggatgtagttcagccacatcattgctatttatgaggtgtcttctgtagatccgaaatgtgggacagatgagagggagagtataaaatgagcggaagaggcaggctctgagtttgagcaaatagattaataggacaggtgtccccaggaaggacacctggcctgtaagctggttcctggcattcagctcgccttgcagggatctgaacaaacactccagaccactgggggtgcagacgtgagagggacgcagtcgcacactcagagggttgagagtaaatatgtgtgcccgctgctgaccttcacgaaaggccaaatgtaagaagagctaagtgagagagcagcaaagcactcctggaggccggggataatccaggcaggcttctgggagtttgtcattccaaggataaggaggacctgaacatggcctttgcctaaggcgtggccctctcaaccagcactaggtgcttatctggagctcagctaggggaggagacagctcagggccattggtgtcagccagagactctgtaatcttccagggagctcgctcaacctgctgagctcgctctgccacgctcgcagaacaggagatagaaatgagcctcatagtgtttatctctgctcaaatgttaataaagtgacttcttgaaattaacatttgtaacagagcttagtatctgcctccttttacaatcctgccctcatctcagtggtaacatcctcactgtggatgtgactgaagaaaccgaaacctggcagtgcggttcacttagtaaacactttctgagaactggagcgagtcaggcattcggctgggcgctggagacacagaggaaaccagcacagcccgcagactccacactgttaacttgcccgtgtagatagcaccgtaattaactgacccctctccaaatcccactgtgaaggtcctggaattactgtcatttcctgttgaggaagcaaaggcgcaaagagatcctgtgttctccccaaggccacacagctagaaagtggcagagcatgatttggatcctgcttgtctaactccaggctgtgagctgggaaagagcttctcatgttgggagctgcaagatagcagagagggtgggtggctgcgtgcaggaaaggtggtcggcactgggctggacccacactgggcctcacacgagtgcagtgggaaaccaccacagggtttgagacagggaatggaaagatgaggcctgagttttaaagagatcatttgggtgctttatagaggactcagagttggtgaggctgggacttaaactaagaggctgcgagagcatttgggaggtggcccctctgtcaggtgggggctctgactagggggacagggaaggcggggaccctctatggtggagaatctgacttctactcctggaaaaaaaagccccacaaatatttgtgacaaaatgagggggctctgcttgaaatgcatgtgttgtgctgtccctctaaccaggtctgtggacaccaagagggtgtggagtcctgaaagccacagggcctctctcaagttggggatgtgggtagcttaccagaatggccactggcaggacctcctgggcttggctggatgggagtgggagatttctccaggggaggggtcctcatgctaatgatgcatttgtttcctgcagccggcgcgacctggagattgagcgaccaatgccgggaacccacacagtcaccctgcagtgagtggcttttctctcccccagcacttgcagtcggggctgcccactataaaggtggccttgctggcagggccttctttctgagtgtggcaggacattgtgtcagtgagacctggatatattccacccagagactgagcattacccagcctgacttggacttctccctgtgccggtggcatccgtttctagggtgtccccatgacctaggcctttgatcttggagaaggatggttgattgtacttgggacagcatttattaagcacctactacatcaataactgtgtgaggctttgctccatgaagcctagggatggatagcacaggacccagccttaaagtgctccatacacctaggaggaaaagacagtcatggacagaactaactgggtttccaccagtaatgatggtgtctttttgtggctgagtgcaccgcgttgtgtgacacttgggaacctggcacgtcattgcctttgtccttcatgctgttcttgtttcggtcttgattgccagctaagtcctgcttaaccatccttgaggagaagatgctttaaaacaaaagcactgagtcacagaaattccctggctgaaattcatactaagttgtgaatgactagtaaccaatgttatcctaagatcaaaggagaatgaagtaaaagagcaaagggtgttggggaaaccaaaatgacattgtttgtagaatgcaggccccagcctggcaggcctgggagtgggacaatctttaaaggaaccttgtgctaattctctgctctatccctgaccccaggtgccctgctctgttggtggttggggacagctcgcctgcagtggatgccgtggtatgtagaaatcacagctgatttctgtgtttaattcaacaggcaaagtctggttgactttgttgaagtggccctgcctgcccctcctctcctctgccccatcagggcaggtgatgttttttgaaatgccatattggcctttgggcagagggcccagccactcagtctctttccctggtggctgccagccctggttgcttggcagtgtctcctctcccaggtcccctcacccgccagtctgtgtcccatcggcttgtttatatgggcatgtttgccacttggcttcctggccaagagactcacctcttatttgggaagcagctggatctttccaaactgactggtgcctgatgagctggcaggggagagaggcactgggaggcagggcttagcaaagcttcctgactcctttcaccccttaactcccacctgcaactttgtggcagcaaagagaggaatctgcctttcaaacaaccccacagctggggagatggaagacttaggggctatggatcagagtcctgcagtactgccatgctttgtgcagtgatctgcagagtgacatttgcaaatgttcatgtagtaaatacctggcatgccttagtgaaccatgagtttcttacgggctgactgactggagataatcatgggatacatcaatagagatacactgttcaaatcaagggaggtgatagttttactttaagcattttgaacatcctgggttacatatgggtattctgcccaattccagatgcccctttcaagaggttcactgacaaaatgaagagagaaaccagtgtgattttacatgaagaatagttgttagatctgggaatattaaacctgtagaatctctggcagctgctggttaaacaaggatatttatttagcaggtatttctacagtactgtttacatttcggctaatcttcataataaccttttgaaaaaagatattagctccattttattgatgaggaaactgaggcccaaagaagttaaatcacttatccaagttgtcacagctggtaatggcaaggctgggatttcaagccacatctgctgaatcccaataactccacatactttcttctttgccagcagaaatactggagtttctggtgacggtggcagagtggcggagaagggggagatgttttggctttggcttcacgtagaaaattaacagatttcctccctcttgtgcaggtggagtgcaactcaaaattggacccaacaaagaccactctcctcaaggtacagggaaaacagtgggggttcgtgtttgttatttcttagaaactctcagacgttttctgcaacattgagttaggcttgaaaaaggcaaggcacacgatcagaaactatagaattaatgatttaatctatctgtttatgaacatatattgggtgctgactggtgatctgaggctgcaaagatgagggatccttctctgggactgcaggaatcaataggctgctggtctgggggctttggggatagagggaccagggatggcttggcaagggccctccataggctggggccaggacattcctccaagaggggctctctgcttgtcacaataagaagagacgtgtcccacagccggggaaggtcaggactttgtccagcaagttcatctgagcacatggtgagccagctcactcgcagctggatttgagggtctgtagcaacctccgccagtcctttgccagttatgactgattgcacaatgcaaaccactggctgtttgtggcggcctcgtccggagatgcagcccaagagtgggaacctttcagaggggcctctcagccggggtgcacccctgcaggggcagatgaccaggcgggacctgggtggagatgaggcggctccctcgcactgggggaaggacaaagaggtggcatctgtaggtcaccgtgccctcaacttcccccatagaagtagaatgcctttgaaaggcatgtagggggtgtccgatacttattgagtgggaggctgttttcctgtattgggctctttacatagattttctttcaagattccctcaaaaggaaattgcaagattagaagctgctgggcgtcaagcttgcataatgccgtactttgagggcggttgtcacaagtatcacaaaatgggtggcttaaagcaacagatatttattcccttttagttctggaagctaaaagtccgaaatcaaggtgtgggcagggccgtgctccctctgaaggtgctaggggagaatgctgcctgcctcttccagcttctggtggctgctggccacacttggttcaccttagctagtagacacatcactccagtctctgcctccatcctcactcagcactctcccgattgtatctctgcgtctatgtccaaatttccttcttcttttaataacatcagccgttagatttagggcccgctctaatccaatatgacctcatcttaacttgattttacctgcaaagaccctatttccaagtatagccacagtgataggtactggggttaggacttcagtatgtctattttggggacacaattcaaccacaacctacagcaaagggtaggtggcctgactgaggtggggtggccgatttgatggtagatccagaaacagaactcacttaggcctgattctggagacttccacagcgccagtctaatgtgctgagtgccccgcctggaggaaaaattcgggcatcctgctccctgcgtgctggttgagctgagggctgccccaggtcagtgtcgctttgtggctagtgttgggggtccagacttgaggcgccctgggctgtaggatgcccacagcctcaccactcccatgaactcctccagccccgtttcaccccaggccaccctccccgcagcctccccctgctcccttgccgtcagcgctgcccatttccaggctggctgcacagtctcacagcctgcaatggcctcttgcggttcggtgatttcacagggactttgaacgtccaccatttaggaagggtactggtcagctgaatccggcctgaagacccaaattcaaccacttccttttgagggaaactttcaagggaatatatgaagagggtcttgtttatcaaaccctttcgggtcagagagatcctggcctggaaccttgcgagtccctcaagctcttcctggcccagtttctgcctgtaaaatgggacagctgtaccttccatggttcttggggaatggagtgaaattatctgtagggcctagcatagtgcctggcacgtagcaagctgcaagtgatggttgccacggagacaccagcagccttgcctggtggggctggagtgttccctacccacggtccaccctgttcctcctttgtaaggcaggacaaggcagggcagggcagcgggcggatgggcatcctttcggaaaaaattcatagagcgcagagggccttggctgtggtgtttggcactaacgagcttccctctctcctagatggcggactgtggcggcctcccgcagatctcccaggtgagtgccatgttggcttttgcattatacagctgtcgcttccccctgggtggagtgcatgtgcctctgtgacacctgttccctcattaccttgctgtgacatcggatgacagtttgtggactgttgggaaaaggtgctatataggaggactctgattccctaggaaccaacccctgtggagtaggtgatactgcggttcacagaggttgggggatttgccaagtagacacaccttggtcatcatgggtcagaatctgggtatgtctgccccaaagaccacgggcttctgctggagtgaagggccgcaaggagctccagcccagagcagagggacatggaggagattaagccaaattgtgtgtgtgtgcatgcatgtttctgtgtgtgcatgtgtacacgtctgtgtgtgtgcatgtgtacacatgtctgtgtgcatgtgtaaatgtgtgtgcacatgtacaaataaacacattgatcaacgtaatgtgtttgctacgtaactgatcccttcaatttcccctcctataaagaatctcaccaacctaacaagtaaacttttaatttgttgtcttataattttatatcctgacagttttgtgttccatcttaaaatgaaatagagttttttgtcatcttttttatccaaaacctgccctgcctcctttcttcctcctttttttctttctctacttaaaatgagaacagatgtaaccctggtcataattaaaagaattttcagagcttcagaggagtgcaacgagcacaggcttcgaggacaccagcacaggggggagcaattcctgtgtgacactgtcgtcctcatgccgttgcaggttgggtgtatgtttacacagggttttcccatccttgattaaattaggtccttgcaatagtcctcagaggtgggaagagcaagcattttatcccagtgtcacagaagaggaaactgaggccaaaagttgagagagattgcccatgattactggagctaaaattgggcccaagtgttctcattcccaagcctgtattcttggttctctccaccatctcgaacacaggcgtccctgttccctgcagccctgacctgcttctcttgtctctttcttccactgtcacacaaattccagagggcaatttgagcatagccgctcttttaaatgtcatttggctctttgtggaatcctggcaggagttagtggagagcagggaggggggtcagcccagcctctaccagtgccctctcactgcctcaggagaataggacccagggcactggatagaacagttgggattaactgaagaacagatacgccttgcacgtatgcccttgatatttgagcattcacctccaagtttacattaaatgaactgagagaactggtagaactggatgtggtctcagcattccatacgcatttcacttaaagtagcccagttagttgttaattaattggtttgtttacccatccaacgaaccatccaaccatcatccattcattcttcttcatatcctttcttccttttatttgtccttcttttgttcatatttctcttttttcttccttttgtccatcaattctttttttaatccatctttccttccttccttccttctcttcctttctttcttttttccttccttctttccatccatccttttctttccacccatccatctatccatcatcccttctttcagccagcctgctattgaggctgacagtgatttgcctcaagaacaagtgttttaggtttggagagccctgggttaatgtacaggacccaccacttacttgttctgggaccctgagtggatttacctgtccaaatctgttcagctatgaaatgtatctaaggtagcactgacctcgtgaggggttgtcaggagtaaatgaatgaacgcagcaaagccccttgcattgggagtggctcatgatgccgatgcagttatgttccacttgctgggttagacatgtccctttgtggatggtaatctcctcagaaacacacagaaatagctgtgatactctgccctgtattacaggtgaggaaactggctcagacaggtcatgtaacttgtccaagttccacagctgtggggtgaatttcccatcattgtcccatactcttacttttgtgttttgtcctgtcaacacgtgatggcttttgtcttgagccaaactctcaaatgaaggtgaccacaggcacagccccccatggcctcgggtgatctggctccccagcaactgactgcattttctctccttgtctctcgcagccggccaagctcgctgaggccttcaagtacttcgtgcagggcatgggatacagtgagtatggcattccccgtgtgcagtgggtcggggcatgtgtcggaattggaagtgctctgtcctgagccaggtttggatgagcaattctgtgtccccctggccagcttcagctttctgggaggaaacagttaggtgtgtggagggcatgtggcagcctggaggatctagcctctcatttatcagtgaggctcatttttcctcctttgttgaacagaagttgtttcacaccagggattttggggggtttagatgaggactgtccctttaagcaccaagacaatgaccaacagtgaaacaataacatttttaaaaattttgatcacaagttttaagagaccactagctacagtgatgatgaagatggtgtcgatgatgatgaaagattactaacacattattttatctcactgaaccatcacagtactcctttgacatattcttagcccatcttatcagtgatgaagctgaggcttcggggttgtaagcagggagcagagggcggatctgtggaaattctttgaagactgtgaagctctgtggaagtggctaacaaagttgcttacattcaaggtggagcatgccatagtcaagtcatgagctttgggaagtggaggatacattggaagcatcattcaggaactcactcgttcttattttgcagttatagtttgttagacacatacagccttttttccagaagtgctgtcccaggactaggacagaccctggcgagttgtaactcggctgaacagcagccacactcagtgctgtgggcctgtcagccatggtccggccctgacatgactagtggctcttctgaccctactgcttggaactataattcgtgtgtcctcccttactaggaagttattgaacttctgatcccttttatcatttccttaaactgtttgcccatgtatagtaagagtatgcttggtaagctgactgcagtcctagcattggccttagccatgattagctctagcaaggcgaggctggcaggtttgatttccatgcctcaggctcaggcaggatccacatccccaggtgccctcttccaacagaagctatctgctagtggggctcctgcctttctagcctgctttccccgacggaagttgcaggcaaaggttgtcattggagacagccatggagacagccgcggggcagtcctgctttaccctgcacggtgtgaattgtggctcccatttgtcttggtcccgccagggtttggatttctgctttgagagtgtgttctggagagaaaggaagtgaatgctagacctcatctttctccccaaatcggcttctattaccagaaagctgaagcctcctgcaggtcttggggggaaaataacaggaagagctatggtctcaaaggcatcagccaaagagaaggaaaggaaccggtcactggccttctgcacaccacggggtgctggcttgatgaaccctttgcacacctggcatcagtgctcactgtacgcttctcatcctgctcagtagacatcccagatttgtgggtgagaactaggggctcagagaaatatgtgagctgcggatgtggcattgaccccaattctttctgaattcaaaactagctctttaagacaattcagcaaggattaattctgtttgggagtgcctgacatcaaaagcccctccctgtgcctatcaaggagataacataagccctgcatgcttggtgtggatcaactgcccctgtttctgatgtctgactcagtgtggcctcctagccatgatgcttcagttgggtggagtactagtttcctaaagctgccgtaacaaatctccacaaactgggtggctgaaaacaatagaaatccattctctcaaagttcaggaggcctaaagtccaaaatcaaggtgtgggcagggccttgctccctccaacgctgctgtggaagaaccttccatgcctcttcctggcttctggtggccccagcaatccttggctttatgtggcttgtggctgcatcactccaatctcagcctctgtctttgcgtggacttctcccctgcatatccctgtgtgctgtttctataaggacatcacagtcattgggtttagggttccctctcaacccaggatgatttcatctcaagatccttaactaattacatatgcaaagaccctatttccaaataaggttcccttctgaagtttcaggtaggtgtgaatcttccgggacactgtcccacccggtacaggtgggcaggattgttcctcctcattccaccccatcagcacgtgctaccccatcagcatgtgccacttgcacgtgccatgtgcaagagcatttgaggtctcagagaagatcccaaagaatagacagcgcccttgttagcacctgggctgacaggcttctttgggagagatgacaacgaatagccatgccgggaacttgccgtgtggcccctctccctttccccacctgtgatgtgcagggccactgaccccaggtgtcctccctgctccagtgatcatggacagcatggggtcatgggcgtacacacaggtgctgataccaggggtcagtatttaacatacttgctttacagatgggaacagggaggctcagggggacactctcaaaattacacagcttttaacaggtggcagaattggggttcagacccagatctgggttcaagtcactcatggtgtgattgcggcagttccttcccgcatctgggccttgccatctctctctccgagtggacatggagaggacgggggcccagcagctggatggctgcagggatcaagtcttctctggggctggcacgtagaagagcatgtggctggtggacgggcatgcctggctcctcacctggcagtctcctgccctctaaccggctgtctcttgttcccctagtgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcgacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcagcggcttgtgtcttttttctgtccctgagagattgtgtgtgtgaaacattgcagtgcagggatggctgtttcactggggggttgcccgtccttgacacctaggggaccccagcccctcatctctggaattctttcctcggagcatcacgtccagcagaaatttaagtcagctcatatgttaattctaatttcccagtggccacattttcaaaagtggaaagaaacagatgaaattaattttaataatacatttcatttatctcaagacgtctaaaatattaccacttctataaaaactattgaccaggtattttgcattcttttttcattctaggaactctagtgtgtttcacactcgcaatgcattcagaccagctgcatttcaattgcccagtagcttgggcagcacaatgatgaggataaaaaactttccaacctataattcgaggaaaacagcttttttatttttaatatttatttttattttttgaaacgtagtctcactttgtcacccaggctcaagtgcagtggcacaatcttcgctaattgcaacctccgcctcccaggttcaagcagttctcgtgccttagcctgctgagtagctgggattacaggcatgcgccaccatgcccagataatttatttttatttttatttttagtagagatggggtttttgccatggccaggctggtctcgaactcctgacctcaagtgatccgtccacctaggcctcccagagtgctgggattacaggcatgagtcaccgtacccaggctacattttgtttggattacaaacaaatgtatgtggaaagatcattccttttctcatgcccagtgacaaccattgtaatgcttgttttctactctacattaaaaaaaagagattttagtgtaacctcttatttaaactaagattagtttaaaatatacagacagttgcaaacaatacagagagttgccatatagcctgtacttagtgacccctgtcactaatatctgacgttactgcatacttgtcacaaccgggagatcagttggacgttgctgttaactaagccctggaccatattgagaattcactggggttcccctaatgtcctctctctgtccaggatcccatctgggacaccccattacattttgtcatcatgtctcagcttcctctggtttgtaacagtttctcagattttattttatttatttatttatttatttatttttacttgagatggagtcttgctctgtcgcccaggctggagtgcagtggtgtgatctcggctcactgcaacctctgcctcccaggttcaagcaattctcctacctcaccctcccaagtaactgggattacaggcgcaggctgccacgcccagctaatttttttgtattttagtagagacgggttttcactgtgttgtccaggctggtctccaacttctgagctcaggtaatccacccgccttggcctcccaaagtgcttggattacaggtgtgagccaccgcgaccggccagattttcccttttcttcaacagcgttgagaagcactagtcagacattctgtcacaagtctccccactgaggtttgtaagtagtttttctcacagtacaacttggggctgtgggtttttcggggaaacccacagaggtgatttgtcctgcttctcacatcatatccaggccacacgctatcactgtggtttatcactgatgggattaatggtgatggcgtggctggggtagtgtttgccagatttctctatcgtcaggttaccctttccacttttccatattcattctttggaagtgtgaacccccaaaatttgagacaggtctctgttaatttagaaagtttattttgccaaggctgaggacaggcgcctgtgacagcctcaggaggtcctgacgacctgtgcccaaggtgatcggggcacagtttggttgtatacattttagggagacatgagaccgcaatccatacatgtaagaaccatacagcc

SEQ ID NO: 15782 - DNA, 6635 bp, Human
ccctgcctaaaatatgtgtgactgtgtgtgtggacccattccagcaggtaccactctcagtggttttaaggtggcaagatgtagtgggggaggtggaggtgtcaatgcataggtctcagaacagagtctataatatcattgttcacattggagccacgcatttgctgcttatggagtatttggccatcctttacttcctggccctacccatttctcagagattaaaaaaaactttttaagataatcttgctgtgttgcccaggctggcctcaaatttctgggttcaagcaggcctcctgccttggcctcccaagtagctgggactataggcacatgccaccatgcctggcccatttctaaattgcttgtttgtttgttattacaaatgcctagccctcagggtatgaacatggactggagaagaagaaaccagagttgctgctatgtccaccagcctctctgcatgtcctggcctcagcccccctgggctctggtactgacccatctctggccaccatgctcctccataagcctctgcagagctaatctgaccctgttgatgttctcatgagagagtgatctgcatgccccctgcacccctccgtgataatacagcagaccaagagctctcccacccttccctgcctggatgctgggcacgtccccagctgggctgcctatttaacgcaccacactctcattctcccaaggtggggctccaggactaggctggggcagcagaaagtccccctctctacattgtccttggctcaggagccaacttagaaaaagcatttccaaattggctaagccagcggagcagagattttctgtgctgagaaatatcaggacatccagaggggtggaaggaggcttccagggcacacatgagatgtggcaggggtaggctgtccgttttaaagcttaaagctttagacatgaactcacagggatttcagtcagggtcatctgccatgtggcccagcagggcccatcctgaggaaatgaccggtatagtcaggagctggctgaagagctgccctcactccacaccttccagcagcccaggtgccgccatcacggggctcccactggcatctctgcagctgcacttcccccaatgctgaggagcagagctgatctagcaccctgtccattgccaaggcacagcaaacctctcttgttcccataggttacacaactgggataaatgacccgggatgaagaaaccaccggcatccaggaacttgtcttagaccagtttgtaggggaaatgacctgcagggactttccccagggaccacatccagcttttcttccctcccaagagaccagcaaggctcactataaatagcagccacctctccctggcagacagggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagaggtaagcagggtcgggcctggtagtacttggatgggagaacacctgggaataccaggtgctaaaggctttaagaataaaaaataatgatcctgctttgtgtttatcccatgttgagttctgtgcggggcagagggaacacacggtaaatgcgttatggggaattataggctacttgagggagtgacagtctggtggtaactcctgccttcctccatcagtgccacattggcatcctcttatgcagtcaggcttcagggctgatgggttcagaaccgagggcttctggctctgagtgaggtcctgctgcaaggtttcctagatgagccactgagactctaataagatccagtggaaataaccaggctctcgtcggaatataagtcccaagggaagctgtgccagtcttgtgggcgactgcctgacttctcctttcatttcagcaccatgaagcttctcacgggcctggttttctgctccttggtcctgagtgtcagcagccgaagcttcttttcgttccttggcgaggcttttgatggtaaggcttcagaaggtttgcaggatttctgaagagaaacatcgccctggacctgataaactggggaaaatgatgctttcggaaggctgcttttgaaccacagagttgctagtgtctgcgttgctgaggcctgccaggaactagggtttgctgggttgcctgtctcgagtctttcagagctgctgggaatatcccctttccccgtagtgcagcttctcaggatgtgttaagtggatggatcacatttcagaagccgctgcaaggtgtatcaaaaacacatctcctgagccgtaagggacggggcatccagtaacaacgcacacggggtatttttgggcttccttaagatttgagccgctgccttaggttgtgctgcccaatgtgcctggggagctgctaaacagattagagagtcgaggattgttgtcagttactcagagaaagaacaatcatcctttccaggagcacctgagctgtttgttttgagtagaagatgcaaaataaggcctgcaattggtataaaatgtccctcagcataaatcgcataggagtatgactaaggctgttgactcttctgtcttctttctccttcctccttcgatttcctagttggataatgtacagggctctttagcctcgctctgtcaggggctcccttcctggtttgttctgtttccattcttccttctccagccttcttgacaagagctgggaactaacgtgcctcaagcccccacaaggaccacagcattttctcatctagtttcagaatgactctgtgaggcaggcatcccttctgtgaaggtgagaaagctgagacttagagcagctgaggccaatgcccagggacttactgccagtcagcaggtggcagggcagaggtttgagcccggctgtgcttgaggtcagagctcttgccaggtagacgcatcactgaccacctcccagaggttgatggttatgaatctcagacacaccttggcatcacctgaactacccatgccttcaactccccagcagagtctgcagaaactggcctggggtgtggcctgggcactgggactttcagtttctctctgggtgattagaaagtgcagccaaggctcacgcctgtaattccagcactttgggaggccaaggtggatgaatcacttgaggtcatgagttccggagcagcctggccaacatggtgaaaccccgtctctactaaaaatatgaaaatgtagccaggcgtggtggcaggcacctgtaatcccagctactcaggaggctgaagcaggaaaatcacttgaacccgggaagcggaagttgtagtgagttacattgctccagtgtgctccagcctgggtgacagagtgagactccgtctaaaaaaataaaaaagaaaaagaaagtgcaaccacggcggagaaccgctgctctattgcttcctcaagcaacccacagtatcagtacagcctactgagaaagtgtttagggacttttatgctcctaacagtcactggaactcaggtcacaatgacatgtattccatttgcaagaatatatactttagtagtcagggcagaagtactctgtgtctgccacctttctcagcatcagtattccatgtcaccacctcattcatatacactcctggatcttatcataggcagcttcattctatagcagtggctcttcaccagggcacttgaagaagccaactaggataaaggaatgtgcttctcaacccatggtatccaaggctgctatgatcacaggctgatagcttgaagtcagtggaagatttgtccttctttcattcccctctaaggtgttgttggagtctttatgttctcctgatgtcccttctgcctttcctttcctttccaggggctcgggacatgtggagagcctactctgacatgagagaagccaattacatcggctcagacaaatacttccatgctcgggggaactatgatgctgccaaaaggggacctgggggtgcctgggccgcagaagtgatcaggtaactggagctcctgggacgccagagctgggtgagcagagcttgcctgccttggacagtcaggagggagacgagctccttgtagagaagttagaggctgcggcccctcctcttcttgccctctctctgcctctgtgctcagtgtgagggtctgagtggatggtaggagtgagtgattcctccccctccccctctgggtgctgttcatccagcctaggggtgcccagcctgtctgaatggggcagtgcccaggcagggtcagtgttttcactcctccttccttggcctttctgggctcctctctgagccctcccttggaacggggagaatgggagggtgagctgctgctcactggcctgatgattaatctccttcttgcctgcctggactacagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtggaatttgttgaaacagtgtgttcttcttttggtgctgactgcctgtttggtacaaaagggaaatcaatgcacacccacatgaagggtgagcctaggtaggcctatgtgtttggatgtgaggagacattcttagtagtcacagtgcagacacctgcatcaacccttccacaaattagacctccttttttccagacctttgtggttacattgttgctatttccagtcccttccttgcccaggcttctcatctcctgtgaattatttcctgttaccttctctgtccctcagttcttcattcctcagtgatctctgtttctggaggcaggggctacagacaattgaattgtgaagtcctgcctcagcgactgccacccgagtcttcctttcatttctcagcaacacctacaaatccaggcattaatgaatttctacccactccatctaaaaaatacctccaatgcagttctcttccactctattttcattgccttctttcaagtctaaatatgtaatgcgactccttttatgaatgttttctgagtttctggagcttaactagatcaaagttgtggaagtggtggcagtggagagagagccagatagagaagaactgttttatcagtcagggtccctttgggagacagaaaccaggcagtaatttgaaaagggaaattttaatataaagaattattaactgagagcagcattaacttctaagagtacagaatatgagaaggtataaatttgagattgggcccctcacaagactgacattggatggcaaatagtttactgggtccttcaagccaaaactgacatataagaactccattgaggtattaatgaaacttggcaggaagctacccagggtgtaacttaactctgggaatgcagctagggttcctgtgacaaatttgggaaactgcttgggggcaggagataggttatcaaaacccctgggaagccagctgtggaagtggcagtgctctggagtgaactgtatcttgccaaaatgtatatgttgaaaccccaactcacagcatggctgtactattttgttacagcagcccaagctgattaaaataagtgggctgctggtaaacatcatggacatcctactgaggtgccacagaaattgtcaggaaactgtcttggccttgggatgccactcagatctctggggcaagtgccactggttgtcctgtacaggagaagagtactgcaggagctgaaaggaagcaaagcacaaaagaacaggaaaagatgtcttcatctcctgcttggccctctagcgccctctatgggtgaagattaacatcatgcccaactggcaaaggagaaatgttcacagggtccagctccagcatcacaaataggacaaaggggtgggtgtggagctgaaaataaagaaactgataactggcataccccttttctctgaaaaaggattgaggaggactcctaaggtgagaagactagttataaaattatatttacagagtaaagacaaatttatttgtcaaggaggaagaaaatgtatggatataaagtagaactatttacaacagaactttctcatacagttctcatcaaaagacactaatagaagtgtaggtataggaggtataggaggtttgagtctgagtctcaaagatgtgccaatgccaaaacaaggcaagggcaagataaataagatggagagaggggtggaagattggctcatgggagcagactcaatgcactgttgagattagtgttcagtctagtaaagtctgagttgaccccaagttgtaaaaaaagactgtaatgctattattacaatagcaattgtaaatgcttacaattagatttctgtcacaagtactg

SEQ ID NO: 15783 - DNA, 14189 bp, Human
  misc_feature (1)...(14189): n = A,T,C or G
cgtgagccactgcacccggcctggtattttcatttattaaatccggcatccttacccacaggcctgactcttgtcttttccctggagttgtattttcctggcctagcccagagcccaccatttacaaggtgctcagtaattgttctatatgaatgtactatctgcatgctgttttgtacgttttttactcatctgaaatttacatgtatttatcagaaattcccacactcactaaaaacacttgttaaagacaatttttgaaaatatattatattgccaaaacttctttgttttccgtttctgcaaaattggtatagtaggagtatctaccctcatcacattttgacaattagaagagttaatggaaaagtaaaagtaaagttttgcaccgtgcccggcccactaggacgctcaataaacttcagttctttattaaaggaagcctgtgcaccattttagcgtaaagcaaaaaaagcgcgtttgtaaagaacgggtgggggtagagaaaacggttagaaaggtctgtcgacccaacaccgagggcccgggaaaaagggaggagagaagggtgaatgacagaggagccagccaatggggagactgggaactacttcccccctccctttgcgtttcaaattctaagctccgtttccatccgggtccttcagcctcgttcccgggcagtataaagtttgctgtctcctttgttcgccctcgttgcgcagtagtgctagcggcttcgcggttcggtcctcgcacccggcagccgccactggtgctgagctgctaggaagcccctatcgccgagctcgttggagcttgaacccattgtcacccctccggtacgtgtctcctttcctcagtccgtttttcgtgacactctccccgtgttaggactggggattatatctccctggagatgggggtggcgggcgccattttaagaacccaaaggttccgacctatttaaataaagctgagggggtcgagggaaaacaaatgagggggcccgtttggttgtatgcttctcgagaaagtttggctgccatctgcgggagttggtagcggaggtcggggctttgtaggctggagcggggcgaggagcgaccgcaccacggcgatacctgcattggtatggcgctggcgctaatgatgggcatgtggacttccatgcgggctgcgggcttcgtattcattggcggccccggagaagaagccctctgaatgttcccagccaatgttggtggtaaaagttagtcccctgaccagtgtcggtggttctgggttgaatccaagtgtcgccattttgtcttttacacgcggtttttaatgacgagttttaattaggttccgctgcagtcacggagtgtcgagtgttagtgtgtgcgtccgcgttccgttacttaatagcaaacgatgttgacgatttgtttttatctttttggccggatagtagaattttcggtagggcgggggccggtgaagaagaggggcggcataacttggcttaaacttcacatttctccttggatttagtagggaatcctaatgaggaaaagaggagtcgttggaagagggcttggtgttaaggtcctgtgtctagcctgtgaccttgggagtcttttaaaaccatcgttaggaagggtgtgatgagtaattgaatctttcaaaggcaagaggactggaactaaaagttgctttttcaaatgttaagcagctgttgcttaagaacagctaagggtgatcaagggtagtggtaaaagttaagttggcccttttaaccagttttatgtaaattgcagtgttactaaactacttagttcaaattgcttcctactgtggctgaggcttagctcgttatcgttttctttagttattaaggaacaatggttttagtggaaaatatgagaaatgtgcgaaagtaaaagtgtccaataaacttgaggaactttttgcagtgaggtaatactattccttttcaacagactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaaggtgagttgtctggcagtacaggctgggctattataattaaaatataagctatgatgaatttgattgcattgatcgtctgacatgataatgtatttttgtcctctaagaagttctgagctttctgtttacacatttactttggttatttcatttgacctagggtaacactttatttttctgaaaactactttttagtactcttgatgaaagaccgtgaaaccaacaaatcaagaggatttgcttttgtcacctttgaaagcccagcagacgctaaggatgcagccagagacatgaatggaaaggtgagattgtctacacgatggatgataacctgttactagtgcataaaataacatgtagttgtccaagtctggtctaggacagcttttgagttttcgttgtttttcagtatatacctgtctgggatccactcatcctgtttgtgatcctgttccaaagagtattctgtaattgcagaaccaaatctagtagtgagttatatcttatgctcgtaacattctctcagttcagaataattatggcattacatggtacttttttttttttttttttgatagtctccctccgttgcctagcctggagtgcaatggtgcagtgcccactgagcctgtctcccgagttctaagcgatttttctgcctcagcccccccccccccccccagtagctgggattacaggcatgcgcgaccacgcccggctaactttgtatttttagtagagacagggtttcaccatgttggccaggctggtctcaaactcctgacttcaggtgatccagctgcctccgcctcccaaagtactgggattacaggtgtgagacactgcgagccactgcgcccagccaacatgatacattttatcttgagatccataagccatattttgataacttggcttttggttttggctactagttttgataacaagctgatacctacttggccttgttttaaattttaccatacaataatgcagtgggttcaccttatgtttcaatccagatcatcagtatcggttttaagtattaagaattttaagcggaaaagccccatttatgtaaactgactatatttgcagtgttttttcttagactaatgagcaacacttacccataactgcattttgaaggaccagttagtgtcttagtgcatagtagatgtgcaaattatttttaaatcttgatttaatttaatcgtatctttttttttagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatgggtaataacttgcgtggacctcgggtttggtgtataagttagggactgcaagctcacaccaagtggatgctttggttaagtccttgaggaaaggtgccaacttttgaaattgacaacacttgttcatctaccaaagtgattgccaattgaaagcatgggaagcatgttttagattatggtgttaaaccgtggacagtgttacttcttgtccaagtagttcactctgtaggaaaggcatttaaaaattgataggccagggtgttggacatgaaaatgaaatcatttttattttttaaagttagctgggcgtggtggcaggtgcctgtaatcccagctactacggaggctgaggcagaagaatcacttgaacttgggaggcagaggttgcagtgagttgagatcgtgccactgtactccagcctgggggaacagcgagactccctctcaaaaaaaaaaaaaaaagttttttaagactaccttcagttcttatttccccagtttctatgactgcagtgcatgctccatcaagtacaagtgaaactagactacccaaatcaataatggtttttttttgggggggggggnnnnnnnnnnnnnnnnnnnncatcaggcgattgtcctgcctcagcctctcaagtagctgggattacgggcatgcaccaccacacctggatttttgtatttttagtagagacaggattttaccgtgttagactggtcttgaactcctgacctcaggtgcccgaccgcactgtctttacgagtagctgggattacacgcgtgagccattgtgcccggcccaataatggtcatattcttgatgaagcaaagaaaacttttatagtggccgagcctggtggctcacacctgcaatcccagcactttgggaggctgaggcaggcggatcacaaggtcaggagttcgagaccagcctggccagcatggtgaaatcctgtctctacttaaaaaaaaccaccaaaaattagctgggtgtggtggcgcacacctgtaatcccagctactcgggaggctgaggcaggagaattgcttgaacccaggaggcagaggttgcagtgagccgagatgaagccactgcactccagcctgggcgacagtgagactctcaaaaaaaaaaaaaaacttttatatctttcttgattcttgtgagtagtaatatttttcttttctatttttgatgcagatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagaggtaaatgttccatgtatgatgatttatgctactaccgtaacacaaagaattgagaggtgaatgatgcttaaaattttaattggccaggcgtggtggctcacgcccgtaatcctagcactttgggaggccgcggcagacggatcacggtgtcaagagatcaagaccatcctggccaatgtggtgaaaccccgtctctactaaaaaatacaaaaattagctgagtgtagggcgggttcctgtaatccccgctacttgggaggccgaggcaggagaattgtttgaacctgggaggcagaggttgcagggaaccgagatcatgccactgtcctccagcgtggcaacagagtgagattctgtctccaaaaaaaaaaaaaaaacaaaaaaaaaaaactttattcatggagtctgggtgcggtggctcacgcctgtaatcttgacactttgggaggctgaggtgggcagatcatgaggcccggagttcgaggccagtctggccaacgtggtgaaaccctgtctctactaaagatacaaaagttagctgggcgtggtggtgggcacctgtaatcccagctactcgggaggctgaggcaggagaatcacttgaacccagaaggcagaggttgcagtgagccaagattgcgcgactgcactccagcctgggtgacagagcgagactcccatctcaaaaaaaaaaaacaaaacttttagtcatgtgttctaggtgattagataaatggaattagcactgaaaaaaatttaaaatatgaatgggaaattgtagaaaataaaattaggtgatctagcctccgtaatgtcatctttgaagtcagtctcattatttttcatagcctgaatgtaagttcacgttttaacttttttctctggctatgtttaaaaaaatgatatttttccttaagctcctgtatcacgtggaagagatagttatggaggtccacctcgaagggaaccgctgccctctcgtagagatgtttatttgtccccaagagatgatgggtattctactaaagacaggtaatagaaaagtgcagctttttaaattaataattaaggttgaaggaaagcttatcaaaagcataaaccaaaacttttgctttgtagctattcaagcagagattacccaagttctcgtgatactagagattatgcaccaccaccacgagattatacttaccgtgattatggtcattccagttcacgtgatgactatccatcaagaggatataggtaagtgactttgcttctgtggcttacatgtaagaaaagttgcaatgaaagttgattctctgggacttaaaggtttctctttaatttagcgatagagatggatatggtcgtgatcgtgactattcagatcatccaagtggaggttcctacagagattcatatgagagttatggtaagatactggttaagggtctttagtatcaccagcttgagtttttaggttcgtgagccagtttattaggctgtgtggtgcttgcttttaaagggatgtttgcttgcttttaaaggggtaactttatcagctgggcttttcctagttttgtgaggggctttttttgtttttctaagtttcttttgaggctgtttgcttgctttggaggggattttgcttgcttaaattggcagccttatgtgttttcccccaacagtgaaaatacaatttaaaaattttattaacaagatcaaatatttaccattgcaatatgaaggcaagttctacagttcaaaattgcaacttatcactggaaagtggctgagtgtctactataaaataacaagctctctggaatatcctcttgaaatacacaccgtcttcagtcttttcaaacaaacattaaaatgaatccaattccatatctcagcagatgagcaaatccctgttatggccagcaatggcagagtttaaaacctcccacccagttgagaaagtaaacttttaatacaagaattctgtaaattcagatttaaaatgttgtatatatacaatttatagtgttgccatattacctgaccattgaccctgcaggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaaccatgaagctgcaaaggtgcttgctcttactgtttcaaatttttgcaactctgtagtgtctcacttttaaaggaacagcttgattgcaaaggagaaaatagataagcaatgaagttatctccaacttcctaaaggcttatgacttctaaaaagtgaatctatcagcattccacatcagatttaaagcatcaaatgcctgtgaaacagcaaagatggtaagcaaagcaaactagtttttccgtctaagtcgaaattgaacacttaccttcctcatagtacagtgaaacatactgtacctcaaggcaatggaaatgccttctagattaaaaaaaacttttggaaaaaagaaatattcaatagcgtattagaagtcctccaaattcaacacttggattttttttttttttttttaaagcatgtgtgacacttaaaggctttattaatagagctgttgtttaccaatggcgatctggggcttgggagggggtatttttttcaaagtccatttttgatgaagacctttaaacatgcttcgtatgtttttaacatttttttcaaattagtcttttagtcaatataggaaatggcttaagtttggggtccccctttttacccctgtaagccattgcaaacttgacatttagttggatgcctgacttgtttttagttctatgaaactacactgtatggagaaaatctattgcaagtggtctttaaaaagcaaaacctgaggcagcatgacccaggtccagccatgaagttgaaaaagatgctcttgaatatagtaaacttgaagacctccaactaaaaatccttatactgcacttattccttcaaataagttttgttcgttcaacttatggatttaacgtggcagtgcaccattggaacagaatgacaatccataagccatgcaacttaacaatttaagccattccagtccatcccgagccagtgaatcttccaccacttaagacaaatagtagaacatgaaatatattaagctgcaagtctgaacttgccttttctttctggaaaagagggcagtaataggcaagttttaaaagaatttccttaagagagataactagttttcatttatttaacttttgcaggttggtgattttgctcattatggtcgtggagtgctgattgattcacagtagataaagctggcagtaagaaatgctaaggtaagtgttgaaagcaatggcctttgaaggtttaaatgttgtgtaactaccatttagtttagctgtgacattggcaagttattgtggtcctcacttcatctgtaaaagaaaacgctgcttggaattgatgaagttaagtgctttaatgtgtagtgcctgacacattcattgtgaatttagagtgaggttacatttccgtgagtctggctcattcatgagattattcttagctatttttgaacccataaagcttgcttatagctcttcatatgcaagcattctcaacaaggaagtacacacgtaagaagtttgctcagctgggcaccatggctcgtgcctttaatcccaggactttgggaggccaaggcgggcagaccatgaggtcaggagttcgagaccagtctggcaaacatggtgaaacctcatctgtactagaaaaaaaaaaaaaaaaaaaaacaccgggcgtggtggtgtgcgcctgtaatcccagctactggggaggctgaggcagaattgcttgaacccaggaggcagaggttgcagtgagccgagatcacgccattgcactccagcctgggcaacagcaagaccctgtctcaagaagaggaaaaaaaaaatttgctcagtgcattttgtaaaaggatatactttcgttgttactagttagtgcttgctcatttgcatagctacaatacaaattgactaaatgtggagttaatgatgcaactgtggctgcaagctccctgtttaacataattgtattgacattgacataatgacgacatagtatgtaatttcaatattacctttttttttttttttttgagacggagtcttgctctgttgcccaggctggagtgcagtggcgcgatctcggctcactgcaagctctgcctcccgggttcacgccattctcctgtgcctcagcctcccccagtagctgggactacaggtgcacactgccacgcccggctgattttttgtatttttagtagagatggggttttactgtgttaggatggtctcgatctcctgaccttgtgatctgcctgcctcgcctcccaaagtgctgggattataggcatgagccaccgcacctggccgcctatggttgattttttaagcttgcgtggttttttttttttcttctcttctgagacagttttgcacttgttgcccaggctagagtgcaatggtgtgatctcagctcactgcaacctctgcttcccaggttcaagtgattttcctgcctcagctttccaagtagctgggattacaggtgcctgccactatgtcggttattattattattattatttgtatttttagtagacagggtttcactgttggccaggctggtcttgaacccctaacctcaggtgatccgcccgcctcgacctcccaatgtgctgagattatagacgtgagccactgcatgcggctttctttttttttctttttttctttttctttttttttttttgagatggcttctcaactcactgcctctcaggttcaagcgattctcctgcctcagactccccaagtagctgggactacgggtgtgcaccaccgtgcccggctaatctttgtactttttgtagagacagggtttcactgtgttggccaggctggtctcaaactcctgaccttgagtgatctgcctgtctcggcctcccagtgttgggattacaagcgtgagccactgcgcctgcttgctttttaaagcagttacttttattttcagctaaagcaacaaaaaagtatatatttaaatgatagtttggggggaagtactttacagtaaaacaaatactatgtaacaggatcccatgtttttcattttacagagttgttgaagcagaaggcggctgattgtcaataagtcactacagttgcataagcagtgctgtcagaattggtttggtgcaggcaatagattttgccttcaggggttcctgtggatctgaggaaggcatcagtgttgattaacactcataactagggagtgactggtagttacttaaagcaagtaattgaccaaatggaaaaggggaagtaattaaggaaattggtaagtggaggtagtcaggaagttcttgtggttcttcacatagattttacagctttggctttcattttgtttagctaaagtcatggggacaactcttcaatttagaacttaagttgaattataaaaatgatggatataagtggtagctgtatctagtgaagtgtctgtcagtaagtgaaacattttttggtggtggcttatccacaaacagtttagttgtagaataaaacttatgagtgacatctggaaagtaaccatgctaagatggcaagcacactggaaacaattaggccacttggctttcttttgctgtattgttttataagcctactttacctcccagtcttggaaacaagttttagttttttattggtttggagactagagccaatagtataatgttctcaaaggaaacagacttgagttgttggattagaggaactaacccaacttatatgattttttttttgtttttgtcgtgtagttatggcactgtcttatttggaacatttgcaactagggataatacaacatttttaactctcatttgacaacctactactaatcacagaccacaagggtaatgaccaaatttatgtggtttttgcactccatagttgtcttagcccaatctttctatactcttacgattacttgggttaacgcttctgtgaggaccttctggctcttgagataccctaaatatttaagatatttagatatcttgaagatagtataggatatagagattgtaccaaataggaatataaggagtatgttaaaatgaccagatacctgtttgatagtttactgacctagcagatgtgtggaaaaggaatcagatcttgattcttctgggtttatactggttgtaaaacagaatgatacagaaaatgttttccttgtttaactggtagttgaacatagaacttgggtattatagatcacttttcactttttggaatgttttgtattgaaacttaataaaactttaacatggcatctttttttgtggcaaggggctcttctttacttagaaattaggggtttatgtttttaaatgtttttcccatgtccccctcccccaaacactacctctgttgcattgatggcacttaatcagttttgcatgggaatgtccagagtcattgaggctgtttttgtgactaggcctcctttattgagagtgagcttcagggggaatgtagatgacttcattcagtcctcaccctaaaagttaaatggaagcacaatcacacacctaagaagcagaggctaaataaaccaggagtcaactgtagtgcttttatgtaattcctgcttacctcttggggaaaaacaggtcagcaacaactcagttgtggctgtggattccaaatactttgggtcaagcaatgcatgtgataatatgcttctgaatttgcagttttcagtttctctgctttacctagtgtcctgtatatatctgactagttgatgttcgtttgtgtctaaaactgggcattgcatttgggttatgtagtcagttgaacagaactcagcacatggagaaagaatgcagctaagcattaagatggcagagaaagccctaagtattgtcattctgtaaataatctcagctctacacctgtttttttgggggggtttattaatgagatggagtctcaccatgtcccccaggctggagtgcagtggcaccatctcggatcgctgcaacctccgcctcccgggttcaaacgattgtcctacctcagcctcccaagtagctgggattacgggcgtgcgccaccacacccagctaatttttgtgttttagtagagatggggttgtcatcatgttggccagcctggtcttgaacctcctgaactcaagtgatctgcccaccttggcctcccaaagtgctgggattacaggtgtgagctacaacgcgcagccagttctatacctattgttccaggaaaacatctctctactcatcccgtcaatactttatgttgcacatgtcagtatacttcctgaaaagtaacttgaacttttgtatcaattagttcaactttaatcaatttttaagataacatttaaatctgaaatactcaagtattaagggtactgttttatgaactgagaaatgtatactctatcaatgatggataattaccatcatctcaaagtacttgagttttagccgtgtatacatcagtagttccatgttgccgagtatggtatgctttcccattcatggaaacctgggccttttctggtttttggctttcatgcataaagttgctataaatgttctcacagtagcttttgtttttgtaattactgagatgaaaacgggtgtggaattgctgaatcaggatagatgtacattttttgagagatggctaggcattttttccaaagtaatactgtggaaacacttagccaatgatgtgtgagttattccatgccttgtcagtatctggtgttaacagtttagcccttatggtgaatttgtggcttatcctctcagcaatgagtagtacttgaaaaaaagtatggtgaaatgcactgatctcatgtacagtttgatcagtcttgagaaacgcttagcacatcaagacacagaacttagctccggaaagttgtgtgtgccccttctcagtcaatagaccacctcccaacaccagcaacaaacactgacctgatttccatcataagatattttttgcaaattttgattatgtaaattctgttgatgtagtttatgtctagctgcttacagaatgttttcagattcatccacatagttgcatgtatattccttttattgcagagtagagttgcagtgcatgaagtaactattgatggacatctgggctagttccaatttttggctattacaaatactgctatgagtattcttgtacgagtcttggacgtaacagtttatttttggtaaatgtcgagtggaattcatgaagtgacagggtagataatacagtaaatcttaacattgt

SEQ ID NO: 15784 - DNA, 69709 bp, Human
  misc_feature (1)...(69709): n = A,T,C or G
ggtgtgagccactgcacacagcctgtttttctaatatgatcattcttcctattggcttatacctaatagaaggatttaaccttataaaccttaaagttctaagaccagaagctaggtgtattagtccgttttcacactgctataaagaactaactgtgactgggtaatttataaataaaagaggtttaattgacttacagttccacatggctagggaggcttcaggaaacttaacaatcatggcagaaggggaagcaaggcacgtcttacatagtggcaggagagagacagagagagagacaaagagagacaggtgcggggagggaatgccggtggaactgccaaacacttttaaaccatcagctcttatgagaactcactatcacgagaacaacatgggagaaactgcccccatgatccagtcacctcccaccaggtccctccctcagaatgtaggaattacaatcaagatgaaatttgggtggggacatagaaccaaaccatatcactaggcttataagattcatttgtgtgtgtgtgtgtgagtaggcagcataaatactatctagactacaggaacatagcagaaaatacaatcctgtaaagttgctgtggcaacatcagctgcttatgttgcaataaatataatggcaataatttttgaaactttattttttattagagaccaggatacaactgaatctctggaaagataatgagtctaccagtttgtgctatttttctcttatccccttagttattgacctatttggaggattcttcaactgcagaagttgcaccatgtagccagtaataatatttatttttccagatgcttggggtagagtatgggaatttttcttttttaatccacataatgaggtatttataaggaagtgtatagagtccagcccactcagcagacaacccaggattcaaacattgctggaacttctagtcaaacctcattttctcttccatttgtttccctaaaatagtgccttgagcccagaaaacaagttaatttcctagcccacttgtcacatttccataattccatggcttctttgttattcccagaggtatcctcataccccttgtgtattctcctaagtgaatgaacccattttttcctctcccaagttccaggcattcagatgaacccattatattggtggttggaagacccagcgtctgtccaccctttctgttcatgatcgaatgtgtgcatgtccagtgtgttactgttaagttgagacatgtaactggcagtagtgggaatgcagacaacgaacaacaatatctggttccaacctgggctagagctaaaggcgtcatgggttggaggttcacttctgtcaccaagccctaccagaagcaagggagatttgacctatggggctccctttggcccgggccttaccagtagtggcactcagctacaacatacacctatcagttttttttctctgattcttttcagtccagtctcttgtatgcttgaatctcctgtctgtttggtagtctggctttgcaggaatgtagcagcagttttgaatgaattggttactttaagttttagaaatgtaagtccttgaagatcttgaaaatgattttggtgatgagctgccacagctggttgttcaagcaatggcctgggaaatgcagaaccatgaataccatgcctgttagacctggaacaggcaatggcaccctcattgagaaaatgtgattttgactaagaagcagtatttctggaaaattttttcactggctctcttctattgttgttacctgcaatttcatcatcttttcatttaattatgttcagtatgatgtctttgggaccagtgggtatttttatttgcttgtagaagtgtttgtttttaaggctatgcaatggctcaggaaggccagccccacccactctcttgttgcttggcaccaatcctccctggttgttgggcatcttgtttacttctgcccttaattccctgcaggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggtgaggggtgggaggtgaggaggagactcaaagacaagtggcacaggtgtgggcgggcctctgatcacttttctgcattttgtcctcagtgatctgaccagggagtgagatgctgactggagtcttgtagtgaaacagtagcagccttggaaaagacattatagtgccagaaaagtgctcccaaccaagggcatggctgtggtctcctctttcttctggcagtttttttttccctttcacttgggcctttgggttggatttaaaaaaaaacaaaaaaacttttagcttggggttggtctgaacaaaagaacattaggagtttaatgaatcacagtcaaggtagccaagtaaacttttagccctcgggctgctctgctcctctttcaatgtaaattctaaatacttccataattattactaagtacagcttccttccgcaagaatgtaaaagtcagagtgacagtcttctgagtcgttgatttcctcttcctttttaaaatttttatttaaattttatgatttctaaagatgagggtctcactgtgttgcccaggctgatctcaaactcctaggctcaagcgatcctcctgcctcagcctcccaaagtgctgggattacaggcatgagccactgtgccagcctgatttcctcttcctttaagaagggaagtcaaaaatgtacttagcatgataaatcagcataccttagtaatttttatgaaattatcccctttatatatttttagtttagcttcatcaaaatcaaacacctttttaacatattttcccaccctatttatttatttattattattattattttttttttttttttgagacagagtctcgagctgtggcccaggctggagggcagtggtgtgatcttggctcactgcaacctccgcctcctgggttcaagcgctactcgtgcctccgaatagctgtgattataggtgcgggctaccacacctggctaatttttgtttttttagtagagatggggttttgctgtgttagccaggatcgtctcaaactcctgacctcatgtgatccgcctgcctcggcctcccaaagtgctgggattacaggcgtgagccaccacacccagcccaccctatttctttattaatttacttctatcttgctaaatccacttgtcaggtttttttccttatcttattcagtcttcagcagcatttgacatagttgattactccttaaagcatcttctctctgtctcttgaccacaccctcttctgaagatcctcatccttcactaggtgctcccctcatcccttctggggcccctcttcctcttcttacctgatcatcgatatgctgttttcacccagtttaccctcactgttagatgtctggtcctcacacgccccaaacagaacctttggttgttcctactctccactccacatctgttcctctccaggcgttccccatatcagttaatcgaactactgtccatctggttgctcaagtcccagtatagaagtaatcctgatttccttgttttgccctctccctccacattcccctgccaccctcccggtggcaggtcatgtcagttcacctctgaaatgtaccctgactctggccattcttctcacttcccatcagcacccaagtccaagcctttagcatctctcatatagcctatccactgtggtctgctgcagtccattctccatgtagccatcatagtagttttttaaaaaacttaaatcatgccggacgttgtagctcatgcctgtaatcaagaggaggatcccttgagtccaggagttcgatatcagcctgggcagcaggctggtattttttttgtctctacaaaaaatacaaaaattagctggggccatggtggtgtatgcatgtagtctcaaatacttggaaggctgaggtgggaggatcgtttgagccccagaggttgaggctgcagtgagccgagattgtgccactgcactccagcctaggtgacagagcgagatcctgcctcaaataaatgagtgaataatgaatgaatgaatgaataaatttatttatttatttaattcaggccatatcacttccttgtttaagccctgtaatggttttccactattcctagaatcaaattcagactctgccatggctttgaaggccctatgtaatctgacctcttcctgcctcatcatcttcccctcagtcactgggctgcggccactgtagccctcttttcctcaaacaccctgcatccgttattttgcttttgctgttccctttgcctgagtattgttctcccagatgattgcatgatggactttatcttattcaaagtctagctcaaatatcacctctgagacaagcctttcttgattatcccacctaaatgaagctttcttctccctaccaagccactaatacatcctctgtgttcttgtctgtataacacttgttactacctggaattgtctcatttattaacttgtatacttatttgtggtctccccagctagaatttcaggaatttagtttctgtcctttacttctgttcagtatagctgctcagcctctgaaataacatgttatctaaataatagtatctgttcagtaaatgacttcagagttagagcaaaaatgagttaagcgcagtggtggggaacaggatcgcaagtcccctgggcagttgtttactcagtgtggacgctgacgctgctgctcaggggtggcacttttattttttattccatctgaaccagcaacttggtctgaagtaatactatattttataaatataaacctaaatagtgatcttttgattgttggattcatagccctttctgtggacactggaaggatctctaaatagtggttcagaaaggaaagcatatctaaaccaagcttgtccaacccacgtcccgcaagacgcatgtgacccagaatggctttgaatgtggcccaacacaaattcgtaaactttcttaaaacattatgagattttttggcgttttttttttcttcagctcattggctgttattaatgttagtgtattttatgtgtggcccaagataattcttcctctaatgtggcctagggaagccaaaagattggacaccccgatctaaacttttctttactgtctttttacagtttctattattctgtttctagaggcattctgactggttcaagtaaagaaaacataaagtgaattatttttatctagttgatgtgaagaatctactctgtctcagatgtaaagtacatctactgcctaagcctttggtttctaatactgtgttaggtaaactcctctcctgtgatgggtattttttgttctttgtcacatttggtgtgttagggtaaagcagtctgaggttttgattatattatatcatcgtggattggccacaaaagtcagcaaacagtttagttattatcattttggaggtaagacatttgaaagtgttgttttccatatttgtcaaaaccacactcagtagagcttggtgtgctggtgaatgaggagctggatctcagttgtcaaactcatagatactttgttggaggtgcacattttctctatcatatgctccctctttccccttcttaccaaagatgatgactaaaaagtcaaccataacaaataaaataaaacaaacaaatgaggaggaagagggagcaggatgatgaaaaacccagctcccaattgaatgggaatttccaagtatttggatcctggcattttcccccctcaacgttttattgttgtttgttttcattgaatacttttttcttaacttgagctaaatagctcctctttgtctctgtctctctttttttttggggatggagtctcactctgttgcccaggctggagtgcaatggcacgatctcggctcactgcaacctccgccttccagattgaggcaattctcccacctcagcctcctgagtagctgggactacaggcatgcgccaccatgcctggctaattttttttggatttttagtagagacagggtttcaccacgttgaccagactgctcttgaactcctgaccttgagtgattctcccatcttggcctcccaaagtgctgggattgcaggcacgagccactgcgcccagccaatagctctcttttataattgatcctaaagactttcaccattaatgggagtaaaaggagggttttatttccacccaaacctagatagacaagggtatgggactgcaagcagtttaatacactgttagtgagaatgcagattggtacactttctctagatggcaggttggcaatgcatatcaaagtctaaaaggtgtgtatcatgccctccagttaaacacagatgtacattgtttattacagcatgcttacaataggaaaattgggaacaatgtgattggttaaattatgatggtgtttagaatttatataggaagacgagcagcatagcccaaaagagatgattccgtgaactgttagacactaaaaatgatgatttgctctttattgcagtgaattatatttgtggtatgttaaattaaaaaactgattgtaaagtagcattttttatatactgtaatttgaggagtttagggctttatttttctgtttcttttgggagatttaaaaaaaattctgggaacacagaattgagctgatttatctcattttctataacattaacataaaacatgcccacctctgtgtgtatagaactttggagggatgcacattaaaatcttaacactgccgggcatggtggctcactcctgtaatcacagcactttgagaggctgaggtgggtggatcacctgaggtcaggagttcgagagcagcctggccaacatggcaaaaccctgtctctactaaaaatacaaaaatcagccaggtgtggtggcacgcccctgtaatccagctactcgggaggctgaggcagaagaatcgcttcaccctgggaggcggaggttacattgagccgagatcatgccactgcactccagcctggggtgacagagcaagactcgatctcaaaaaaaaaaaaacaaaaaaaactgattgtaaagtagcatttcttatatactgtagtttgaggggtttagggctttatttttctctttcttttgggagatttttttttttttaatctgggaacacagaattgatctgatttatctcattttctaaaacattaacataaaatatgcccacctctgtgtgtttagaacttggagggatgtacattaaaatattaacactaattatctacacatggtggcattataggtgattttcattttctttatctaaataagcatgaattgcttttataatagaaatacaaaaaactattttcctattttatattaaacttgaatattttaaagtgcaaagttaggccgggcgcagtggctcacacctgtaatcccagcactttgggaggccgaggcaggtggatcacctgaggtcaggagttcgagaccagcctgaccaacatggataaaccccgtctctcctaaaaaaaaaaaaaaaaaaaaaaaaaaaacaaccaaattagccgggcttagtggtacatgcctgtaatcccagctactcaggaggctgaggcaggagaatcgcttgaacccaggaggcggaggttgcagtgagccgagatcatgccatcgcactccagcctggggcaacaagagcgaaactccgtctcaaagaaaataaaaataaataaataaagtgcaaagtttgataatgtttctgctttgttttacgcaaagattactttatgttaacatgaagatgtcaacaactctctttttccccccttattttcctcttaaatagatactgtgtgttggaaggcacattactaagttctttacaggggcatctcatttaatccacctttctgtgtgtgtgtatgtgtgttgtaaaaaattcttattttatagtcaaggaagcagagctcagatatagcttatagccataaagaacaagtacattttactggacattaattctagatttcagaacatgtgggtaatttatggcttccttgaagtgataaaattctagaactatcaaattggactgtaatagagatagacttgggttaaccagacaactctattaatcatcttatctgcacttaatggtatagagataacttgatattgatgaccctaacttagaaatctatataggatcctaagatacattctgaatcatctaaagagagtaaattatattcaatattgttctaatattatgtgttgcactattttgtatctttataaatgagaaggttagcatgatttattggaaagaatactaactcagagtgagaagatctattctctagtctcaattctactacatataaccatggttctcactttcatcttctgatgaaatatatgccctcctaccttaaggagttagaggaagaaaaataaaatttggtgtaggaaaatgttttgaaaactaaagcatcacaccaaggtattattactaattattaatgttaattatatgtattgcctatattcatttttgaataacctgaacataccatctctcagccatgctttattagagaaagttcatgaaccaagaattttaatttttctcaacaattaagtgagacaacacaggtggctttttttttcttttccctggtgtctacgaaaacaaaatatttttcagattgaaaattgaggcataaatagccgggcgcggtggctcacgcatgtaatcccagcactttgggaggctgaggtgggcagatcatgaggtcaggagatcgagaccatcctggctaacatggtgaaaccccgtctccactaaaaatttaaaaaaaaaaatcagcccggtgtgctggcacatgcctgtagtcccagctacttgggagggcgagacaggagaatcgcttgaacccgggaggcggaggttgcagtgagccgagatcacaccactgcactccagcttgggcgacagagtgagacgcagtctcaaaaaaaaaaaaaattgaggcataaatagaaaatgaaatttatgaagcaagctagtgacagatagaacttagggctgcattcatattgccagtgctttttaaaaaatcttttttgtataaaactgtattgtgttcattattcagattgactctttcagctagtctgcactaaacatttactttttttgtttttgtttttgtttttgagacagagtctcactctgttgcccaggctggagtgaaatggtgcgatctcagctcactgcaacctccacctcctgggttcaagcgattctcctgcctcagcctccccagtagcttggattacaggcggacgccaccacgctaggttaattttttgtatttttagtagagaaggggtttcaccatgtcaggctggtctcgaactgctgagctcaggcaatctgccggtcttggccttccaaagttttaggattacaggtgtgagccactgcacccagccaacatttactttttaaaagaattttttacttgccccaaaactctcaaacttgtctcctacacatataaaaattgtacatagcaatgtctgcagttctgtgagaactaaatgctctgttcttttaggaagcagctctcttggtttttgtcttttgtcttttttgttttgttgaaagcatgattctttattagtaaataggatgttttacctggaaagtttctgtttttattattataactatattaaagtttttagtctcttcttttggtgccatgacttggattatagtcctcattttggcaggggggtggggggtgggtctgcacgttagaaaactacatagctctatgatatttttagttattaaaatgaaaatttggatttctaggcacctttaagaatagtggctggaacttattctatacttactccatatctattttagaattggaggaggttgagataaagcttagcaaaagggatccttagtttggggtaggttctgtaaccccagaattcatttacaatgaagtctcctttttcagattttgaaagtcaggttagtaaatttcttttaggatactacagaccagggcctagtggatgggctaagtcagttcctctcaaacttcagagtgtgcagcagtcacctgagaagtggtgttcaaatgcagattaggaatcagtaggtctggaatgggcctgaggttctgccttgctggtgagcccccaggtgatgccaatgctgctgtttctcagactatgctttgaattcaaggaattgcatagcttcttgcagagtctttaagcaataattatgattttgctagtggaaaatcagttctgctctttaccagacttgggtcctgtaggcatctcttgttcttgggaggtggtaaatctctttggaatctgtattagaagacatccaggcaaagatataattatagaagaatcatcactggaaagacctgggcggtattattgattaaaatccactcttctttcccttctcccttccctcaccttccttgaacttactgccctcctcttactgtcattggggcaatctttgttgctttaatattcccgtggcatgatgatgcaacaggatagtaatttacagcagtttcaggtaaaccttctgaaatgttcagcagagtggttgcttcattaggaaggagttattcacacggcttttgagatgttttacttacaaaacagtcagtcagttatctgcttaggttttttgagagttttgttctgttttgaaaaaacattggtctcacctcttctacccaaagagtagaaaacattatgctaagtgaaataagccagacacagaaggaaaatattgggtttctagagttggcaaaatgataaagatagaaaatagaagtggctgggcatgatggctcatgcctgtaataccaacactttagaaggccaaggcaagcggatcacttgaggtctggagtttgagaccagcctcatcaacatggtgaaaccccgtctctactaaaaatttttttgtattatttacaaaaaaattagccaggtatgatggcaggtgcctgcaatcctagctactggggacgctgaggcaggagaatagcttgaacccaggaggtaaaggttgtagtgagccgagatcgcgccactgcactccagcctgggtgacagagagagactccatctcaaaaaaaaagaaaaaaaaagaaagaaaatataagttaccagggaccatggggaggtagaagtcaggagttatcgttttaatgggcacagaatttgtttgagatgataattttaaagttctagaaataggccgggcgcagtggctcatgcctgtaatcccagcactttgggaggccaaggcgggcagatcacgaggtcaggagtttgagaccagcctgaccaacatagtgaaaccccgtctccactaaaaaaaaaaaaaaaatttagccgggcatggtggcaggtgtctgtaatcccagctactcgggaggctggggcaggagaatcgcttgaacctaggaggtggaggttgcagtgagctgagatggcaccattgcactccagcctgagagacagtgtgagactccatctcaaaaaaaaaaaagtcctagaaataattatgatggttatacaacattgtgaacatatttagtgccactaaatggtacatgttaaaatgataatgttatgttatgtgtattttgccattattttacaaaatttttttgaaaagggctggataaaaagtattttagtttggtggttctcaaaattggctgcatagtagagtcacctagggaacttaaaatcctagtgccccggccacactccagaccaattaagtcatagtcttcagggatggatctaggcatctgcaatgtttaaactctccaagtgattccagcatgcaggcaactttgagaaccactatgatggatcacaattccaaactgcttctccatactgtagtgtcagaatttactggcaaagcaggctcttcttactgtctgaaattatcaaaaaatgtttacatatatgatgtctttccatgtttagtaggcataatgaaattaagagaatatatatgggccagatgtggtggcccatgcctgtaatcccagcactttgggaggtcgaggtaggcggatggtttgaggccaggagttttgagacaacctgggcaacacagcaagacctcatctctactaaaaatttaaaaattagccaggcatggtggtgcatccatagtcccacctactcaggaggctgaggtggtaggatcacttgagcccaggagttcaaggctgcagtgagccatgatcatgccactgtacttcagcctgagcaaaagagcgagaccctgtctcaaaaaagaaaggaaaagaaagagagaatatatacgtaacaaataaaaacactggatgtgttcttaaatagaacatggcatattgtgagtaaagaataagggtatattcagaaatactaaagagaagaaaatagccatataaattacttacataggatacaacttgactaaggaaatatttacatttatatgacaattaatatccagagcagattaatattttcttcatattcataagaaaaagataattagaaaaataagcaaacattataagcagttcacagaaaggaaaaataaccagtaaatatataaaaagattgtcaactcactagtaatggaaattaaaataagaaaacatttcccccatatcagatgagccaaaataagaaaacttgataataaggctgggtgcagtggctcatgcctgtatcccagcactttgggaggctgaggtgggtggatcacttgaggtcaggagttcaagaccagcctggccaacatggtgaaaccccgtctctactaaaaatacaaaacaattagccggccatggtaacgcatgcctgtagtcccaactacaggttgaggcaggagaatcacttgaacccgggaggtggaggttgcagtgagccgagaccacaccactgcactccagcctgggtgatgagtgaggctgtctcaaaaaaaaaaaagaaaaagaaaaaaaaaagagagaaaacttggtaataaaatgtggaagaggatgaatgggtattgtctggtactcttagtgacagtgggattggcaaagtctttctggaggacaatttggcagtgtgttaaaatgttaaatccatataccctttaatcagcaattccacttttctgaatttctgctaaactgatttcataaactgtaagcaatctaaatgtttatcagtaggggaatggctaaataaaatggaaattctataccatggatactaggcaactgtttttaaaaattagattattctagttgcactaccatgagaagatctctatgacaaaatgttgagtggaaaaaacaagttataaaatagtgtacaatatggtaccatttgtgtttttctttaatcacataaaactgcctttctagcatgtatttatgtaaatgtatagaatttggcctagaaggaaggctgttcatcaagctcatgcctctggataggagactggattgagggaggatacatggcaaagaggactttgactttatctatattatttacatttttgtacagaagagtacaacaagcataaggtaacagaagctaaccaaactgtctccttcaaagagaaggtaggactttaagagcattttgattaaaaagagagagaaagtttgataggttgggggtgccgagatacagaagcagaagtcttgccttgagagaggagtctaaatgagtgtctccattgactggccttcaaattcactaattctgaagttacgttgatcttttctccaaacttgctcttgtggtttctatgggaatgtgtttttagggaaaatgagattaagagaagccagtgttttgcttggcactactagggagtggtgtttctgataataaccaccatagtcatctctctgaacagagatcagtactacaaataattcccaatatagggcaaatgaatcactttgctttagctctttaatgccctttaaatatccattcaaataaaattgggtctgtcagcctggacggtaataattttaagttaaagtaatgttgccacagtctgaaaaatctccatttttccttccctgctacattcctgttttctgtaggctatacaaacataacctttcaacatggtttgctttcaactgccttctctttaaatttattatgtattctctgacctcttcagtagaggtggagttggcagatatgttggtctgaaagaccttttcttggtaattgagcctaaatggacatcaggagcctcaaaatccctagactcagataaatgcagagcaaagatagagggaacaagaggagagggtatttggaggatgtgtaaggataatgcattgttggatagcaaagaactaactgaatttacaaaggaaatttctagcatagcaagaatttttttttaattggataagacgttttagagttttagagaaccttttattttaaacctatctgtggtttccacataatctttacttttcactgacacaggcatgaatttgatatccttatctttgctgattgtcccgggaagtggtagtattttctattctttgctgatttggtgtggctgtactgaccaagctagagtaccttaggcccacctagagccctaaatcagaatgagagtccaggaaagcttgttccagctcaattaaaggacggtctgagaggttaggctttagctttgctgatcctgttgattgtctccctgtgtattaaagacaaaccttccttaacaagcacttcaagaagctctggtttccagaactctccaggaccagtaattaattcaactggtaatgagagcacagttccgaattctggaaaggaatcatttgactcttcctgtactggactgctagtttccctttattaatagtctctttagccttagcactgtttatttgggacagtataaaaagaacctgtaggaagattgcctttttcaatgaagtcaaattatctcttaagcatttaaaagtaaaaaatacccttcattcccaaaatgtacacacctgaaaaacaaactcttatagtagaaaataccttttacttcttttggtataggggcaaattttatatgcttgataattagcatttttaaaagctatgatctgctcctgaattagaacttgtatgccagcagctgatttcagtctggttccattttttgacttgatgaggtttctgcctgtggaagtaaccttctttttgtactgtttctgtttctcctgcctcacatattagcctctaggatcatcttcctaggaatttgaaacatttctcatccagagatttctagcaaataaatcatctttgaaaagtttcccagttctgtctttcctctaattatggttacccttttttctgacaatttccattagtaatctgcttgtacatccccccaccccccgtttttttttaattgaagggagagaaacagtgcatgtgcgagagggagctgcttgtattaatacgtatttttaatgctcaaggaccgagcagaacaaggcacctaaactttctgtacattgtgggtgggttggtaatagcttgccattgatcattggtccaaatgatcaatttgttccttcttggttctagcaccctttatttctcatcctcaaccttgtttcagatacatataaactcattcttctgccgccttctgcttttttccactttacccatccttgaaaaactaatgatgaatgtcttaatgtacattacagtgtgttcagtattagtaaaccatttcagaaagctagctatttgtttgcattgggagaataaattccctattttccctgatttaaaagtaaaatctcatttacctttgaaatatttatttttggcaaatggtcacatttagactttgatagaaacttaatatagattgagtaccccctgcctgaaatgtttgggaccagaagtacgttggatttcatatatttttggatttttttaacatttgcatatacctagtgagatatcttggggataggaccacaatctaaacacagaatttatttgtgttttatatacaccttatgcactatagcctggtggtaatttcttagggtatttttaataattttgtgcatgaaataaagttttgacagcgacttgaggtcatgggtggaattttccacatgtgacacttgaaacattccagatttcagatcttcaaattagggatgctcaatctctccagattaaggattaaaactgtgctggattaaagccatgatgtttctgagtccttatttgttttacatttagagtagttttatttaatagatttgaagagtggatgcttaaagcatctacttttttaaaaaaaaagaaacagctttttcttattataaaatcagaattaccaatcagttgccaaagagctatggtgcacctaaattttataacaaattaagctctaaattttagaacaaaagttatgaatactggagaagttgctgaaaaaagatggcttgatgactgaggtaataataataaaacttctattaattaatatacctgctatctcagcctcttcattgaccttgtatatttgctattattactgttttgcagatgagaacattaatattcagagccaactctgagtcttgtgggttttttttgtttcttggtttgttttttgtttttgagatggagtcttgctctgttgcccaggctggagtgtagttgagcgatcgtagctcactgcaacctccgcctcccgggattaagcgattctcctgcctcagcctcctgagtagctggcattacaggtatgtgccaccatgcctggctaatttttgtatttttagtaaagacggtgtttcaccatgttggccaggtgggtctcaaattcctgacctcaggcagtctgctctccttgaccttccagagtgctgggattacaggcgtgagccaccaagcccggcccttgtgttctttttggtagaaagagctaacttaagagaagtgagtctgagtgcactgactcacacctgaaatcccagcactttgggtggttgaggcaggaggattgcttcagtccaggagttggagattggcctgggcaatgtagggagaccccttctctacaaaaagaaaaaaaagaaaagaaggaaaagtaaagaaaaaaaatagctgggcatggtggcatgcgcctttagtcccaactactgaaggctgaaacaggaggatcccttgagccctggaggttgaggctgcattgaactgtgatcatgccactgcactccagcctgggccacagagcaagatccgagagtgagagagagagagagagagaatgaatgaatagttagtatatgttccacaaagaatgtaggacttttctgggcactaaagaatgagtggcggcattagaatagtagcatggaaaatagtccagccaggggacagaacaaaggcaaagaagcgggaatgggcttagcagctcttaagacagtgcagagatttgtctgatggaggaccaaggctgagtggtgggaattaatgggaactgactgtagtgtgaggccagattgtggtgggtctgaaaagctgggcagaaggatctagtttagttgccatagttaaaagacatttggaggtgttttgagcattggagctatgtaggtaacatttaggaaaacctctcaggcaaggatatgtgggaagagggaatgaagggagaacttggagtttcccaagaaagccaactagaaggatacactagccttgggccaaaaaattagaataaaggtggggccggagaagaagggatagacaccagagacgtttcaaagaaaacaaaagaactggacttgcaatgtgtgactaggtaagtgttgaaggagaaaagtaaagataactttgacatttttagtttgagtggccggggaaagggtggttttctacttgctaagataaaaaagttgagaagacaagtagattggagagagggtagggtaggagtttaagtgaagaggctgatgctgagcccacctttcaagtaacattgagttattggaactcagttggaaggcctggtgggagagccgaaggaagacttgagggtgaaagatatccacgtccaggtgccaacgtgacccagaactgaggagcataaggaactattggtgcaaatagggtgaggcgtcagaagtgaagcgatcaccagaattagggaatatagagggttccaggtggatctgagcagactctgtcagtctagtattctccacagtgagtgctttctgatcactttaggatttctgttttgtttgtttggtttaagacagggtcttgctctgtcacccgctttaggatttttgttttgttttgttttgttttgttttgagacaaggtctcactctgtcacccaggctggagtgaagtggcaccatcatggctcactgcatccttgacctcctgagctcaagcgatcctcctgcctcagcctctctagtagctgggactacaggcacgtgccactgtaaccgactgagttttgtatttttggtagagacagagtcccactgtgttgcccaagctggtctcaaactcctggtctcaagcattctgcctgcctgagcctcccaaggtgcagggattataggcatgagccactgcacccaacccactttaggattttgttaatttagaattatttagccttctcatttcattttctccagactctcctaggtatgaatataaagaattctcctttttggaaactgttaatggtattcaaagaaaagggagtttatgaaagtctatatcaatttaatctatacctctgagaaagccattttttttaacatgaagaagtataaaatattgtgtgtgaagattaagccctttcttgctctatgtatttgagcctagaaaaagacacactcccaagaaattagaataaagggaaaaatgactttgagatgtactttcttaaaataactgaagtaatgaccgcatgagccagctgatgggtttttaaatggatacgtttctatcagcctgctgcttgatgccagagccaaatatatatggagtgtattatatcatatcctgtaggcaggagactgttggggcattgggggacttagagaggtgaagtggcaggcttggcacaggaattaacagcatggctaccgtcaaccagaactttattaggtcaacattactgattgggttcatggttccctattatgtaacaatttgtatcatcttctcgtaaaataatatctaatatttattataagaatgataagaatacctgatatttatagaaatctttaatattaaagtgttgctgtactcattctctcattaatacttaattattctcatttctgttttttcttgttttactttgtaactacaaatccacacccccgagtctgattcattgctaaaagtggcctctttttggttttcagctgcaggggcagtatgggtgcatccttagttgcaggatgctacttatatctggagtgctatagaccaccaggttaaaaggaagacagtaggtctgggaaggaggaatagatcataacttgataaactgcttttcttgccagaaatcattatcagcgattaagaatattcacaaagtagaccctcccccaacacacacagagtgtggttactatgccaggaaataagaatggcagttgtctttgtggtttaaaacctgtttggtctggatttgatttgtaaaataaatctgaatgaagtccataatgcatttaaattcacacatgctttactatgtctatatgtcagactcatggacagtggcctagcttactggaaaatttctagaagagttttagggttattttccctttttattaagttaaaggcctgtttgttttcctatattttataatcagccaccttattgaattctcattattgtttgtagtagtttttcatttgatctctttggaattctctagatataaggtgacttcatctataaataataatgattttatcagctcgcctcttatttctctcttatctaattgcatggattcctacttccagaacagtgttgaaaacaccccgagtttggcaccttacatgcatgaaaactgtagaagggaaataagctatagtaccagtaatatcttgggaagcagaaattaaacttaggggtagatattcttactcttagaggaacaagtctacaaaatgcagcctaaggtgcactttatcaacatatttataattctcaaccacccatggagatataggaacctatggaaaacagtgggttttcatcagtcacatcttagaattctctgggaccttcctggaaacctctctgttttataaggttagaatttaaggagtcataaacacaccccagatgtctttcatgagtattgatgaccacactgttctcttccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtgagagttcctctgactgagttgcctggttgcttttccatcctaaattaaccacctcaatttttgtcatttctacatcttgtgctagaaagtctttgtgtaatagttaagcctgtccctccaaagactgatattctttgatttatagccttttccatttgtcgctccatcactatactataaagagaagactgggttgagttgatgaatttaaaatgtgtcttcggggttgccttttggagcagttttaattttatgaagtgcttgggaaagtcaaagaaacttgaagtaaaagtattaatcactttgaacacttagaaatgcttttatttctggttactaaaaatcattgttgaaaatgtaaatatggaattagagggatatgaagtctgccagctgagtctgctaataacaaaacttttacaagaaagactaaactacctaccattccttactttttttgcgtatttatttttctttttctttcttttctttcttttttttttttttttttgagacagagtctcactcttgttgcccaggctggagtgcaatgacgtgacctcggctcgccgcaacctctgcctcccgggttcaagcaattcttctgtctcagcctcccgagtagttgggattacaggcatgcaccaccatgcccagctaattttgtattttcagtagagatggggtttctccatgctggtcaggctggtctcgaactcccgacctcaggccatccgccctcctcagcctcccaaagtgctgggattacaggcgtgagccaccatgcctggccacgtatttatttttcatttagcttggaagtttactgagaatcttaatatgccattcttgatcagaataatctttctttgcaagaagtttaagagtttggcctcaggttggaatagggtgtaaactagactttgatcaagaagaaaccaatgagaagccctctttgatacttcgtacacagcttctttctaccagaaccagtctgtgggaggtaatcctaggagagtctaataagaggtttggtttggtttgatttgataaagaagtagctgcttattgcatattgggactaaataaccaaagttctttgtggcttaatgtgcttttccggtcatttggtgacaggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggtgagtaaacctgagggctaccagactgtggcttctgagatggatcagtgggcacctcacctcagactagggaaagtttcctttgtgcgaactcttgtatgaactttatatagctccccaagatcttcctacctgaaattgatttctgaagaatagtttaaattctttgcatttgctaaatacagagctatgagtagcttcctggacatttccaaaacaaagcacttttaaagggctctttttttttttgagacaagatctctctctgtcatcacagctcactgcagcctcaacctcccgggctcaagtgattctccctcctcagcctcccgagtagctgggactacaggtgtatgccaccaggcctggctgaattttttttttttttttaagtagagatgaggtcttgctatgttgcccaggctggtctcaaactcctgagctcaagtgatcctcctgcctcggcctcctaaaatgctgggattacagatgtgggccaccatgtctggccttaaaatgacttctgttttacagtttcactctcagtgatcagggaatattccttctgaatgacctcttctgaggtaaaacacaatttgttgattgggaacctctaaagttcagattgaggtgagaatagaaagttggttgaccaacactgggcatggatgtggcgatgtgatagcttttctcatatggacttatttggttgaagtaaaattctgaaactcgtgatagtctctgaactatgattttagtgagctatgattttagatttcacatcataaggcatattctttgttatctgtgctgaatttgggattaaatgagtctcagcttctgagtaaagaggtggaaggatccatccactgacacttaaccactttccatatttttctttaggttggtacgggggcaacagtagccacattggctgatgcttcagaattgccaaccacggtcaccgttgcccaagtgaattattctgccgtggctgatggagaggtaagaaagagattccatctgcatcttcttaaatacttgaatgtataatgagggaaaagcaagggtccagaagatggagtagcctgcatgtctgcggcactctttcatttaaaccttttaaagagcatgagaccatgaaagttttagaaagtgtcttatgctatgtgtattaattgtaacaattaagattcatggattagtatgtcaggaacttagaattttacatttgaatgtatagcatttggtattatacacaatacaaagggattatccctttaccatttttatgctgtgaatcccaaagaatttcatctttggtctttatgaaaaaaaaatggcacattaaaactggaactgactaagggaagccttctttgaaaggataaatatgtttgcaagtcagtaacatgatttattacatcttaaatatgcctttgaaaagatttcttaggagaattcttccttaccaaaattgggataattatgggacattaacctaaagacagccaacctttattgatcacttggtgggctaaacactcaaccctatgaagtataaagttctgttatcatcttcactttagagatgagaaaaccgagacataacagagcttagatgatttgcccaaagtcccatagcagtgttgaagctggataatgcattgagaaaaacattacctaggctctgagccattggtgaagatgcaacagtgaaggaaggggtttgttacgtcaccatgagtgtttcccttgaagatactgatgtggtgtgctgaagtttgaaaaatagccaacagatgtcaaagagcagtatcagaaataaagctaagagtattatctcacccttgttgagagccatggagcatttccccttagaacaccacaaagtcactttcatttgtgcccctcaggagagggggagagctggcaaaggccacatggctgggagatggagggagagtgcaccacaggctccttggccaccctgcatgtgccaaacccctgtgtagctgcagctgtgtggagttgattcgcacaggatccttgctgtcatgggactccagtctagtggggaagagagatgtctacgtgaatgaactctagccttcctgtaagggatgctgcaaagcgtatgtgcctcctttccacctaaggagcctgggaaagtttgggacactgaaaaacttggttattgggtgaggaaaggtgaaggttgacaggacacttactttctaagtatataaacatcattaaaggatatggattagcaaagcaaagaatttgtcagtcccagaacactagaacaagatgacactccttaaagtctgaaagaggtggaaaagacaacgaggggtacagttaggagatgtgttagtttttggcttagacaaagttatcaaccatatgtctctactgaatgtttcttggtactatttaaagaaagtaacttcgtttccttctgtataaaataatttgtttttgacacataatatttataacattaatggagttgcgtttccttttttttttttttttttcctgagacggaatctcactctgtggcccaggctggagtgtagtggcacgatctcagctcactgcaacctccgcctcccaggttcaagcgattcttctgcctcagcctcccgagtagcaccaggcacgcaccaccatgcccagctaatttttgtattttcagtagaaacggggttttaccatgttggccaggatggtctcgatctcttgacctcatgatccgcctgccttggcctcccaaagtgctaggatgatatatagtatatataattctgttagaagagaaagccaaagtgcaaaaacattagagacgtgaattttaaactgaaccatcaatatatgtaacagttttgaattgcataactcattttaggtgcatttttatgaatgtcagtttaccttaaatatgggcaggctgaataacaaataggaaaatatcaatagtatttttccatccatcccttcagtaaacactttttgagccctgtgccaggcactgtagagactatagataaaagataataaagactcccctttcccttaaggagcacataggtaggcggtagagaaaagcaaagaacaattgcagtgagataagggtctactggcagcaagcccagggtgctgtggaacagcagaggagaggctctcatctggacttcaggggagtggaattgtctcaggaaacacttcccagaggtgtagcccctgagcttagactagagtgggaactagccaaacaaaggagagggatgggagttctatcctgtcaaagagagcaacacattcagtgcattgacttgtgaaagcatggaacagccacagtttgaagggccttgtggtagtgggcctctctcagaaatgcatagtagctaatgagatatcttctgaatatcttcctctcctagggcttgtggccctttctttggggaagggagtgcaacaagagctcaagtaaacacagtttaagaaagcactgagactcaggaataggaaattccgaagagatgctggcacttgagctgatttcttgatcacctgccgtgtttctgattagaaatctcttctctgtttctcctcctattttctcttcaccgtttactgtcattccatgccatataatttaactttcttaaattatactgtatatggcagcattctaatgccattttcactacaaatatagttgtaactaaaagtatctatattgacttgctgcctttggagtttgaggacttgagagagcctcactgggccaaactcaagtgagagcagcagcatgggccagactgaaatagaggggcagatcagaaacaggaagaccattccctagcagtaggcaacagcactgcccggcttcagtggatgttttgagcggactcatcagccacctaagaattgatagtgcagcttgcctcttatggtggcagtgttggtagtgatgttcattggagcaatgagatcaaagcaaccaaccttggaaagcaagagctttggagttcctgaggggcaattttgcagctctaggatatctctgcctcaggagtgatgggccctgaaggcttgctggcacaatccactgcccatgagaactcagggcaaacacgaaggtaactcaaaggaatgtctctttctctgagaggcttttggcaaacattctgaaaagcattatcataatctaagtatggtaatataactaaagcaggaagcatttaaaatatctacctcctagagcttggagcactttctttgggacacagtaacaagcaggcacaaggtaactactcactaggccccagcaatgtgaagcaggaatagcaagagctgcagtaagcactgctaaggtcctgagacccaggagtccaaagacagatacacctgagctgatggatcacctgctgtacttccaaatagaaattgcttttactgcccctgctgcttttcagttttgagggtgggtagttaatcaaccagtatttattgagcaaaacggactgaagtaactagatacaggtattcagaactaagtctctaaacacagagaattgtactaaaatcagtagttctgtaccccagaccagaggggacatttggcaatacctggagacattttttaccgtcctgactggggagggtgctattggcatctagcgggtacaagccgggatgctgctaaccatcctgcaatgcacaggacagccccacaaccaaggatacctgggccaaaatgttagcatgccaagactgagagactgtaggcctagcaaacctggattctcatgtatcctgtcaccagagagtatgatttttatttttgggttttttgctgtgggcagtgggagagtcttcataacttctcccctactaaaaagaaagcagtttttgctacactttaaaaaattagtttctgagtttagcagtttctatcaaaaataaacatgccaaataactttgatctataattctacctctaggcatttaccctataaatagactcacatgtaatatacaaagtataatagtatataaggatattcatcacagcactgtttgttaatagcaaaagactgtaaaccacttaaatgtgcatgaaaagatgacttgttaaataaatcatgatgtttctatataatgcaatgcttcccagcactttgggaggcggaggcaggtggatcacctgaagtcgggagttcaagaccagcttaaccaacatggagaaaccccgtttctactaaaaatacaaaattagctgggtgtggtggtggggtgcctgtaatcccagctacttgggaggctgaggcaggagaatcgcttgaacctgggaggcggaggttgcggtgagccgagatcgcgccactgcactccagcctgggcaacaagagcaaaactccgtctccaacaacaaaaaaaaaaaagccattctatgcagccatttttaagaatcatgaatgagtaaagtagttttatatgttccaaaatggaatcatttcagagatgtactgtttgtgaaaaaagcaagatacaaaagatatgtagaatatgctgccatttttattttagaggagggagtagaaaggggaaatggggtgaatgtgtgtgtgtgtctgtgtaaatatacttccatatagcaggaatagctctacaaaggtacacgagaaaataggtacattacatggaaatattgtataatgataaaataataaaagagaaaataggcacagttgtagaccctttggacaaagggtctagagtactggtatcatattccctttgatacagtttgaaattttggtatagtttgaatttttttttcctctcatggcccatttctaacaacccagcctatatatttttaaactttattatgtatttatttaaattaacaaaaaattgtatatatttatctggcacaacatgttgttttgaagtatgtatatatcgggaagtaaattgagaaacgtatttaaaagtgtagagtgggccgggcgtggtgactcatgcctgtaatcccagcactttgggagactgaggcaggtggattacctaaggtcaggagtttgagaccagcctggccaacgtggtgaaaccccatctttaccaaaaatacaaaaattagccaggggtggtggtacacacctatagtcccaactacttgggagcctgaggcaggagaatcgctcaacctgggatgtggaggttgcagtgagccaagatcgtgccattgcactccggcttgggcgacagagggagactccctctcaaaaaaaaaaaaaggtacagtggaaggtcttgctttctgtctcccatccaacttgtttccaactcctctcaaccccacacatacaatccagagaatatattcagtggcttttgtgtgtccttccagaatttcttcatgcaaatgcaagcaaattcaggtatatattctaatacccccttttttatgcaaaaggtagcatgcttaaagctctgttctgtatattgcaggtcatgttaattttaaagagtatgtgtatttagccaaaaagtagcaattattagaaaaattacttgtaaaattgtacttttgtggctttgtttttttactatcttgtcctttctgcctcaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacaggtggtggcaagagtgtgggaataagtgaggatcgcaaatctgtccctgcagatatgggtggaggccccttaaagagaaatgtgtctctgtttgccacagttggcagttggaacttaacactcttggcccatacgatattgtagtttggcctataataggtcagtccttaccaagaaaaattaaacttctttccttcaggtgtgcttaggaaaggtgatgtgaaatggaatcctccagtaaaaggtagtttccaaaactcaatgtattgtttcctgcttagttccttctactggctgttgatggaaagatcatctccgcatcattcttcactcctgccgccacccagccccaacaaccagtgtagcctttctgacttccagcccaagctggtcaagccttcccgtttatcctattctgtgtccagtaagcagaagcagtaaggcttgagtgcttcatgttttcaagggatacagaacaaattaagaggcttcggattattgtccttttgccctacaaaagaaactgcattttgttgggggtattaatccatgtttaagcagcaaatggctgattttacttgcttttgagaaaaatgtgttgcccttgcttatcagcgagctcaagataaataagttttggattattggggaaaataatgaacttttttcttcaggtatgttaggaagggtgctgccaaatgggatgctccaagaggtggtttctgaaactcgattgtattattccctgcctggttctttctactggttgttgacaggaaagatcagcttcatatcattctccctcttcttcattcctgatgcaattttatttttaatgggctcagggatttaaattaatggtcaagagtgtgagccttgacgccagactacttgggtttgaagcccagctctgtcacttacaagctgtttggcatcgagcagttgatttgaactctcagtagccaggctctcctattctgtaaaatgggagtgataacagtacattcttctaggagtgttatgagaactgaattactccatgtgaaatccttaggtcagtgtcttgtatacagtaagggctgaactcttgcggcatgccagctctactgggtaaggctgtaaatagagaatagagtgctctagcatatactctgccctcaaagaaatcatactcttattgcggagactgatttaagtaaaacacttagcaaacagtattacttagagtgtaactcactattgaattgtatggtaaagactatgaacgttgtagaaattcagaggagggtgatcacctcccctaaatataaaatcagtgaaagtttagattgattatgatagatactagagagctgtgatggatttgtatacagttcactgtatgaggctgtatagtatggtggctgagagcagggttccaacgtcacatagattcaggtttgaatcctggctccaccatttgatcctgagaaacataacctctgagccttgttttccccattgttataatgaggataagactcatcacacagaatcatgtatatgagataatatagataaaattctcatcgcggtgtccaacctatagttagcatttcaagaattatagttattatcatttaagttgtattttaagagttgtctattctgaattgattatagtgagaggagattagaagatcagttaggaagaggcactccaggagcgccttgttaaggtcttggaaactgaagtagtaagaatggaggtaaagtgattcttttttttttttttgaaacggattttcactcttgttgcctaggctgaagtacaatggcatgttctcggctcaccacaacctccgcctgccgggttcaagtgattctcctgcctcagcctcccaagtagccaggattacaggcatgctccaccacacacggctaagtttgtatttttagtacagacagggtttctccatgttggtcaggctggtctcaaactcctaacctcaggtgatccacccgcctcagcctcccaaagtgctgggattacaggcgtaagccaccacgcccagcctaagtgatttcattttaaaagaagtatggccagagattggtggttgattaggaataggaaactgaaacacacacacacacacacacacacacacaacacattcttgctcagagttacctagttagtccctagtgatcagaacatttttttcagcccattgagccatgttgctcttgttgctcttcatttctttttttcccccactcacgtatatactcatcatgttgcttttcagtaacatgaaagtcttacttggttccttacacttggctcaattctacccctctctttgagagaaacacccagataaacttcctgaaaggcatggccaagtgagaccctccgtccctttagtccagtaacaccccccattctccgcccgactgtagcttggggtctaacaggccctcattaaagaccagcaaaacttgatttcattgagacttgcagccaacaccttggatattccagtgaagtgtgtgtgtcctgggaactctgtacatagtggaaaatatgaggcacatttgggctctctttgttataaggaccagggcttgtttctaaaggcaagcgggtaatggtatcccctgagggcttgttaacaaacttagatgcagctgaggtggctcagtgtttactccaaaggaaggagaatgtgttcactgtggcatagaggaggaataaagagatgttgaaatctctttgcaatcaggtagttcgatgccccaatgagtgttaggggttggtggattgcagcttctgctggggatgaagaaaccaagcctggcagcagagactagactatagcagactattaggggaatatcagggctttctgaacccaacagaggtaacccatggtctaatgtcttagtcaggagggttggatgtaagaaacaagcccttaacattcgcttctttgtggacgagatgcagtagaatcatttagtccttgcactctgagcctctccacagaatttgctgttggaagtcatctcagtaagaaatacacagagaaatctggtctttgttcctatgatgacaaagcagtttcataatctgccctcttgcagcttgctctgttttgggtgcagataaaacaagcatggttctctaataaccacctgcacctctgctgcaatgtaaacagcagatgtgggcgcagggtgagaagggagaggaagctacgtgcaatggcaggttggggaataaggaggcagaggggctccttcatcttttacagggtaaaatgggatcaggacagttgcaggacagacttgtttctcaaccacgctgttaagagaatttcatactgcaagtcacaagggcccagggctccacggcctttagcccaccctggctttctaacaacccaaagtgggtatggagaaattgtcctttaaaaacctaaaaactatgttaattttcattttcaaaataaagaataaatcagcacttttggaaaggaggtgggaagggaatcaaagtgaacaaatgagcagaacatcacagctttaaaaaaatttgtgtgtgtatgtgtgtgtatatacatacatacatatatataataccatatatatgtatataaaaaatagcttatatataagctatttagcctgaacaaccagagaggaaaggaagtaatattatcatttacttgtgatacagtgattaatttgaactttcagttctttggttaagctgtcctggacttgtagttcctcttaaacatgtccttctacaaacccatttcctgaatatggccagtatagtccttgcatgtagagatcatgatttggctttgtagacttactctacgtttctaaagtagtggaaacttacttgatagtatattgttaacactgagacagtatttattgtgtgtctactgtgtgcagggctgtgactcagtgctatggggaaatacttagattaattcctcttctcaaggaattttagaatttgtctttttttttgttgtgaagattttgcttttaaaagtcatattttgaaagaaaaatttgctcttagtcttttttttttttttttattgagacagagtcttgctctgtcacccaggctggagtgcagtggcgcgatctcggctcactgcaagctccgcctcctgggttcacaccattctcctgcctcggtctcccaagtagctgggactacaggcgcccaccaccacgcccagctaattttttatatttttagtagagagggggtttcactgtgttagccaggatggtctcgatctcctgacctcgtgatccacccgcctcagcctcccaaagtgctgggattacaggcatgagccaccaggcctggctgctcttagtctttaagatgaaatattattgacttaaaattagacatattattaaaataaaatggggcttttatatacggagtgatatttgtccaataaaatgggatggaaaacttagatcagaaatcttctctggaagagaagtcagggatggtacaactgcttttctttcctacaggtaaagattagacgcttacagataaaaggttgatggaaacctcttatttatagctttggttttgaaatgacttttgtctaaaaattgtgaagtggtctagctcagggcctttttaatccctattcacctttttaagtgaacataatctttttctaggctgggcgtggtggctcacgcctgtaatcccagcactttgggaagccgaggtgggtgaatcacctgtggtcaggagtttgagaccagcctcaacatggagaaaccccgtctctactaaaaatacaaaagtagccgggcgtggtggtgcatgcctgtaatcccagctagtcgggaggctgaggcaggagaattgcttgaacctgggaggcggaggttgcagtgagccgagatcacaccagtgcactccagcctgggccacaagagcgaaactccgtctcagaaaaaaaaaaaaaaaatctttctagcagtttagtttggtcgtttcccataaagttgagtgtaaaaggttagaatcactctggaaatgatagccctgcttaccataggcatcatcgttgtcttcatgccccacgtaaagaccttaactggggactgaataattaatcgtactgacctgtcaacctgtcacccccattgcattggacccctcatccctggcattccagattgttttaggttgttgctggttttcagcttttcttctaccataccacattttagaaagaagttaaagaagataacttcaagtttttagggctttaagtggaaatgagtatgatcagttgcaggtacactttcctgtcaaggcttggggagctgccctctcccttcactgcccatgaaactcattctgccagagtgtgttcaggatgtacaggagtggcaggatgtcatctttgatggtcataaagatgagattattgtaaattgtaagaataattacaggaaataagcagtcactgaggtgacctataaacaaagatcctaattccatataaacaattctcatttacagttttcttcttcagactatcacacagctttttccaaagagtatacttttctgctttccataaagtctcaggtcacagcgtaaatatttgtatcattaatcattgacaggtggatgctgtaaaattggctggtcatatatttatgtatctttttctttttttttctccgacataggtaattaataaaatttccaggccgggtgcggtggctcatgcctgtaatcccagcactttgggaggccgaggcgggtggatcacctgaggttgggagttcgagaccagcctggccaacatggagaaaccccgtctctactaaaaatacaaaattagccgggcatggtggcgggtgcctgtaatcccagctactcgggaggctgaggcaggagaatcgcttgaacctgggaggcagaggttgcggtgagccaagatcatgccattgcactctagcctgggcaacaagagcgaaactctatctcaaaaaaaaaaaaaaaatttttttcccagtggttggtagtagtgtttattaacataactttcttagcaaaatattaaaaattaagggcctaggtactaaaaaatattcattaaagtctctctaataaatactttaaagcactttaaaattaaattctgtcatgaaaaatgtaaagaacagtcttagtagtaattccagatcaagggtctcctgttgaaaagacagtcctttccctattgaatggtgttggcacccttgtcaaaaaccatgtgaccatataggtgaaggtttatttctaagctctcaattttattccactggtctatatgtttgtctttatgccagtactatacactgttttgattactacagctttgtgttaagttttgaaatcagaagtgtgagtggtggtgctgggaaaactggatatctacatacaaaagaatgaagttggacctttacctaacacagtgtataaaaattaactcagagtggttccatgacctacaactataaaactctttgaagaaaacatggggcaaaacttcatgacattggatttgccagtaatttcttggatatggcaaaggaaaaatagacaaattggactttacgaaaattcttaaaatgtgtgcatcaaaagactatcagtagaggaaaaaggcaagccacagaatgggagaaaatatttgcaaattgtatctgataagggattgatatccagaatatatagggaatgtctaaaactcaacaacaacaaaaactctattcaaaaatgggcaaaggtcttgaatagacatttctccaaatttctccagagaagatatgcagatggccaataagcacaggaaaagatgtgcagcatcactaatccaaactacaatgagatatcacctcacacccattaagatggccacaatccaaaaaacagaaaataacaagtgttggtgaggatgtggagaaattggaacccttgtgcactgttggtgggaatgtaaaatgacatagccactgtggaaaacaatatgataattcatcaaaaagttaaaaatgggactaccgtatgttgcagcaaatccacttctgggtacatatcccaaagaattgaaagcaggatctcagagaaatatttgtatgcccatgttcacagcagcattattcacaatagctaaaacatgggagcaaccaagtgatcatcgacagatgaatggatacacaatggaatattattcggcctttaaaaggaaggaaattctgacaaatgctacgatgtggatgaatcttgagcacattctgccaagtgaaataagccagacacaaaaggacaaatactgtgtggttgtatttatgtgagatagagtagtcaaaatcacagagacaaaaaataactcaaaatggatctaagacctaaaactatcaaactcttagaagaaaacatgggggcaaaatgtaatgacattggatttgcctgtgatttcttagatatgacaacaaaggcacacacacctatagttccagctatttgcgtcaggaggctaaagcaggattgcttgagcccgggaattcaagaccagcctgggcagcatagcaagatcccatctctaaaaaaataaaaacaaaaatgaaaaaatcatcgaggcagaaagtagaatggtggttgccaggggctagggagatggtagaataggaagtttaatggtccagtttaaagttccagttttacaagatgaagagagttgtggagatgaatgatggtgatggctgcacagcattctgagtgtatttaactccctgaactgcacacttaagtgttaagaatgtaaattttatgtgcattttaccacaacaaaataatttttcaaactgtacagtacaatcctaattattatcttttttttttttttgagacagtttcactcttattgcccaggctggagtgcaatggcatgatatcggcccaccgcaatctccacctcccgggttcaagcaattctcctgcctcagcctcctgagtagctgggattacaggcatgcaccaccacacctggctaattttgtatttttagtaaagacggggtttctccatgttggtcaggctggtctcgaactcccgacctcaggtgatccgcccgccttggcctcccaaagagctaggattacaggcgtgagccaccatgcctggccttatcttatctttttgaagttgtatttaagattagaaggaaataattatgatatttaaaattttcttttatacttaatagagtttgctcaaactttctataaaagcaagtatactgcttttattatcagaaaaagataactgtttaaaacacaggcataaaaattaaaaagcaagacaaattagtaagaagaggaaattcttctatttaatgacacttttctgtccattcggtttcttttcctgcttcctaaaatccttacagtgaccaagaagtcttttgcaggggaattactatatctgttgttttacttgtgtgctgactgtcttaggtaaaggagactgtattgagtttggtacatgttgctttgcccacagtcctaacatgtttactccaattagtccctgtccccttacccacctccacttacggcttgtgcttacaagaccactgccatgttacagcaaatcctgcagcttcagagcaaagctgactcgactggcttatttgtccacttctgctaaactaaatggcaccaccatctctattctgtgcctactggaattcgatagtccctcagtaattgcaaattgacacctgatactttaccagaagggataatgaaattgcctgttttttcacatttttacatctctgaaatttggatggcaaattataatcttacaattgtcaggaatttttcttccttactggcccatgaaataatagtatgtcttacagtttgtagcatcatagaatcaagaaaaatgggtatttatgcacatagtaaaagcatatagcaaggaaaagaaagaaaaatgggacacactgctaaaatagtacttgctataaacaaatggttaatgtcttcctattctacagagcatttgtgctatgtagggaggtttattattttgttgtaattatagaggcaaactgtatttatacagtttggacttgcagtgataattttaaactttaagtctttgttttagccctgcctggatatacagtgagtcaaagggaagagctggacttttcaggatattaatcagccattactctgtatttgaaaagcataactataaatcaaattaatatttagtgttaattgaagagtgagtccaggttgctgctgactcctcatattatcattcatccttggctataaaaggacagtctcagatggtctgccttatgttactgtgaggagaaaagagaaaaggaaaaccttgtgattgacaaccaaaatggcttttgcattgtgaatatggatcagagctttcactatggcttgcaagcactcagctgatattgataaggaagaaactgataatgagtgccttctgtcctcaaacactcaattaccgaggttctgagaaactctcaccattagctttatagctatgtaagacttgagatttctctagccattaatattatttcaaaattactcttggctttatctattagcactgttatcacatatttgctggtaggatcacaaccatggagtcagtagaaagacccaaggaaggcattgaaaggatggtttgtcttggctgcagtgctgttcctctattcatcatcctctctcctgttcctgtgcccgcagcgaagctgccgcccatgctgtcgccaccctggctgaggccaccttacaaggtgggggacagatcgtcttgtctggggaaaccgcagcagccgtcggagcacttactggagtccaagatgctaatggtaagagagcataaatattttattaaatttcttccctgtttccacttaaaccttcctgacatgactggcaacaaagccttcagaaagagtttgagcttcgatttttttttcttcattggtagacatttcatgcctaggaatattctgggagcctgtgattcctttcactagtaggaaacatgggggttcctgaaggaaaatactgtgataatggctacctaattgaattgttacttaaaaagtgattatcgtcttgtgacaagacttgctgagaagcaccttaaaattcactgtgagccacattttgtcttttactgtctcatcggatagggtagatcaatgtcctttactgtagcagagactctctcatgggcaggaccatcatggaaagttctgactacatcaagaaaggcgccaatgtctcacctgtgcttggggtcaggcagcaggctgtgatgccggtgcctctctggttggtactgtggttctgcttcctgttatatgtagcctcacgaaggacctttggatttagccaattacatgcccctaccctgagcttcttccccagctctttgacttcctggacattggtgaatatcctgaataagcaaaagggataaaattcatagaaatatggtggcaaaaatatacaacttcagcccagttctttgggtccatgttggtaaggagtcagttggcaagacaagctgcccaaggaagtgcctcagaagtctgggtcaaagaggagggccagatctgttctgtgagaccctatgtgattgttatatttttaaataatatataattaagcaggacaaattaaatactccatggctttggggaaattgttgctttaaagtcctggaatggggctgggcacggtggctcatgcctattaatcccagcactttgggaagccaaagtgggtggatcacctgaggtcaggagttcaagaccagcctggccaacatggcaaaaccctgtccatggtggtgtgcgaggctgaggcaagaaaatcgcttgaacccgagaggcagaggttgcagtgacctgagattgcgccactgcactccaacctgggtgacagaatgagactccgtctcaaaaaaaaaaaaaaaaaaaaaaaaaaccaatcctggaatgaggatagataaataacatactttcatcatgtaggcagaaggttccttaatggcattagtggcagaaagaaaagtacctggcactttgtttatggtaggtgcctaagaaccgaatgctctgttagttggaaaagtctttgaagaaagacatagtgctgtgtcctcctttggaataggaggaaacaaagtacctctgtcccgccagagaagaataacataggaaatgcaaagagccatcgtggcttctgagaatcattttccaaagatgccaaacaaattcaattctaaaactatagcctactttttctgtagggaaagaggcttttgtgcttatctaaatctagacagagttgatctcaaccagaatgctgtaggacaaaggacatcttatagccacacatgttcaggatgaaatggaccatggttggaattaaggagaacctctctctctagctagactcctacttctatttttttacctttttctattcctcatcagagtcctaaggcaccctgagcaaagggtaggatatctggcttatgtggcattcatgtgaagtgtgattgctcttattcactatggaactgctaaaaataacttcccatgtgggttcagtaggaaactttattatccattctaatcgacttgacctgtctgggagagaacagactgctttataattctggctcctccccagcatcaccttttcagatggatgaatttataggtaagtccaaggaccctctggctctcggccaagtagaaccgttcagccatacaataaagttgaaccacacccgctactattgattactggaagctgcctcttttcagtagcattgggttgtgtgaatcatttggtgtgatttcatgttgttggctacatttgtgatctgggaaaattctggttcgcatcctaaaagccagtatttcccccaaagcaggccatcctcagtctgtgactgccagtacttgctgaactcaggccttgagagttggaagttatctctttctgaatgcagcatttctgtatcaaatcagacccttgagttgtgccgtatcccagcagttttaggcaaaggccaatcatttcatctgcccttgggaatccaaagaatgaatctcatatgggatatgatccaagtaactttgataatcctcttatcttctaacatttttgcccacagtgctatagtatttactttgggattggaaccagatttttccctcttaatcagcaattttgatatctggctagacttttagaggttctctttttcatcattctttcggattctgtcctgttgccagagtttgttgcttctttttgtttttgtttttgttttttgagacagagtcttgctctgtcacccaggctggagtgcagtggcacaatctcaactcattgcaacttctgcttcctggaagttccaatgattctcgtgcctcagcctcccgagtagctgggattatagacgtgccacaccacgcccagataatttttgtgtttttaatggagatgggccatgactggtcttgaactctggcctcaggtgatccacccacctcagcctcccaaagtactgggaatacaggcgtaagccactgtgccgggcctatgtttgtcacttctgggcagacaagcttatggtatctgccagtaggtcacatttttttttaatcttttttctttttttaatagaaatgaggcctctccatattgctctggctggtctcaaactctcgggctcgagcgatcctcccacttttgcctcccaaagtgctgggattataggcatgagccaccacaccctgtccaggccaagtttttttaatcagaaagagtttattatcaggaagaaccagatgatagcagaacaaggtgctgtttgttgacatagaactaacttggaaacagatactacttaggggaaaacatgtatcccatatttcagagtatggtttaaatcaaaattggaatagcagatgactcttctgagagcaatttggatatcattcagttctgaagtagaaagagtttgtgggatggaactagcagggatagaggaccactgcatgtggagcctgatgaagtccataaccattgggaagtggcgcgggcgggtgaggttatgaagcagtatcctaggggatggtgtttttcaagttagagataatgacccataggccaggcacagtagctcatgcctgtaatcccagcactttgggaggccgaggtaggaggattgcttgagtccaggagtccaagaccaacctgaacaacatagtaagaccccatctctacaaaaattttaaaaaattagccaggagtggtggtgcacacctgtagtcccagctacttgggggtctgaggtgagaggactgctagagcccaggaagtcaaagctgcagtgagccatgatcacaccactgcactccagtctgggtgagagatcaagaccctgtctcaaaaaaaaaaaaaagccaggctcagtggctcacacctgtaatcccactactttgggaggccaaggtgggtggatgacctgaggtcaggagtttgagaccagcctgaccaacatggtgaaaccctgtttctactaaaatacaaaaaattagacaggcatggtggcaacacctgtaatcccagcgaatcgggagttccaggcacgagaatcgcttgaacccaggagatggagattgcaatgagctgagatcatgccactgcactccggcctgggcgacagagcaagactccgtcttgaaaaaaaaaaaaaaaaaggtaatgacccatgcaagccagaagtttaaattttggatcaccaaagcagacctgatgaagacattgcacctagcacctgcgcaccctgaagacttctttctggacatgtaccccacactaccccgacactaaaggaactacccaagcactcacattactttatttctatgttctctgtctttttcaatagagtctttggtctcttaggatggagtttcatggttcggttcaatataaagattttcacagatgccttttcatttagatgtaggtagaattgcctaaggctggtgaaggctaccagattaattccttcctttacttgtttgtttgtttgtttgtttgtttgtttgttttgagacagggtctcactctgtcacctagactggttcactgcagccttgacctcaggctaaagctatcctcccacctcagcctactgagacgctgggaccacaggtgcgcactgccacaccgcgctaattttttaaattatattttttgtagagatgggatctccctttgttgcccaggctggtctcaaactcctgggctcaaaatgatcctcccgccttagtctcccaaagtgttaggattataggcatgagccactacacccggccctttacttcattttttgaacatagttatctcaatactcttttcatcttatacaccttaatgtaagaagtcatacagttcagcccatttgtttttcttcactctgccttcctctctgctggtccccagaaccccctgtgttccaggactcctgacctccaggactgacagatacaggcattcactcagacttgaggagctctttgctgagtgcctctcacctctcacccagaccttaacacccattgttggcaagcctcagaaaaccaggcctatagacctttctcttccttcctattgcagcaaacgtaatgaaagagaaggattatattggcacttggccacctcagaaacactcttctgtctgagatcttattgcagatttatacagctatctttcattcctgaaaagtagatgggggaaaacaaaatagattaacaagttcgtaagtattggttggtgcaaaagtaattgtgggtttttttgccattagaaggaatggcatatttgaagttggtgcaattactttcacaccaacctaataagcctcttagcagagctgctaagaaagcatcagcattttttaatatagctgacacttttcctaatgatgctacaagaaaaaagagaggatgtagcatttgctggtttggagtggggtttttttgggttttgtcctttggggtttttgtttgtttgtttgtttgtttttgagacggagtttcactcttgttgtccaggctggagtgcagtggctcaatctcagctcaccgcaacctctgcctcctaggttcaagtgattctcttgcctcagcctcccgagtagctgggattacaggcatgtaccaccacacccagctatttttgtattttcagtagagacagggtttctccatgttggtcaggctggtctcgaactcccgacctcaggtgatctgcccgcctcagcctcccaaagttccagaccagcctgggcaacatggtcaaaccccatctctactaaaaatacaaaaattagccgggcatggtggtgggcacctataatcccagctactcaggaggctgaggcaggagaattgcttgaacccaggaggcagaggttgcagtgagctgagattgcaccattgcactccagcctgggcaacaaagcgagactgtctcaaacaaacaaaaggttcatcttttaaatttgaaaaaacttttattcaaaattccaaagagtgttttgggaatatgaactttatactgattttaaagttcatttgaaagaataaaacctgccgtgtgcggtggctcacgcctgtaatcccagcactttgggaggccgaggcgggtggatcatgaggtcaggagattgagaccatcctggctaacacagtgaaaccccgtctctactaaaaacaccaaaaattagccaggcgcggtggcgggtgcctgtagtcccagctactcgggaggctgaggcaggagaacggcgtgaacctgggaggtggagtttgcagtgatccgagattgcgccactgcactccagcctgggtatagagcgagactccgtctcaaaaaaaaaaaaagaaaaggaaagaaaaccctatcttagccattttttatgctaacaagcctttaaacagaaccactaataaactgtaaaattgactcaagttttctcctctgcttctaccccagctttccccaggttcagggttatagggagttttcatcacagagatggaccaggtgagggaagcaagtgttcttgcactttgaaatttcactttctcctttatattcttttgatttttttcaatttcattttttgtaataaagatgttagtggaggcccgacaaagtagttcatgcctataatcctaacgctttgaaaggttgaggcaggtggattgcttgagctcaggagttcaagaccagcctgggcaacatggtgaaaccctgtttctacaaaaaatataaaaattagcccagcactgggctcatgcctatagtcacagctactcaggaggctaaggtgagaggattccttgagcccaggaggtcgaggctgcagtgagccaagatcatgccactgcactccagccaggatgacagagtgagactccatttcaaaaaagaaaaaaaaaagatgttagcaaggcataccccacttgtggagctctctgacctaggacatcaacatacttctcagctgttgaccttgcattctgtctctcaatcctgttgtatcattattttattcatttaacaaaatttacataatcttactatgtataagcattctaagtgttttacatgcattatatttaaaacgcatgataactttatgagtaaacactgttaaactgatttaacacatagggaagctgagacacagaaagtttcagtaacttaaccaagttcacatagagagtggcagacaattcaggcaatttgtttccaaaccactgtactacactgtctccctttgatgtgagctctgggttcctgcctagactccacaaatacagggtgataaccattgttgaacaaataaatttggaaatgtcaaacctttccccacccctgccagaggctgcttgccttagtctagtttagccacagcacccatctgcccagctgttccgagggctgtaggggtaccctggaggttcatgctgctgagtgccccgggctcagcagccctccctctgcacacacacaggcttgcctttgctggccagaggagccgacaggtctgtatgcttctccggttgcagaactcatcattggctggctgtcagccttaaacattttcagtgagcagagtactttgcaattagtgaatgtgtcttcttgactggagttgggtggtgggctacgggtgctatttagagccagggaaactaaggggaagtagatgatgttcagaaggaaggaaccccagcagacgagttgtttcatcagctcctagaagcctctgctcaagccttcctgctgcccttcagtttaggccaggactctttcagccttcccacctgtctctaacaaagttgagaccaaggtggtagggctgtggatcctggggaaagggtcaggggcgtgttcatttttgcctggagcgagtttattggcttatttgtttccccagctcctcaccgggtcttccacttggctctgcctacagcccttgcttggggtcccccagagattttgaagagcacatctgtctccgctggtcagcactgaagactcagaaaccacctatgctgccctggttaagactagggtctcaaccctccctcctcatgttctgaatgaagagaaatggactggagggctgtttaaaaattaaagctgctgggtgcggtggctcacgcctgtaatcccagcactttgggatgccgacgcgggcggatcacaaggtcaggagttcgagaccagcctggccaatatggtgaaaccctgtctctactaaaaatataaaatttagccgggcgtggtggcacacgcctgtagtcccagctacttgggaggctgaggcaggagaatcgcttgaacccgggaggcagaggttgcggtgagccaagattgtgccactgcactccagccaggctgacagagtgagacttcctagtaaataaaaaataaaaataaaatagaataaaaattaaagctgatgacaaggcattgtcattacacttagagaaggaacagcccttcgcaagtatcctcagggtagcgtgtcccacgttctgggctggtcctggcaacagtcttgctgctgaggttccaccttaagacttcaacgtcatattttctgaaactataagaccaccgggcgcggtggctgacgcctgtaatcccagcactttgggaggccgaggcagatggatcacgaggtcaggagatcgagaccatcctgactaacacggtgaaaccccgtctctactaaaaaatacaaatattagccatgcgtggtggcaggcacctgtagtcccagctacttgggaggctgaggcaggagaatggcgtgaacctgggaggtggagcttgcagtaagcctagaccactgcagtccagcctgggtgacagagcgagactccgtctcaaaaaaataaataaataaaatacaaaataaaaaaataaaattataagaccccaccctgccttactgtgctgtaaaacaaacgtacattttactatgcattccaactgccaaattaaattaatatagacatttctttagggaaaaacattctatctttttacactagacaatcttcaccttttcacatccctgttttctttgaccttattaaaaactttttaaaatatgtatgttttctcagcagaatttaatctcagcaatgctcaatagaatttttttttttttttttttttttgaggcagagtcttactctgtcttgcccaggctggagtgcagtggcacaatcttagctcactgcaacctccacctcctgggttcaagcgattctcctgcctcagcctcctgagagagcccagctaattttttaaatttttagtagagatggggtttcaccatgttggccaggctggtctcgaactcctgacctcaaatgatccggcctcccaaagtgctgggatttcaggcatgagccatcacgcccagcccaataggatattcttaacctggggtctatggaccctgagaaattctatacaaaggtatttgtatttttttttggtatctatagctttttttttttctttgcctccgctagcagcagggagggtattagctttgattgaatgtgtaactagaccagaggcattcccacccccacccccacccctgttcatctccagcccacaaaaaaaggttaagaacctctgctacagaaggtggtggtgaggatcatttaactttgtagatacctggtatagcactgagagtaaaaggaggagcaatggagaggggaggtcccgcagagctggagaccctaaaagctgaacctctaacaagctctgtaatcttaggcaagcaaattaacctctctaagccttaactgtaaaaattaggataatgatagttctgtactcagaaggaagttgtgagcattaaacaagatgattcctgtcaagttcttagcatagtgcctggcacagggatgcatcataaatataaaattctttagctgtcagcatcaatttcttctccatcattcctcacatatgttggagtgcacagtactatgtagacgctgctttcctgtctttaagacggatccgaatgcttgcctttcgcagatgaagatgtatgttgcagaggtggatgctgtaaaaatgggactagattagaagccctttctgtaaccttgactgaagaaaatacaaggtgacattgtttaaaggctctatcacttgcctttgtctagggctgctgttctcttctgcacatagtttgcggtcatgagtgtggcctttttactcctaaaatggcacaatgtgtcttcaaatctcaacagatgcattgtatttcaactctatcatgaaaggtagcttttgccattttttcctttttgtcaccaccatcatccatttttacttactgcatgtcccactgttccaactctttaaaaatgagagggatgatgccaatcctccacatgttagactgtaaaacacatctccttccacctttttctgtgttccttgttccctggacacatcagtatatgggcttgttctcacaagagtccactgagatgtaaatgttaatttaggaactgtattattgtttctccccaaaaaggttgctgatgtgctattccagtgtgtactaaatcactttttgcctcattattttaaagtttaaataaatgaatgtattaaatagtcttagtgtaagagtgcgttttcagtcaccataagcataatagccttaaaagtgctgttgtgttctatgacactgtgatactatttgtagcttttatccaaagatggtaagctcagtgcctcaggacttgaagcaggcagcccctaagcaactgttttttgtgtgagctgtgagtcccaggatacaagcctctcatcttcaaggtccccaaagagcagcacagctggtagctgtggatttttaggctgccctcctgtaaggtaaatggtcttttccacccactcccttgttgatagagtgccttgagagaaaatgaagacactagagtgctggtctcagactgcgctgaggcatcgcctgttctgtaagaaaaagcaaatgaagattcatgtgtattacaactgtttctcctttggaatcacaggccttttttaaatagagggggaggaggggatagtcctagacctgaaaagattccttcttgtaatataaggagagctgtgagctgtggatcaaaatgaagaggagtgaggggagtatgcagcgttgcctgtggctccagctgagctgggagctggcggcttttcctgggaactgtatgtggtgcagcaccttgggacagcagtgtctcttagtgtcttccacacgcccccctgggaaataggctttctttgcagacagggactttcccatttaagtcagctaacttttctctaagatgaatcgttttcattctgggaagcatgttggtagatgtcataccaggaaaataaccatttcagtcggctgtaattttgccttttggctatacacattgagcataattatttagggtcttcatctttttcctttcattgtccattctttcattttgtttttttactactgctacaaccaccaccactgccaccatcatcttcttgcaaatggctaagcagtgtctgcattattctaccttcacccagtaaactgagtagaatagatcttctgagccctgttcagaagcagctaaaaccgggacttgcccaggatctgtcagctcttaaatagtaagactggaaatcataccagatctccagtactctttctactgcccaatgaaactcccttcttccccttcactccctcttgccagcttagcctacctaggaagtaaagaaggcataatacaaatgaaaatcatggcctttattattcatctggttatgctagtacttggtgtggtgactcctttgcaggattattttaaagaatggtggcagctatgttttactcactttagaagtcaaagactcacggtaaatcttagcagaggcaaataaaaacatgataccaaaacctaacatctaaatctgtactgtccagtatgatagctgttagctacatgtggctatttgaatttaaatgcaagttgattaaaatgaaataaaatgtaaaaggtagttattagtcacaatcatatttcaagtgctgaatagccacatacgccctgagatactgaatttttaatttaattataatttattcacatttaaatgtaaacaggcacatgtacctagtagccactttaatggactgtgtagatacagaacatgtctatcactgaagacagttctattgggtggtgctgatctaagggctatatcaataacactgtggtctcctggcaagttgtaccctctctgtacaggggaggacaacacaaatacttcatgagctttgtcttccagtgaccttctcagctcataaacagcatggctttgcttttaaaaaaaaaaaaaaaatctacccatgtgactgcagtaatccgcagccagtaaacagcagggtgggagggttgcgaggagaactgatctatttttatgcactgcagagtccaagcaggaaaacctgagaccggagacagtggtgacatcaagactcacttcctagtgagtttattcatgactcaggccatgtgcatatttccacttggattcctcacaagtgcaagtttctcttctaggctacaggtatctgcagccaggtgctgtaatggatttatagtagcccgccaaaagatcaaatatctgaagcctgacgggtcacaaagctgacaggagccatgactattgcatgaattccagatttcacagtgaaacagagctgctgctgaaaaatgggagcacagagctgttcactggggctcttgattctagacactcaaagaggggtacagttctctgccccatgtgtgtttctcacccaaccttttcatggtgttgaggaggggaagggacagctcagtggtgattcttcacttctcaaacgtgtcctcctcctctgtcttcataatgacctcctgaagtccaaagtgccttccaaaatagctcttggaaagaggtggcagtttcctgactccccaatctcccccatcctgggagatgtgttgatggcactaatttgcggggtagcagagactatagtcctactctctttactggctggggcatcggaggcatgcagtaactgttgactaccactgctacaactgctgttatgattattaccattataatgattaatcactcacaccgaatgggaagggaagtaaccttcagaggttcactcttagtacttctggcacatatgcttagggccagggccagtgagtcttcattcgcagagaggtggtagtgaatctcccacaaggatccctacttcgggaagcctgtgttcctggtggaagtcccatcatatccctcaggcatactgagattctcttctctagaattaccaggccttttctgtcactcctcaggcataccccccgtagctggagggatttccagttgccagggttctttggtgcttttctttgcctcctgcagagatgctgagctgtggacaccttcagaaagaccagcactgcctcatgagagtatctcctgtccctctttgcgggtttaggttccttgtgtagtctgcacatccagaggggatgtgtcattctctctctaccattataacctggggtggcctcgggcattcatcgtttatatgccaggaattgctaacctaagctctgctatttgaaggcttaaagactgcagatcaaaagtagacacagagggcctttacaatgagatgataggccagtagctgtcattctttattcttagtgctcatctaagccatgaccatgtccttcagatgtagcttttagatacttttcatgtgaaagactggatacctctagtcgacatgtcagggccccaaaggaatcaagtccctttggcataccttcatgtcctcttttttttgtttttctgtacttcaatagatgcaaattcatttactctttggtctgcctgtgttgggtattctcagcttggggaaactcaatgagccagcacaccatcctatgaacagaacaccaatctgagccagggacattccgagcagacaactcaggtcagggcttccggacagattcccaaggtccctgccatctggcagatggacaccactgactgtggtctcctctccatccacggtgtcctcaaggccaagttacatgcttctttgtctcattctccttccctttaggtccgcagatctttcggagtctttgtatgtaaaggcagattttggtcttagattattccagctccttataaaccaagactgaatcttgtgcctgtcattgtgagcgctattctgtaaagggatttttttttctggcataccaaatccagagccataattggacaagtttaattggagtcatttctattcaatacatggatggcaaagtgggttttaattgagcatgtaaaaagggcattaatcactgttcacacaggaatcacaatattagaacaggaaaaattcttataaagtttttcaggttcttgggtaaaggggactttcctctttttatttatgcttccattaggattttgaaggaatgccagtgcactgttattaactctaatagcttgtccctcgcagccaggatggtttggggccctctggctctcaggttacctgtgtaaatacagggattcacttgccagcacccagctctgacatttgcttaataaagagcaaatgtgcagaacccaacagcagcagcagcctggcagaagcagtaatctgaacaggataaacatgcttcctctttgtgcgatgctctttctccatccttctgccaagagcaggatatcaaatgaaggggaggttgtggttggagtcagtgaagtgaatgtctaagtggcacctgcttcattcaacagatctgctttcctggggcctcccagtgcacatctgctcctgacaaagcctcttttctcctcctattggtcagactgagagcaaaggcctggcaaggagacatactggttttgctttgtcagcacaattgcctgtgacattataattacaccaaatcttcattattagaaaggccccaatttagagattttcagagcctaaatgggattttctaagtgaaattgattaaaaaaaaaaaaaaaaacaaaaaactttgccatcataaagcctagcaattgcatctgagaatcattgaaggggtctaaatatggaaaccgagacactgctgtgagtgagactacaaagaccatgctatcagattggctcgctagagaggcgtccagcagtcttccgactctgcccagcccatcctctccttattcccgtagcactgtaacatgcagatacctacactgcattgctctcacatgctgatagtttctcatgcagaggcctggtgggggaggggctggagggtgttaaaataagttgatgaggtatggcagtaaaggaaagaacctgtgacttaaataagggaaataccagaaatctatattttaggtgaatacaaagcatccaatttagattgagtttccatttaaacaaaggcaactcttaagagtgttgcacagtgtgagtgtatgtgtctgtctgtcggaggcacgtttatgatatggagttggcacactggaagctctggaaaggttttagagctgtgctctggctatttaaacttaattaaaacagaataaaatttaaaaatcagttcctcagtcacgctggccacatttcaagcactctgtagccactgtgtcggacagcactcaaacagaacgtgcccatcatcacaggaagctccagtggaccacactgtttgaggttggtctgaacctcttgaaatgcctcggctgcttaaggaagcctgggagtttctattgcaggcttgttggaaggaaaaaatgaaatttgcctcaatgtttctggaacaactccttccagccatgttacctagactgtgttctttttcacctttttgtatttttttctccaaggatttcatgtccttttcctactcctaccccttgtttaaaaaaaaaaaaaacctgaattataacaatgaaaaggaaatttaattttaggaatgtccactttcagctgaccttctccttggccttctcctaattaaactttcacagccctgctgttggaccagacagtccttttctcattaaatggagcaccttagtaaaacaagagggcatgtgaacactcgggccaagagtgtgtaaacaagttgtgcattgtgtggacaatgctgctgggtgtggaacgctgggctgccaacactttccattttcagcaactcttgggaccaaggacagggcctttaatcttgcttcttccatttgtctgtgtctagtagctactacacagttgctttgactcctggagaaagcccacgtaaaataacaatactacttcaaatttagacagtgtctttttttctcaagaacttaaatcatgtaagcatgatgttatttatcctcatagtggtcctaagatacagaagtggcctgttggttttacaaatgtgaatatagtcaactcttacttgttacctacagattatctgtcacgcagattactcgtgacacattttaaatccttgggcaatttctctgagcgagccagtgtaagcctggaccatctcctctgccccccgacccagctgctgggtacttagggaatacaaattagttttcatattagcttaaagaagacataattaggaaggtaagtctgctacaagaaaatcacatcacaaattccaacggcgagggggaaatatgagggaaatgacctcctctcccttcaactgaactaagatctggtggtctaagtgcacattagcacttggtgctggcatgcttgccgaaggctttcctcacgggtggaaggagcgaggctgtgcaccctgcaccagatgtgcatgggaggctgcaagcgccgcagcggggctggtggcccatcttgcccggtgcttttttttttttttttttttaacagttctgtgttattgtcaggcctctttatggcagatcgtgcaggtcgcaagtggatcctgactgacaaagccacaggtgggttcatctttggggaaagaaggaagcagctggaggatagagtcactgtgaggctgtcattccaggcgctgcttcctgcttggatggtgggattcctctactgtgcagtccccctcactcggtcacctgatagttttagtaaccattgattccattgattatctgatttttctagtgttaaatgtttccttttcatttattagctggaattcttttttaagagacagggtcttactacattacccaggctggagtgcagtggctattcccagactacaggttcgaactgctggcctcaagtgatcctcccacctctagttgggattcttttataaagaacttgtccccattaacaatttggctatgctaagtacagttcagataggaaaagcaggagaaaaacttgatgaagatgaactttattgggatagagttctttccatcttactctaaagccccattactgtctatttccacttactgatctgcttttttcaggtgtctcactgcctagagcaaatttaattctgccctttatgtgctcttaaaaagttttagtttttttgtggtttttttcctaaatggtgctctacagattatgctgagtgaggggatgaaaagtcacgagtacatctttggaagcttccttgcctcagcgtatccctgctcagatagaagaggcagggactggatgacaggcacatgggggttcattgtactcctccctctcctggtgcctatttgacattttccatcataaaaagtttgaagaaaaaaaaaagtttgaaagtaataataacagaaaaataaataaatctcccttcctaactctgagtaactcctgagtgggcctgctgttcatttctgcacctgactgttgcaggctcctggtgactttcttcttctgaggtttgtcatctgggctccactttccattttaaaatattggtgcactctgcatattgccatgatctatcctctgggacacagacttcaacctgagtgttgttcccacccttcttcctagtgatttcttctgggaatttactgggtaccccttgccctgctctgtacagtcagatcagatgtcctccagagcaggggtccccagtccctggcacggcaggaggtgggtggcaggtgagcaagcatcaccgcccgagctccacctactgtcagatcatcagcggcatcagattctcataggagcacgaacctattgtgaactgatgatctaaggtggaatagtttcatccccaaaccatccccctcaaccccccccccatccatggaaatactgtcttccatgaaactagtccctgctgccaaaaatgctcgggaccgctgctccagagcacgtgcatattccacaagcttcagcagaacgctttctctcctgccattttcagtttaaagccttcttggcagggtcaacaggccttgcagttagcttgttcatccccacgttgggagctcaattttcaggataataaaccatggtggttctgaatactgaaacacagagcgtttcataacgctcctgggcatcgccagtaatttcaagaggaaatcatgacattgtatctccaaaataggtcttgagatatatttactaataaagtaaaaatgaattcagttttaatatttggcttatgggatgaggggcatgaaaagcttcctggtggtctgcaaaagcaggcaaaagatagagtgagcctgtctcaaccagagtcactcctttgaatgttattccagaaagcagtttttcttagtcttgagatggtccagcaagagagaagaaaactctttgagtgctgaaaagcaccctgtgcaccaaggcacctgtgaggctgctcttggcttcatgagaatattcagtacttgccagatgtaagacatattttaatccataaatcccccaaatgtacccaaaagcttggacttaggaaacacggaaaagggagattaaatgtcccaaaagcagctaatagaacagaaacagaaccactgggaaagaaatgctttttctcttccccgtttgccctactatcatgaggttacttggacctcctttttgtttgatattgacattctcttcatgaccttcctcttcttgccctacatatgtcctctttccatctagtccttggtattctcagcctgtctaactgctgtctgcctgctagactagcttctttactgatttcctgttatcttcttccacttctatactggcacataccatgcctgtttttcttcatatagtggctttccttagacgtcagccactgatgtaaatatttttccaggcctgtaaatggaagatttttaaaggacttccttcctgcctgtcacccctagaaacacctatagataccgttgctggctccttaaaaactcaagcaatataatccggaatttaatttcttactcacgtattcctctcctttctaatcatggtcccggttcccatttgggccagtatttctttgatgtacatggttagcgttcatgttcataaactaaagaaggcattacgtaatgtaaatttccctttgggttttaagaattatttcttttccacctactgtcatgtttattatttgtttagctctctctttttctctcaacagccatcaatatttttctcccaactaaagatatttccatgaccaccttggaaggccttcaggctgaaagattcagttacagcaaacaacaattcccaaaggtttcccagactgtgagggcaaatgaaaggcccattcttcctcaggttgtctgtcctgctctatcttgtcgtggggtgaggggaggagggccagctatggtgctggataacttcaacagccctgcagccctgtgctctgcctggctcaagtctgttagtttctggaggacttcagaaatgtatcagggtgatgacatcacatcatactgccctgattgtatttttcacattcttaatattgaggagtggttctgcctggttgcttattgaccagtgcactcgattagcaaccacttcatctacgtcatgtgcagtgccagttctgaccatcactgtgtttcagaagggaagctgcctgccagtccatctgccctgatttcatggctgttatctttaatctttacatctttgaaggcctttggtgaatgatgtgcttcctggcaggagaaaatcactgctgaaaggagatctgtgttgtctctgcttttctttctgtttcccgagagctttagtctaacatctgtgaccccagccagactccatcaaacttcatactcaaagtcatctttgaaaagcagtggcatttattatatacctactatgtgccaagcactgtaatagattttaatgtgtcatcccatctatctagtttagcagccctgtgagatgagtgatcaccattttacatatgaggaaacaggctcacaagccattaaacagcagaaccaagattcacatgtaggtctttctgactgggaagcctttaatggaaataaacagcctactttttctcacataaaatgcacctgatctgcagcaccatgagaatggttgtggagaaaattcgacttcattctgaatcagagtaaaaggtgttaaggctgtttggtctgtggagggcaagactaaagggactaccatcaagtttctgaaattcatgaagagtatgatcaatgatacattttcatatcatattcaattattgagcacctactgtgttcaagttgctcaacattaaaagacagtcctcggccgggcgcggtggctcatgcctataatcccagcactttgggaggccgaggcaggtgaatcacgaggtcaggagttcaagaccagcctgactaacatggtgaaacccccacctctactaaaaatacaaaaattagccgggcgtggtggtgcgcgcctgtaatcccagctactcaggaggctgaggcaggagaatcacttgaacctgggaggcagaggctgcagtgagccgagatcaggccactgcactccagcctgagcaacaaagcaagactccgtctcaaaaaaaaaaaaaaaaaaaaaaaagacagtcttgccaacaatgcaagcatgcagatttatagacagaaaagcagcaactccttgggaacaggtcagcacatacctggggccaaatgaatggtggcggcaataaagtcacaggagggagaaaccaggtgggctgtcccctcagaggcaaccccatgaaccatgtggaaactgctagaagaactggcctgagactggcagggcctaattccagacagagagacctgcctgaggaagttcacatggcatccaagggacacatgtgattgtaatgaggggatagtgtagggtgttagcaggaaaggctacataaactccttcaactattagctatttagactttattttcctgataggagaaagcaaagtaatgtttttgatgggatgggatggcttttgccaaacaatattttaagatgttaaccatgataaacatacttattcatccaataatactgaatactgaaagaagttagccttgggaaaaataaagtccctcaaaataactaaataaattccatttccacggatacatgcacatatgtttatgtgtgtaaatttcattacacaataggcaagtgatgaaactcattgccccaggagagatctggaatagagtagattggctcatgaatgataaatccagagtgtgcaagactgtgaccctaacctttaaagcaaatctcactggtgcccgtggtctaccacagtgctcccctggtgccaccatcagagacagaccactgtaaaacctcatggccccttgttttgcagcgtgcaaggccaggcttatgaatagatatcatcatctgccacccatgtaatgtgatctgagaggcatcactttgtacggaagttttaaaagatccctctggcaggcgctaaagtagggttattacaaaggaaggcaagagatggtagtgtctgtccagggaggcagggggaaaagtgttgaatttgggttctgtatttgaagggagagaatcagctggtgcattggatgtgtgaagtaaaggatgacttcagagcttttggcctgagcaactagaagaatgttattgccatttatttgggaagagaggagacttgggaaaagcatgtttcaccattttggctcaagaatgatacacattaaaaaaaaaaaaaaatagagccatgtcaggcctcattgtccttgacagggaaacatggtcctgcagccagttcttccagagatttgggtccaactgctgcttgacgaggaaatctttatgttggcacctgaagtttctgagtcacctttgactttttttccattttgaccaattctataaaccttaccatgaagcttgagaagaaaagcagcagggggcccaaagaggacagtcctctcccttctggatccttcctggccctggtgttaagtgtttaaggacattctaatatatggaaaaagactcccaaatcaaaggcctgggtccctgactttaccatcaactcagtcatttggggaacaaaatcagtcctcctttgatctgtgttgaggtttttttttttaataaaatttttatgtttacttttgagttcaaataaaaagacgggttgtatttactaaactgagttaactccaaggttgtgtgtagctctgaaatactaaagtcttcaggacattagaagtatgtgcctttatgatgagcccgtggttctggctctgactcgtgaaagggaaggagccctgccctgtggacttctctagggtctcagcagaagtcaagtgacatgcagcgggggtgagagggctcagaaaggggctgtactgaggccaagggtctcattaccaggactctacaagggccctgtaagaaaaaggagcacttccaccccttaaagtagaacacgaagggcttcctgttgcttaatcaatcgaaatgacccagaatacaagcttggattaacatgcgcctctagattagggctaatcaggggcaggctgagcagatgcagggacagtcccagcctgattactgtacctcagcatttaatcatctctcttccaagggcagccgcccgacttagggcacgctgggtttccaggcctccagcccctccccctttcccttgccagggacatgaaggctgttaggtcagagacactgaggcgatttaatctaatcccatgtcaaaatggctgtgtgtgagagagacagaggtcttaaaatccctacagtgggatggtcatgcatttatttaaggtggcagtagacagaaactctatgtagaaaacagcggaattggggttccaaggcatgcgaggttatgaaatgactcccatcatggcctccctctcctgtgcttctaaggtgtgtggctgtcctcaccagttactcatccctgggagctttgggtggggaccatttcctcacccaggtgtggccaaatatgcttcttccctgtctggggtggagtacagaagatggaatctttcaaaaacagctttatttgggtgagtcttgaatatagtatttttgaagctgctttttttctgggctggaagctcttgttccagaacagcctcatcaccctaaggctcacccaccttaatcacgcagtccctagaagggacacaagttaaatcttagtaagcaggtttcattcatggtagtagaaaacattccagcacctgctgactgctggccactcaaagatggagacttaattcctcccttaaggaatctacggtctccttggggacaagacatacgagcagtgaggatgaatgaggccgctgtctccaaggagcctgtacagggagcagaggaggagcatcggagaagaggacccaagatggggaggagagaggctggggaggagccccctccaggcagaaggcatggaggtgtgtgcttggagaacctcagtcaagtagttcatctggctggcgtgtgaagtgagtggggattagtggatcaccaggcttaactgaacaacagtggccgacgtgaagagtttaaatacctgcaaaggggtttggactttatatcccgtgggccactagaaaccactgaagaactgtgaaggagaacagcaagatcaggtcagatgttcagaagatcattctgatgatggcagtatcagccaatagatagatttttgcattagaaccttgcttcatttattctggggaaaatcttccgtgatactatgaaaactattttaacaattgggcatgggcccacatcataggaaacccaaacacatcacagccagggtgaaagaaatttaactttgacaattcttttagtttctattcacaccagccctaacccagatggttgctcacagttagttagaaaagatctccctgcacactgtagtcactgtatttgtacagcaagggacttgttccccaagcctggagcttttggaactgaatggagcccagaggcaagagcagtgaaatgaggctgacctttgcttctggttttgcttgctacttgccagtatgtgggttccctggaggaacacacaggtgtcttggctttgccactgggcattttgggtgatttcgttaactttgcctgttttgaccagaagagagcctgatcgtgataggaggaggcgggggactgacggggttatacaatcttcacatatatatacactcagtcccatgccttgagtctagaggctggggagagggcccagctgcacgttggttgaggccagcagtacatggcccttgaggctatgctgatagcaacttgtggcacactttgtacttcatactgtgaggaacatgaaataagccagagccaggcctgatcttgaaagaaccctctgtcaagtgggaaggcctgttgcagacatgcatcaactggcccagctggcttatccatggctgtccctgggcctcctgtgaatccagaggaggctgctccagcattgataaggctgggatggggcaggttccacaaggagggaaagctcaccccagtgtaaaaggaaggagtgggggataagtctatctcatgaataacctgagcaaaggcccaaaagagtgtggctgatagattgggggaactgagagtagtctgggggtggggggcacctagaggacagggcacctgtgagagagtgagggagatgagactggaaagatggaccagggcaaaccacgaaaggccttgaagaccatgctaaatcatttgaactttgttacaagctttggaaaccttttaaaaaccatggaatttaaatgtttgagatgaggggagtaacattatggaaagatattttggctgggtgtggtagctcatgcctgtaatcctagcactttggaaagccgaggcaggaggatcacttgagctcaggagttcaagaccaacctgggcaacatagtgagacctcgtcactatttaaaaaaataaaaaataaataataataaagaaagataatttgagtgactgggaaggggtgaactgaaagagagattaattaaagacagttaagagcaatttgcaaaggtttagttgaaagaaattgaagcccacagttttgtaggccaaggcctggcccttctgcgtgcttcccccatgcccacgtgcacttggaggctggcctctctcctcctcctttcaggcctgcattgcaagtgtgggggcgactggccacgtcttccatttcggtgagggcacaccagaggagccagggtttctagtgatgcgtcaccataacagcaagtctcatttcatgaagtctcactgcatcatcaaatgcttaccccttatccctaaactggcaaaacttactcttagaaaaaagttacatacaatttaacattggaaaagaaaatcttatatttgattttttttgcattagaaaatattttgacaaccctttttaaaataatttttatcttcatcaaagtagcctatggtttaaatgtcaaaaagaactaaaaggggcctctctgggtcagtttctcaatacagtgggtgaacctcagaggcccagtcagcaaaggtctttgggtctggatgttggggttggtctaatcaattaaattcaaactttccactcattctcatttttagcctcatccctctttctgccgtagctaggcctctatgtgctgagccctgtgtgagcataggagttgccccttccacttctctgttcaatcagaaccatttcacatttgctttgcatcttcccaaaaaatgttgacatccctcggttatatccttttttcctcattcactgtaattctagtttcagaaggaagagagattgatgtatatgttagttactgccttactgggaatccttttttttaatgtattatcagctttccctttttaggcaggactacctttatggaggttatgtgcttcttcctttaagccatcctttctactctgaaataatagtgatattagggagtagctggggtcttttttttttaagttgaccccaaaatgtgtttttacattttactggtgtgtgaaatctagaaatcaggaaacaagtgacctaggctttaaaaataaataaataaataaaataagcttgactatgaaggaaggcacatagacggagcagtggccagaagacaggataggagagggacaagatttttcttttcaagctgagagagacttaagcataggcagaaagagggttgaagaaggcagtgtagccaaatatcaaagaaaaataatggtggcctgttctgagagggagaagacaggccggggacattcacacctgacgggcctgtgcttcctagatgcggaggcaggcagggccctctcacggcaagctgggaaggccctaccctaaggcatgtttccacaatttctctaaacttttcttttctgatagtctgttttaaaaaaatcaaaatggtcagggttggtggttcacgcctgtaatcccagctattcaggaggccaaggtgggaggatcacttgaggccacgagttcaagaccagcctgggcaacacagcaagactccatctcaaaaaaaaaaaaaattatattagccaggcatggtggcacacgcctgtggttccagctactcaggagaccgaggtgagaggatcacttgaatccaggagttcgaggttgcagtgagctgtggtcacgccactgcactccagcctaggctacagagccagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtagagagtagaataatagttaccagagtctggggaagggttggggaggggggcaggagaggttggccagcaggtgcaaaggaagaataagttctggtgttcagttacacagtagggtgactgtagcgaataacaatgtagtctgtgtttcaagatagctagattttgaatgttgtcaccacaatgaatgataaatctttaaagagattaatatggtaattttcttgatttgatcattctacagtgtatacatgcattgaaacatcacattgtaccccataaacatgaacagttactatatatcaattataaatcttaaaaattaatgaaaaaaattttaatggggtgggaaagagatgtctttgtgcctgggccatgggtatgtgatcacctgaggctggtgaccacgatacctcaaaggcaagacttgggtgcccccgtccagccagcatctgggaacttgagcctgagccccaccaacggtcttctctttgtctctccaggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatacacccgtgggagcaattttctctactgtctgtagcttcacagaggaggcgctggaatgaacaagaagagacatctggtctgtggccacagcaccctgaacgcccctgatcttgtgtgatcttggaagctaagcttggttgggcccggtcagtacgcggaagggaagaagggacacctggccatagaaaacagctgagggtgtttgctgtgttcctggatcaggccctgcttcagaagggactcctggaggcccatgttccttgatgcaacctcgtggcccaggccgggagcagcttgcctcctcagaggtgttgactatctgggtgttcttggtaaccgttaactctgtctttctcagctgcaagccctgagtctccagtagctgaattcacctgacttttcaacaggccaaatctctgaaccttgagtacagggacagctcctcctccctcctcccagctctccccatgtgtgtgatggtgtatttaatgtgtttttttaatgcgacattaaaagattctccacgtcttgctcaacctttgagagaagtttcagattcttgtatttgcttgttttatataaaactatctaatgttctttatatgttcttttctgtacgtaatggggggaggggagggaaatttacatataaatagtcctagttctacaatttgttatttttttaattattattttttatcgtcattgtgaagttgtccagggactttaaagtccatgttcctttgtggtgaaataacctccaaatagtttgagaagttgccaagacgaagaaaaaagcaaaaccccagtagcagagcatggattctgtgttgtttcccattctgtctttgactgcctcattcaataaatagttaaaaatgtggcaacaggaagtggaattgttcatctctataggagctcttggcttcttaggcaaaaggaactctatcttggggcagctcgttctgcgtttaaaatgcagtcctactcgagatcagcggtctccgacctgtgccactccgacgctggggacctccgtaaagaagacactgaagattgcccagagccccctgcgagccccatcaccagacctgctccatttcatacatttcatatataacgtgttttcttatactgacgttctggggaaaaaatcgtatttaaaaaatcctaggccgggcacagtggctcccgcctgtaatcccagcactttgggaggccaaggtgagtggatcacttgaggtcaggagttccagaccagcctggccaacatggtgaaaccttgtctctactaaaaatagaaaaattagctgggcatggtggcgggcgcctgtaatcccagctattcaggaggctgaggcaggagaatcgcttgaacccaggaggcggaagttgcagtgagctgagatcacaccactgcactccaacctgggcaacagagcgagactccatctcaaaaaaaaataaaaataaaaaatgagggtgagtgatggtgcctctccatcttgggaattactattaaagtgaattgtctttctttctccaagcagaagcctcaagccatgacttgttcccctgcatcctcactccctggtttctcacacagcttactcccttaacatggcatatgccatcgctccagctgttcctcctgccccatccttaggcccttcatagaccccagtagcctgcacctccatgcttctgcatgccctggcctcagcctggaatgacctgctgtcacccccaccaccctttctttatattgttgggtgtcttggccactttcctggtgaccatgattagaatgcttgg

SEQ ID NO: 15785 - DNA, 10427 bp, Human
agctgctccccagagttgtccttggtctaggatggggagttacagaaggcttccacccagggctggcttcatggacatgggaccagtgaatcacacagggacctacactcaaaagggccttgtccttgggatttaatgttctgcagcagctgtcttgaatttttgttgctgttgttgtttttagcacaccagagttgtaaagtatgtcttgaaattcttcataattttatctttgaatctgcattttgtaagtgaaaccctacgggacaatggagcatgccctgaggacttggagcctctgcttgcacaggctcctgccttccacagcctccctgccctccacagcctccctgcccctccaggacatgttctctaaggcccactctcccatccccaggtgctccttcctgcttccacccagtgactgctgccatctcctgaccccagagtgggcctggatacagacatgaggaaggtgggggtcaggtgtcacgtcccccagtgttgcatggcagctgtccccatcccgggctcgcagtgccatagtgcaattcgccaagtgactgagggtgggggaagcctcttgcccaccctttcccccatcaaggtacctagtatgttccttacagaggttgcaataccctgtgggttggggtggtgggcaggtgggaaggggccatgtctggctcaacttctgtgatgctgggcggggcatggcatgttggtctggtggctggagggaaagggaaatgcacacacactcggtctctggggtgctgggtagctgtgaggatctgctctcactctatgaataccccaggggagtatgacatcaaatagcaactaaaagacacgatgccaggtcaagagagggactacagaagattagaaatgtctttgtatttcaggctgggcacggtggctcaggcctgtaatcgcagcactttgggaggccgaggccggcggatcacttgaggtcaggagtctgagaccagcctggccaacatagtgaaaccccgtctctactaaaaatacaaaaattagccaggtgtggtggtgtgcacctggagtcccagctactcaggaggctgaggcaggagaatcgcttgaaccccggaggcggagtttgcagtgagctgagatcacaccactgcactccagcctgggtgagactccatctcaaaaaaataaaaaagaaacgtctttatattttaataaatttaatggcactttcccccactttttgaacaaggaaccctgcattttcatttggcggcaggcccagcaaattatgcagctggtcctgctcctagcattcactctctttgtggagctgccttcggtgcctccctacttcatagctcagggaggagatacaagctcatagcaacagcttacatttatgaagcacctactatgggccagtaaccagtttaagcccttatctctattaatttatttaatcctcctaacagtgctacaaaggattattatgccccccttgtggatgaggaaactgaagtgctatgaatagaaagagcactgaattgagagttcagaaaccagaatgttcattttaactcctcactgacctgctgtgtgacctggagcaaatgtgtaaaactcagtttctttgtctataaaatggggggaaaaaatgaccaaccttgcagtattactaatcccatcgcatgacagaatggatgcatacctgccttataaactgcatgaaagggactcctcttatatttaaactgctatgcggcaactgcaggtggtccactgagaccacctaaaaaaacctctcattttagagaggagtaaaccagctccagcccctgctaagtcatgctctctaggtgtcggaccccagtgcctaggacccatcctggggtggggggtagggggaaataaaaataacagaattgaacataggagtgaaaatggtgcttgtaaaagaaagctgtgtgtagggtctcagtttgtgatggttgttgctgtttcaggtaataggccactggtgctgaattttggaagttgtacctgaccttcatttatgttcaaatttgaccagttcaagaggcttattgaagactttagttccatagcagattttcttgtcatttacattgaagaagcacatgcatcaggtacagaaagattctctgcctcttctacctcttcccactgtcttttctctctcccttttccccaggccccatctcaaggttgggaggtggaaggaggaagaggaggggagagggaaagagccactattcactgagcacccaccactcccaggccctgcactgggctaacctcacagtctgtgctttcaaccagggtacagagagcagaacacctggagtgacagggtctggctaggagaggattctaacattttgatcggataaatagggaagtcaagggagaagaactgatttgaacacatttacaaagaattcagacccaaaatgtcacaggtgaaatgacggccttatggctatttttttttttttttttttttgagatagggtcttgttctgtcgcctgagctggggctggaatgcaatagcactcacatggctcactgcagcctcaacctcctgggctaaatcgatcctcctgtctcagccttccaagtagctgtactgcaggcatacgccaccatgcccagctagttttttgtattttttgtagaaacagagtttcaccatgttactcgggctggtctcaaactcctaggttcaaacaatctgcccacctcggcctcccaaagtgctggaattacagtcgtgagccactgcacccagcctatatttgtatttttgaaagaacactgtggtgaagaattaggagaaaaaatagtacttaaactcagtatgaattagaatcatctggaaggctgttaaaacgcagatgtctgggtcccatttctagtccatccacgctgacgcctagggtttgcactacttaacaaacttccaggtgacgctgatgctgttagtctggggacacacacttagagaactactgatctaaacccttgcctctccaagtatggtctaggcgccagcagtcttggcatcctgggagttagatggactctcagttccaccttcgacagaccgaatcagaatcttcctataacaaggtccccaaatgattcatgcacattcaagatcaaggagtgctggtttattggactatttcacgttgaagagcaggggtctggcagacagaagccctgggcttcagttctggatcaatcactaattcctgacgtgaccttgcacattcaaccataatgggaaaccaggccaaatcattgccaagggctcctctgagaacctcagttaaaagtgaggggctatttagtctgcaggaagtgtgtgctgtgtcaatgggactcggtgcctggcctttctcttgtagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaaggtggtgacctggggacagggggcccagggagggcaaaggggcccagggagggcaagggcaaagagaaggctttgcatcaagcagaactggattcaaatcaccacccagccacttaccagccatgtgaccatgggcgagtgctttcacttcttggagttccttcaatttcctcttctgcaaaatgggaatgttggtctccacctcacgggggatgaaataatgcacacgaatgtccctagcatttggactggagctgcatcctcccggcttccttttgaacccagatgatggcccagtcctggtctggtttcaaactcagagacagagaatgttgtttttgttctctgttttttgggtttctttctttcttttttttttttgagacagactctcactctgttgcccaggctggagtgcagaggggtgaccttggctcactgcaacctccacctcccgggttcaagcaattctcctgcctcagcctcccaagtagctgggactacaggcgcacaccacgcccagctaatttttgtatttttagtagagacggggtttcaccatgttagccaggctggtcttgaactcctggcctcaagtgatctgcccgccttggcctcccaaagtgttgggataacaggcgtgagccaccgtgcccggtctgtttttgttttatgaacaatgttcagagaggggaattgacttgtccaaggtcacgctgggcaaggctctgatttcaattctaaagcccttgatcgggtgggccagaaatgagaaggtctgaagctgctaacatttgcggcaggcctgaaccagggctggcggggtagaagtctcaaggggaatggaacccgtggtttggagctggaaatgctggacgcagggatgtgcggcagaaatgcatttcaggctccctttcttgtgattgcttcctctcaaaagttccagcctggtcagggtgagggaggtaagcacagcctctgactctttagacacagttggcttggcctcccttaagaaggtagaaactacattttaaagctattgaagggatttcaagccttggagagcagatgaaaccaagtatgtggatgctcctctgtccacagatcaagatcaagctgaccctacctattcagataaaacaagcaaaaacttgcaggcaaattcccaaggtgcaagggtcacagtagaagaatgtgggtccttcatcctttcctgtaccttgggacatggttcaggcatgattgaggcaccctgggcactgaatccctaccttgggttaggccctgtgcaaatactggaaacacaaaaatgaattgaaaatgactcatacctagccgggtgcagtggcttacgcctgtaatcccagcactttgggaggccgaggcaggctgatcacttgaggttgggagttggagaccagcctgaccaacatagtgaaaccctgtctctactaaaaatacaaaattagccaggcgtggtggcgcatgcctgtaatcccagctacttgagaggctgaagcaggagaatcgcttgtacccgggaggcagaggttgtggtgagcagagatcgcaccattgcactccagcctgagcaacaagagtgaaactctgtctcggaaaaaaaaaaaaaaaaaaaaaaatgaccggccgggcgcagtggctcatgcctgtaatcccagcactttgggaggctgaggcaggcagatcacgaggtcatgaattcgagaccagcctgaccaacatggtgaaaccctgtctctactaaaaatacaaaaattagccaggcatggtggcatgtgcctataatcccagctacttgggaggctggggcaggagaattgcttgaacccgggaggcggaggttgcagtgagccgagatcgcaccactgcactccagtcttggcaacagagcgagactccgtctcaaaaaaaaaaagaaaaaaagaaaatggcccacacccttacttcaaggtactcacaggctgagggataaggaagacccaagtaagactattacagtgtcccaactgctgggggactccagagcaggggtcagcacgccttttctgtatagggcctgatagtaaatattttcaactttgtgccaagtaatccctgtcgcaacaattcaattctgctgttatagcacaacagcagctgcagacgacatgcaaatgaaagcatgtgaggcatcaggactaacctggctctcagactgtaagtttttcaacctctggggaagggtaggcttctcagagggggcagcaattgcttgggccttaaaggataaggagttggcctagtgagcacagtgagtgaaaatcactgcggtatagggaagagggtgggtggaggcactgaggcatagtagggcagagtgtgaataaacgattggagacattggggttacacaggggtctcattctagaccaaggggtttggtcttcatcttagggcaaaggagagccactgacgggtttggagcaggaaagagacatgatcggacctgtacttagaacgttcactggctcacggctgtaactctagcactttgggaggctgagccgggcagatcacctgaggtcaggagttcaagaccagcttggccaacatggtgaaaccctgtctctactaaaagtacaaaaaaattagccaggcgtggtggcgtgtgcctgtaatcccagctacttgtgaggctgaggcacgagaattgtttgaacctgggaggcggaggttgcagtgagcaaagattgtgccagtgcactccagcctgggcgacagagtgagactctctcaaaaaaaaaaaagaaaagaaaaagaaagttcactggttccatggccgggcgtggtggctcatacctgtaatcccggcactttgggaggccaaggcgggcaggtcacttgaggccaggagttcgagaccagcctagcccacgtggcgaaaccctgtctctactaaaaatacaaaaattagccaggcgtggtggagtgcacccgtattccctgctactcaggaggctgaggcaggagaattgcttgaacctgggaggcagaggttgcagtgaatcaagattgcgccattgcactccagcctgggcaacagagcgagactctgtctcaaaaaaaaaagaaaaaagttcactggttcctggttgaaaaatggacaggagggagcagggactaaggactggggatagctgggaggggtggcagctgcccaggctgtaggatgaaaagggctgacctagggcagtagaactggagaggcagagatggttctgaggtaggatgggtagaacttgatgtgaaggctggagaagattaggccagtctgaaggtctgattatggaagaaaagcttatttgtacagaacccttctctttttgaaagactatgtcactttatgtcctctagtttttctacttctctgtccaaccttcctgttaactgctgatgccactgtacacactttctcaaccacctcacggttgcatctgccattgaattagccatgctgatggctcctacacagacatcatttgaccacctcttgcaactaacctccagacctacatgttccttacaacttggaaatccttaaaagttgggaatgcctgattcgtttctcttgcagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatcactagctcagatttttctgatctaagcaaacaactcccagctgaggaatgcaggccacagcacccaatcaagacaaattgttattatcagaaaatgaagcaacacttgagctgttcaggccagttccctgttgaagaaacagttccctgttgaagaaagtagagcctgacactgctcccactttggagaccacattccctgcacacggtctttgagagagcagttgcactctacaggcacacttctgaggtacggtatctctctccagccactctgataccaagtaattcaagctggcattccttctattagggaaattcattttacccaatttgcatttatggaattgatcatttaagacactaaattagtttttagaaccaattatgggaagaattccagttgttaggaagagatgaggagttggaagaggagggattagaaacaggaggaggcagtcatcctctccttgccaaaagatttaaacctgtccacattggtggtgatgatgggtgagtttccatggtaacacatccctaattttaccagggaagaggagagtactcactttaccatctttgaatatatttcatagaaatctagctctctgtaccctgaaatcttccactagcctcacttttcaacagagtcatctagaagggagggttggcttcccaaaagcataaccttgaccaaaccaaacaataggcaccagcaatgctgtcattcagttatgcagaagctcatttgtgaaattctgtttctctgatttcttcgcaagtctcttaatggtcatttgtgttagattacatcaaactgatggatagccattggtattcatctattttaactctgtgtctttacatatttgtttatgatggccacagcctaaagtacacacggctgtgacttgattcaaaagaaaatgttataagatgcagtaaactaataacagaattattaaaatatatcaggctattttggatggcttccgtgtgatctttacattttcttttccaatttgtatctgattacccagtgtaatctgaccagcaaaaataccatacgctgaaagggcctcattttgggggaagaacattcaggccctatgttacatgttaaatgtggttttgtcttatgaactcctgctggagtgaaataatttttcacattggaatcaaattacctttataacatgacataaaagaatggatcaggagaccttttgctagcatgagaacatattctctttagctatactttagttgctacaaagttaatattattaatgttgtcactttattattttaaaaatagttattgcaagaggctgaggcaggagaatcacttgaactcaggaggcagaggttgcagtgagccaagatggtgccccttaattccagcctgggtgacagagcgagactccgtaaaaaaagttattattaatcatctaccaggcacagtcactttcagatatgttatctcatttaatctctatatatctcaaagaggagatgattatccccattttacagatgaggaaatcaaggctcagagagttaagtaacttgcataacttctcagaactagtaagtaacaagccgagattcaaaccggatctctaacttcaaggccagagtcctagctctgttcctgccagctgggtgactttgatcaagctgccttggtatcttgacctataaaacagggtatcaatagtgcctagtccatagattcatgagtagagcactcagaactgtgcctgacttggagaaagtgtcatgaagtgttggctattattacgattatcataattattgtcccacaactgcttcctcgggcccttttttggggggttggaggtggaaggaggacaagacaatatggatgctgaataaaaattccccatcctaccaaagccactcatgaccaacataggcatgagtttgtgaggctatactgaaaatgagaagctgtgacaatgatgggactgaagcacagatgagcactcactgttcctcctaagtactaagttgcacaaaaggagacaggatgtaaggcaagcctcttctgaatcacttctctgatggtcttccaattcgtgtctacaaatgcacagaaatctccccattttcactaaataatagtagctggaactgaggagcttttcagaatgacaaaaatagacccccggctttccaattagattctcttcaacttaatgcatcaaacattgagcattgattcttttctgggtgcagagttatgcaaagatggacgaggaagagctgttgtcctccagcagcttaatctcacaggggaccagacatacactccaatgaccataactcaaggtggagtatatgttagagtgaagactaagtgctcagagggcacagaggagacagcaatcctctgagctgggtgaatccaacaatgctttttggagctggtggcatttgagctggtcttcaaagatgcccagtacttccataatttgggatgggagcctggagaagatgggaagggagaagggcatttcaagtgaggagaactacaagggcaaaggtgggaaaagggctatgtgcaggagactgcaagaggtttgggttcaattccaatccttttgttttacagttgctagccataggccagtgtagttcaatggttctcaaacttgggcatgcaacaaaatcacctggagggcttgctgcaacacagattcttggttctcatctccagagtttacgattcgacagatctgaggttgagctagggaatttgcattactaacaagttctcaggtgaggctgatcctgctgtcccaggaaccacactttgagaaccgctgctatagtaggtgttgttggtgctctgcccagatgccttttaccaagccattgtactcatgagccagctgctgtgagtgttggctgctaatggctcacagatgcactctttcctgagaatttgccctc

SEQ ID NO: 15786 - DNA, 35629 bp, Human
  misc_feature (1)...(35629): n = A,T,C or G
tgtttgattttcacccctgagcgtccagtgcctaccaacatatcaggcactcacttttgcttaatatgtatttagtgaatctgtgaaatcctttttcagggaaaaattaccaaaactgagaaagtaaagtagaagattaatacaatcagaacagataaaatacaaacttggcagggtgtggtggctcatgcctgtaatcccagcactctgggaggcccggggggggaggggattacctgaagtctggagttcgagaccagcctggccaacatggtgaaaccccatctctactaaaaatacaaaaattagccaggcgtgatggcacatgcctgtaatcccagctactcgggaggctgagacaggagaatcacttgaacccaggaaatgggggttgcagtgggccgagatcgcaccactgcactccagcctgggcaacacagagagactctgtttccaaaacaaaaaacaaacaaaaaatacaaactcaagggctcaaaagcaaaaatctggagtggaactctctagaaatgagatacattgtgtacacccctcttaaccaaagcccaattctaaaccgccaaaattaaacctcttatattagctagtgaacattgcactcacttgaaatcttcatttttgataaactctacaatgatatccttctcgggttgaatttgaagcatcttcaaggttaaacacagaaagggtgttggttttatgttgccaccatagacgccacccacaaaccttaactccatggctttatcgactacaagttcagctaaaaaacaaaaacaatacagtaacatattagggctaagctcttcctagttggagtggagttagttcaagctttggttctcctaaatatacatcaacagtgtaatattaggagaacgaatgtgtattaataacagtaacgacaacagctaatatacattgagaatggataataaaataggtaccctgctaagcttttcatattatctcacttaaccttttttaacaagtcatgaagaaagttctagcaatgttcttatttccaggtaaggaaaatgagggctaagaaaggtaaagtgacttgctcaaggtccacagattgtcacaggacatggatttaaagccacaattcaaatcggaagattacctggaagacttctctgaagcactgatatttataaatactggaaccggcccagatctaagaatagtaagatcatgaatttggtttcaggcatattaacgttaggtccttaaagaccttcaacagattgtgtcaaagtgttatatccggatccctgagcttaacactgttgcaacccagcctgctatcattaaatacggaataactcacaacacccaactgagacagccttcagaatatgaccttaccagattcatctgtgcctctaatactcaacacaagacgaggcacttagcaggcactcaaaatttttctgaatgatcgacatactccgttccagtaccacccccagaggccagtcgctagtcctacccgcgctcggtcaggagaaatgggccacaagggggctgagaggcgctccgcgcgcttccacttacctgtaagtccaaagcactcctctttccagtacttggactcatagattcgcgttcgaatgatcttctccaccagatattgagggttggtgccatggatgctgtgcgcatccttcactgtacggttagccattttagaatgccttcaattctatttccgtcggatcctttaatgcctcacatccaggttcagaaaaagcacctagaggaatggagaaaggtggaagaagtttcactaaacagcttaggcgaccatcttgaagccggaaacaccgtagtgtaaagggcttccgctccccgcgtcgcctatcgaatcaatgatggcggctgcatgttagcggatgtacgtcatgcgcccctcttaggtgtacggagtgggcggggcgagctagttggtgtcgcaacgaagggacggtctgggggcggggccacgccgattggcgcgaagttttcttttctccttccaccttcttttcatttctagtgagacacacgctttggtcctggctttcggcccgtagttgtagaaggagccctgctggtgcaggttagaggtgccgcatcccccggagctctcgaagtggaggcggtaggaaacggagggcttgcggctagccggaggaagctttggagccgggtgagtgtggcgtccagcgggctgcgagggactcgggggagggcgcatcggaacctctgaaactgaggacgttctctgtagactcagtcattgattcttttagctgacatgtaccaagcgcctgttcagtgccaggcactgttctgaactgttaagagcgttcctctgttccacactccgattcctaaaaggcttcccgcgctgcagggaactgagtttgcaggggggaaggcggaagccaacagcctagaagcaggagcattcctgccctccgcaccctgatgctcagtgatgactttccctccatctgcatttgtaaagcactctacttgtttcgttctttgagctatagtgtaggaaccactacagggaaggcggagcagaggttattaccccattttacggacgtaaattgcgcccagggagggacgtgtcttaggtcgcttttcgtgactaagcagtctgggctcctacccagatctttttttcagatgagctcctaactgctgggctgtctgtcattcaccttcttttcagaagagaagtctggtggcccccttcctacttctcttttctaaccccggaattgaagagtcttctgctgtgacagttggaaaaggcattcttatcctgatctatttgtgaaactgcaatgattatatacgattctagttgtctgtaacacatgaataatagtaccctcgtctctgctgtgttaggtgggctggaaatgccaaaggagtttccaatatgacagaatggtttaagtccctttgcaacagtttttaactttaatggagggcaatatgtggactttaggaggtttgtgaatctgccgaaattgaatgcaaaattttgcttgaattatgttagttccatagtattcatcaaatgatacttaataaataaaaccactgtaccttacaaataaatgcaagggattaaggtagtgggaaagtggatttaccattttgcattttttcacttaatcttccattatcctaaaatagtgcctggcacacgatgggtacttaataaatattggttgaataaacggaagattctattttctccattttgtgggtaagcaaattgaggcccaatccacaatgttcagtcagtggctgggaagcctgatttattgtaataagtacaccaaaagcaagctctcagttacatattaacattatccagtttcacacagtgtgttgtaaggtgaagtagttaagagcacagtaattgcagtctggcttttccgggtttgagttaaggctgtgccatcctgtataagataggataagttatcaccttgaagtgataataacatctacttttcttttttttattttgagacagagttctgctctgtcacccagactagagtgcagtgttgcgatctcggctcactgcagcctccacctcccgggttcaagtgatttgcctgccaccatgcccacctgatttttgtatttttagtagagacggggtttcaccatgttggccaggctggtcccgaactcctgacctcaggtgatccacccacctcagcctctcaaaatgctgggattacaggcgtgagccactgcgcccagcctttgtatttctgttttatccttgtgtgcattttataagcgtcatgaagacatttacaacccctgtatcactgtcttttaatttcactttgttagatgttttacacctattgttctgccttattcctagtatttctaaatgttacagtttcatttcttaggaattgacctttctgttttcctggatggaaagagatacggcatagtacaagatggacacagatgatactaaattgcctgtgtgtaatcttcgtagaccatgacttcaaataaaatgttttcttagtctaaaatgtatgggagtgtagcaggggcagaaaataagtctgatctcatttgaagggagggactgactatgtcttagaatccatcagataaataccaaatatttatcatggtaactcagagtttggactcttccacagaagccatggcacactaccccacaaggctgaagaccagaaaaacttattcatgggttggcaggcccttgttggatcgaaaactgcactaccaaacctataggtgagtgatggggtcctttggttgtcctggaaatacagcttctcaagctaaacagtcaacttgtatctagcctgttctaattactacagattgaccatgaatgaacaggagattagaactgattgtaaggagggttttgtttgatgcaagaagatggtgggataaatatagcagttagtgatggagcaaaattatggcaggctcataaaattttgtatgtaggataatgtcatgtctatttaaggtgagttctatataacttttgatgaaaacgagatgatagatgtttttactatgtctttcccagccctggagatctctgacaatttgacattgttactgggcagcttgacagccttgggaaacatttgttgtgggaagcatttgttgttctttgtcaataactgagaggaattagggttcctaataagacctttggattcattactcagctaaaacaattcattcaacccattttgcctattcttaaatataactgggcgaattggtttcccagtaggagagttggtcagcagaaagaaatcaggattggagagccctctcctttgtgcccaggggatctgaagagcttgacccactttaagttatttcctaatgtgcttctctgttacttcctagagaaatgtgtgtgaaaacagaaggttgttccaccgagattcacatccagattggacagtttgtgttgattgaaggggatgatgatgaaaacccgtatgttgctaaattgcttgagttgttcgaagatggtgagtttgggactggaataataaaccattccttgtcatgaatgattgggaggtggggagattgtggattcttttgttcacagcagtgtgcagggcacattagactgaggtgggatcacgtaagaactagctgcgtcttcttccatctaaaaaatttctttactcaccaaagcagtattgagtaaaacggaactggaaggctcaataatttaactttttcattattttggggagtaagcaaggctattaaggcagaattgggggggatggagagaatggatgaatttgggggaaagggagaaggaaaaaacaggtaatttgtactatcatagagatgtgtcctttagttttggcatgaaggttagtaatatattttgcaagtgctacttcgttacaagtgaagaggtaagttggatttggaaggtgtagcaattggggtttcagtcagggaaaacaaaaacacttaagatattttacccagaggaacttgtgtgttaatgttggaaaggctagaagaaaaggtgacatttaccagagatgagtaagtgcaggaagccacggctgcccctaggctggaggaacaaaagggaaggtggcatcaaccagagcctacaagcccacatcgaaagccttagctgatttgctgaccttctaaccctctgcaaaacaagaggagagcacagaaatgtgggagtggggcacagctccacaaggaggattaggaagatagcaatttgaaactatctaaaactgcctcgttcaagagacagaagaagggcatggtcattaggtaatcctgtggtagtctgtatgcccaagagaaggaactgatagactgagtggataaagatgttttatattactatagtcccccttatccgtggtttcaccttctgcgatttcagttacctgacaacaaccatagtccaaaaatattaaatggaaaattacagaaaaaaacaagtcataagctttaaattgtgtgccattgtgagtaatgtggtgaaatctcacgctgtcccacctgaaatgtgagtcatccctttgtccagtgtatccgtgctgtacagtatgtgtgtgtaggaaaaatcatagcatatacagggttagtggcagcatctgcaggttcaagcatctactggtcttggcgcgtaccctcagcagataaggggagagtactgcacatagataaggaggattttggacatactttctctttgacatacttagaagtatggagaaaaacctcatcaaactaatgtccagtagaggcagcacatcagaatcatgggcttcggtgtatagattctagaatcctctcttggtgctccattggatgactttagtctttctctgaagaaagctaagcagggaagagaggatgatgatgaggcactaatgagtgttctttcggttggagctattgctggtacggagtgatactaatcgtatgctgtaataataaagctgaagattgcaagcatttgccagaagtcatctcagtggttgatgctgtaattctttgtgtgtgtgtgtgtgtgtgtgtgtgtgtgtgtgacagtgacagaatcttgctgtgtcacccagactggagtgcagtggcacaatctcagctcatgcagcctcaacctcctgggttcaagcagttctcctgcctcagcctcccaagtagctgggatgacaggcacctgccaccatgcccagctaattttctttttctttcctttttttttttttttttttgagacagagtctcgctgtgtcgcccagtctggagtgcagtggcgccatctcggctcactgcaagctctgcctcccgggttcaagccattctcttgcctcagcctcccgagtagctgagactacaggcacccgccaccatgcccagctaattttttgtatttttagtagagacggggtttcaccgtgttagccaggatggtcttgagctcctgacctcatgatccgcccgcctcagcctcccaaagtgctgggattacaggcgtgagccgccgcacctggacaattttttgtatttttagcagagatgaggtctcaccatgttgggcaggctggtctccaactcctgacctcaagtgatccgcctgccttggcctcccagagtactgtgattacagacgtgagccactgcacccagcctgatgctataattcttgctaggatttttgttttgctgctgtttgatgctgtctttatagtcactgatttttatttgttcgttgcctgtgtttagagtagctcctctcagaggcctttttgtcattcctttgccggctgatagcaccattaggaaatggagcaatcccagaagagcgggtgtgtgggctggaattagattgctgcagttggtcatgtgacctttgacaaactctttaaggtcccccgtcacttgatttctttgcctgaaaagggggatagctgtagtacctaccttgtagggttattagaaggattaaggatcggccaggtgtggtggctcatgcctgtaatcccagcactttggtaggccgaggcaggcggatcacgaggtcaggagattgagaccgtcctggctaacacggtgaaaccccgtctctactaaaaatacaaaaaaataattagctgggcgtgatggcgggcgcctgtaatcccagctaattgggaggctgaggcaggagaatggtgtgaacctgggaggcggagcttgcagtgagccaagatcaaaccactgcactccagtccaggtgacagagtgagactccgtctcaaaaaaataaaataaaataaaagataacacatgttgggccaggcatggtggctcatgcctgtaatcccagcactttgagaggccaaggcgggcggatcacttgaggtcaagagtttgagaccagcctggccaacatggtgaaaccctatctctactaaaaatataaaaattagccaggcgtggtggcacaggcctgtggtcccagctactcgggaggttgagccaggagaatctcctgaaccagggaggcagaggttgcagtgagccgagatcacgccactgcactccagcctgggggacagagcaagactccgtcacaaaaaaaaaaaaaattttggcgggaggtggtggctcatgcctgtaattccagcactttgggaggccaaggtaggcagatcacgtgaggtcacgagtttgagaccagcctggccaacgtggtgagacctcgtttctactgaaaatacaaaaattagccaggtaggatggcaggtgcctgtaatctcagctactcaggaggctgaggcagcagaatcactttaacccaggaggcagaggttgcagtgagccaagatggggccactgcactccagcctgggtgacagagactctgtctcaaaaaacaaaaaacaaaaccacacatgtcaagggttaagcacagtgtctggcacataggaattgctcagtaaagtgtccttgagttgtcttaacctttccctttccaccaaattctttctagactctgatcctcctcctaagaaacgtgctcgagtacagtggtttgtccgattctgtgaagtccctgcctgtaaacggcatttgttgggccggaagcctggtgcacaggaaatattctggtatgattacccggcctgtgacagcaacattaatgcggagaccatcattggccttgttcgggtaggtgatgccaccatccttggttctaccttgaagcttatttctgtctgcctcctgaacttcatgaccccagaaatattaccggctctaataccccatagggaatgcattatttcctgtcatcttctgtgcttgcctgtctgtttcatctcaacagatatttattgagagcacgtatcatgtgttaggagcctcctacaagaggtgacatttgggttgtgacctgagggatgagcaggaattagcagatgtatctcagggggatgttatatttagctatgactgtggcatgcataaagcattgtgaggctgaatatgctggcttaaacgaggactgcaccttgagtaaatcagtacaaagagtgctagttgctacagacaaatttgtatgacaggatttcttaataaatcaggtgctaatgagcggctggtttgcaggctgaagtaagtcactggttatgagtttttcctgaagtgacttcaggctccccagcatgggattaggttgtgatgtgaggtgtggttgtatgctgattatgtggttcattgagcgttagggtagagactctcgtctggcatgattatcttaatttatctttgagttaaatgagtgaaggagagaaagctaaaggagtgtgaggcagatgcaaaagttgaggcagcaggatgagtatacgcggagaggcacagggcttggagcatctgggcaggagcacagtggtgggaatagcaggactgtgacaagacctcttcaaggagtattgcgcactctgtaggtaaaatgaggccagatcttagaaggcattgaaaaattagtttaagtaatttggtcttgctacagtgggagccattattggctgttgagcaggcgagcatgtttagataagtttgtggggaaacttggcataggcgaacagaatggactggaaaagaaagcaatggtagggtataagaatatcagctaggaggaatctgtgaaaataacccaggagtgagaggatgcatatttgaactagggtgataataataggaattgagagatgaacaataaacatttttaaaatgaaatgaaaggaataatttatttcactgatgtctttaaagtgattaatgataaaatgagtaaatactcagtaaatattcattattatgtgtttttctagcaatatgctatgccatgtctatgcgtctttagattggaaaggtaacattttaggtacagatgtggacttcaatgtttttaattgtagctctgatggaatactccttggctctcttggggctcatctcttcctacttatctatacttcctaaattcaggtgatacctttagccccaaaggatgtggtaccgacgaatctgaaaaatgagaagacactctttgtgaaactatcctggaatgagaagaaattcaggccactttcctcagaactatttgcggagttgaataaaccacaagagagtgcagccaagtgccagaaacccgtgagagccaagagtaagagtgcagagagcccttcttggaccccagcagaacatgtggccaaaaggattgaatcaaggcactccgcctccaaatctcgccaaactcctacccatcctcttaccccaagagccagaaagaggctggagcttggcagtaagttgtggaatggatcaccgtgggcaatactggggctaaagggttatgtgataaaaatgataatttatgggaaagtattgagttagtgatcacagtgcactatagcctggaactcaagtgatcatgctcaagcaatccttctgcctcagcctccccagtagctgggactacaagggtacatcactgcacttggctccattttctgggtttttttgtttttgttttttgagacagagtcttgctgtgtcacccaggttggaatgcaatggcacaatcacgacttattgtaggcttgacctcttgggctcaaatgatcctccttcctcagtctcccaagtagctgggactacaagtgtgtaccactatgcctggctaattttattttaattttttgtagcaagagggtcttgccatgttgcccaggctggtctcaaagtcctgggctcaagtgatccacccgccttggcctcccaaagtgctgggattacaggcatgagccaccatgcccaactatcaaagtttgtgtttaattttaggacttctccctttttttatttaattttttaaatatgtgaaacattaatataattcgagtcaaaactacttaaatgtacccagaaaagcactactcctttccttgtcctccaaccctgcttactccaccttctatatgttaattaattgtttccctttctggtttatctttcctatgtttcgttttggaaaaatcagcagatacatatacatatatgtatacctatatgcagacacacatatatttttatttttcgttttcttaccaaaagggtagtatactggatannnnnnnnnnnnnnnnnnnnagctcatcctcatcttgttgtagtcattcatccttttttgaattttttgtgtaggtgtcaacttcaagtataagttacttgtattcttgatagctctatagtacagtatgtgttttaggagctgaatataaatgtataaaacatttagaaaatgcagcacaaatattaactaatctgtaatatcaccttcagaaattaaggggctgactgggcatggtggctcacacctgtagtccccaacacttttggaggccgaggcgggtggatcaactgaggtcaggcatttgagaccaaccctggtcaacatggtgaaaccccgtctctactaaaaatgcaaaaaattagccaggtgtggcagcacatacctgtaatcccagctactcgggaggctgaggcaggagaatctcttgaacctgggaggcacaggtggcagtgagctgagatcacgctattgcactccagtctgagcaacagagcaagactctgtctcagaaaaaaagaaagaaagaaacaagggagtttttcttttttttttctttaggtcctcatatgtcccctcttcttcctctttcaactctgttgaaattttacctttctttcaaggtatgtctcaaaagccatctttatgagcactcaggtgcttctggacacttatttcactttatgtaatataataggcagtcatgtgtatcatctgttagactagagtgttttttgtgttggaaccaggattgagcctcattcagcttttgtttaacctcagcccctggcacacgcctgcctttttaactgctcagttggtatctgcaaatgagcagctggggtccttggtgctgtggtcctcgtgatgagggagcaattccagacagttttgtgtattcacagaaccagtggattgtccccaggaaccccacttctctctattggcagatataatctgggttaagaaaaatcttggcctcattgttacttgatagcatctctagtataaatctcttcaaatgtcattgagttagggttgaaggcatgcgatgtcacccctgattgagacccactgttctgataggttatttcagggaaacctgttagagatgagaaaacactccatttatctgcaaaagctgacttaaaagttgacttatggttctaactaggaaaatcactcctaaaatttaggtgagagatgaaaaattattagagctacctgggctggagaaagcaagcctggaatgattaaaaatatagataattcctgttttacatataactcagtggctgaatttggctgtgatgagattgtgggtttgtatattgttaggtaaaaaatttacacattgtgatgatttctcttagacttaggtaaccctcagatgtcccagcagacttcatgtgcctccttggattctccaggaagaataaaacggaaagtggccttctcggagatcacctcaccttctaagagatctcagcctgataaacttcaaaccttgtctccagctctgaaagccccagagaaaaccagagagactggactctcttatactgaggatgacaagaaggcttcacctgaacatcgcataatcctgagaacccgaattgcagcttcgaaaaccatagacattagagaggagagaacacttacccctatcagtgggggacagagatcttcagtggtgccatccgtgattctgaaaccagaaaacatcaaaaagaggtgaccagggacattacccacagagcaaattgaaatccttcacatcacgtgaagtatgtgagtcatagtcaaaaaagttagaacagtagttgaaaaacctatgtcacagaagtattggggagctttcttaaaatacagatttctaggcctcttcccacacctagtgagtcagactccaagcactggccctaggaatctgtatttggaaatgctcttcagatggttccagtataccgagctgttatttggggatcattgctatagaagataacttcccaaacctgcattgctatccagtttgggatttcattagttcctgtggctttttgccacactttaacagtcattttttaaagcagtttttcattgttgttgttgtttcattttatttcaatagtttttggggaacaggtggtcttcggttacatgggtaagttcttaagtggtgatttctgaggttttggtgcacctgtcacctgaccagtgtacattgtaccctatatgtagtcttttatccctcacccaccttccacccttccccgagtccccaaagtcccttatatcattcttatgcctttgcatcctcatagcttagctcccacttataagtgagaacatatgatatttggttttccatttccaagtcacttcacttagaataatggtctcatctccatccaagttgctggaagtgccattatttcattgttttatggctgagtagtattccatggtaaatatgtaccacattttctttatccactcattggttgatgggtatttaggctggttccatatttttgcaattgcaaattgtactgctataaacatgcgtgtgcatgtgtcttttttttaatataatgacttcttttcctttgggtagatacccaggagtgggattgctgaatcaaatggtggatctacttttagttatttaaggagtctccacactgttttctatagtggttgtacaagtttacattcccaccagcagtgtagaagtgttcccttttctggctgggcgcggtggctcactcctgtaatcctagcactttgggaggccgaggcgggcggatcacaaggtcaggagatcaagaccatcctggctaacacagtgaaaccctatctctactaaaacataaaaaattagccgggcttggtggtgggcgcctgtggtcccagctacttgggaggctgaggcaggagaatgctgtgaacctgggaggcggagtttgcagtgagcggaggtcgcgccactgcactccagcctgggcgacagcgagactccatctcaaaaaaaaaaaagaagtgttcccttttcaccacatccacaccaacatctattattttttgattttttaaattatggccattctaacaggaataaggtggtatttcattgtggttttaatttgcatttccctgataattagtgctgttgaatattttttcatatgtttgctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccactttttgatgggattatttgtttttttcttgctgatttgtttgagttccttgtagattctgggtattagtcctctgttggatgcatagtttgcaaatattttctcccactctgtgggttgtctgctgattatttcttttgctgtgcagaagctttttagtatcattaggtcccatttatttattgttgtttttgttgcatttgcttttggggttctaagtcatgaattctttgcctaacaatgtctagaagactttttccaatgttatcatctagatttttttttttttttttttgagatggagtctcactctgtctgacgcccaggctggagtgcagtggcatgatctcagctcactgcaacctctgcctcccgggttcaagcaattcttctgcctcagcctcctgagtagctgggactaccagcgcgagccactacacctggctaatttttgtatttttagtagagacggggtttcaccatattggccaggctggtctcgaactcctgaccttgtgatccacctgcctcagcctcccaaagtactgggattacaggcgtgagccactgcgcctgcccgttatcttctagattttttatggtttcaggttttagatttaagtctctgatccatcttgagttgatttttgtataagatgagagatgaggatccagtttctttcttcttctttttttttttttttttctttttttggagacagagttttgctgttgttgtccaggctggagtgcaatggcacgatctcggattactgcaacctccgcctcccgggttcaagcgattctcctgcctcagcctcccgagtagctgagattacaggcacctgccaccatacccagctaattttttgtatttttagtagagacagggtttcactgtgttggccaggctgatctcaaactcctgacctcaggtgatccacccacctcggcttcccatttttgtatttttagtagagacagggtttcaccatgttggccaggctgatctcaaactccagaccttaggtggtccacccacgtcggcctcccaaagtgctgggattacaggcgtgagccaccatggccggccccagtttcattcttctacatgtggcttgccaattattccagcactatttgttgaacagggtgtccttttcccactttatgtttttgtttgctttgtcgaacatcagtcggctataagtatttggctttatttctgggttctccgttctgttccattggtctacgtgcctatttttataccagtactatgctgttttggtaactatatccttgaagttatagtttgaagtcaggtaatgtgatgcctccagatttttctttttgcttagtattgctttgtctatgcgggctttcttttttggtccatatgaattttagtattgttttttctagttctgtgaagaatgatgatagtattttgatgggaattgcactgaatatgttgaatctgtagattgcttttgcattgtggtcatttacacaatattgattctacccatccatgagcatgggatgtgtttccatttgtttgtgtcatctgtgatttctatcagcaatgtatcagatctaggacctttttggatgagtcttcagggttttctaggtatatgatcatatcattggtgcacattaacagtttgacatgctcttttttaattcggatgccctttatttctttctcttttctgattgctctggctaggactcattttttaactggagactattctcaaatacaaactgtacaaaaagataagacatttagaacaaactttgctgtacaaataaaaatgcaacaagccagaagttacaatttgtagtatttgctacctagaaacttcagcacctgttccataataggttgctcagtaaatgctttatattgaatatatagctgcatttctgctaaccttgagcctgtgtggataataaattcatgcatgcatcagaaacaaaaaaggacaagcacctctccctgggagtagcatattttggtctctagttggggagttggtgagtctaatttaaataaggttaaggcagactttgaactctgggtttgagtcaagcttcaattataactttttagttataattttttgccaactttttagcagaaagaaagttttactcttttcaaagtatatataaaaagactgggagccaatcaggccacttgactatcttctagtgccttttgtacactctggtatccaaaactgcttcccgtgacctcgctgtggtttcttgcagggatgcaaaagaagcaaaagcccagaatgaagcgacctctactccccatcgtatccgcagaaagagttctgtcttgactatgaatcggattaggcagcagcttcggtaagactactccttggcaggcagagaaacattgctgccatctctgatatctataatcttatctcctaatgcctcttatactgtttatttgccaatccattgaaattgaccttttacctagcatgtctggaattatgttaagtttcaaataattgtcttagtctgaaggggcaagaaatacttcctgggcttaggtgactcccatccctaatcatcatgtccagcaagactgttggtgggatggggtgcctaagagcatgaacttggattctgacagatctggatttgaacctgggctttgtcatttaccatctgtgtaaccttgggaaggcaaaattacctttctaagcctgaaattcctcatctacaaaatataataatatacatgtcataaagttgttgaggggtttaatgagataatataaataatgctcctaacagagtgtctcggtagcaagcacccatgtcacctggtcacaggagggaccctgcaatacttgtaatccacactaatgttatagagttcttcttatttagacttgaacactgagtatcaaaaaatatgtccctaccattcaggtttctaggtaatagtaaaagtgaccaagaagagaaagagattctgccagcagcagagatttcagactctagcagtgacgaagaagaggcttccacaccgccccttccaaggagagcacccagaactgtgtccaggaacctgcgatcttccttgaagtcatccttacataccctcacgaaggtgccaaagaagagtgtaaggttcttctaggtttacttcccattgaagcatccctctcttagtttaaaagttacaaatgctgaagtcacagattagtaacagctggaatctgaggacagatctgttatattcaatgctattctttgtggaatattcatggagaaggggacctaagtgaacactaggactgaaaatgaatctagtagagagtgatttttgaggtaagtcccttttacggtacagaatcagatggccaagagctgaacttcctgagggaagtaagtacaagacccactcctctttgcatttcccacggagcactggcagagtgggtatcgcatgtacggccaccgagctgtggtgttagttttgttgtcccacttgatacacctgagaaaccgggagtgctacttacatattggtaacaaatcatgtcacagcaagatggaaggaggagatcaatgaacatcttttctgcttcctgtggaactttagcagaacactgaaaaggtattcagatcaggatcttctcatgttcgaatgtgcttgagaaatgtttgaattaaagttaaattgacagagcatcttattctttggaacacagttgagaaatcttaattagaagactttctaaagctgatgtccatttttccgtatgaagatgtgatttggcttgggttgaaatcaaagaaaaatctcggctgggcatggtggctcatgcgtgtaatcccagcactttggaggccgaggtgggtggatcacttgaggtcaggaattcaagaccagcctggccaacaatggtgaaaccctgtctctgcttaaaatacaaaaattagccaggcatggtggcaggtgcctgtaatcccagctactctggaggctgaggcgggagaatcacttgaacctgcgaggcagaggtttcagtgagctgagatcgcaccatagcactctagcctgggcgacagagtgagactctatctcaagaaaaaagaaaagtctctagggaaaggaatccagtagatcagtagtccccagcccctttggcaccagggacccccttcgtggaagacaaactttctacggatggcaggggctggggggatggtttcaggatgaaattgttctaccctagatcaccaggcattggattctcataaggagtgtgcaacctagatcccttgcacacacagttcgcaataggatttgcactcctatgagaatctaatgcctctgctcctctagcagaaggcagagctcaggtggtaatgctcaccccacccaccactcacctcctgctgtgtcctggttcctaacaggcctctggtttgattgtgtctcctggcccccacccaaaagtagggatatagggtgtagggtaccttcagcataataaaaaagggcagaagcccatcaggtttcttgataccttctcagcaaggccttgtcaacacttttctgttttctccaaaattaataaatgtaaggcctttttgtttttttttgagacacgctcttgctctgtctcttgcccaggctggagtgcagtggtgcaatctcaactcactgtagcctcaacctcctgggctcaagcgatccttccacctcagcctcccaagtagctgggactacaggagtgtgccatcatgcctagctaatttagagggggctttcacctctgtgttgcccaggctgtcctcaaactcctgagtttaagcagtcctcccttcttggcctttctaagttttgggattacaggcgtgagtcaccgcaccagcctgtaaagccttttaaacagtttaagtgctttctgcctcgggaggaaatggagagattgttctctctctagccaggctgaaaacagagggtgggtggagtgaaatgccccatagaagggaatgctttgtagaaacgccatgaagatgagggaagcagcagcaggcttgttctagcaagccatgagcaaggaagaagatagagggctgttagactacactaagcggtgacctgggggtttggagtggaaaaatctgccaaggtttctccaggtcccgcaccgtgggccatggaagtcctgggctgatgcttggccatatcttcaaataagcccagggaaagatctaatgaatcaaacctagtttatgcctcctcttctcttctgtatttgggcagagtagttagggtgtcttaaacatttcttgtctttcaagataatattttacttttaaatagtatttcatccaaacttaattctttcctcagactgatattgttataaatcctgatactatacatacattagaaaaaagaaaccatatttggacgatgaacaaagtttatgcaatgtgaggtgagagagggagagtcatggtcctttatccaggaaggaactaagaggaattcaccacctctcttccttttatcagatcagcacaaatcacatttgctggtgtgtcctggatggtgttttgctttttccttgtgaaatatgttctttgttttcaatacagctcaagcctagaacgccacgttgtgccgctcctcagatccgtagtcgaagcctggctgcccaggagccagccagtgtgctggaggaagcccgactgaggtactgctgctgttgattccccttcagagaggcaggaaccatggggcctctgctttcattcacataaaattagcagtcactggtctacctaataaaggtagatacactgtgtgtctatacttttacctatctaggtaaagtgagtgtatgtttagaaaaaagaaacctctcaggcagcatctgggttagccagtgtggacaggccctgggaggactggccttcccgtctactgccatcatttccgcagggatggaagatgattagtcaggacagtgcctctttgttttgatgccctttagaaccatatggagactttcatataagtctggatcctgtcagaaatcaagcaaaatctgaatctcctgtgggatgaggtccacccatgtgatttgggtggagaaacggaggccaaggattatgaggccaaatggagggatttgagaatgaagggattctctagcatttgaaattgagttttcaggtagaaacatagacaagaaaccataatcattttccattgattaatgagtagatggttggggaatgttcctaaagtcttccttttctcccgtttaccaccaatggtaggctgcatgtttctgctgtacctgagtctcttccctgtcgggaacaggaattccaagacatctacaattttgtggaaagcaaactccttgaccataccggagggtgagtcatgtgaggcaggcagggtagtttggggaataaggcccctgctagtggaatgccttgggtgttacagttcagccatacaggctttctccagtatcagcagactagaccaaatcgttgctgaagcccaaagcttctgaaacatttgttgccaaagtaatcctatagtaacagaaattttgcctttcagaaagaatgaaactggccttcattgagtaggcagtttgcatatagcattatgcaaactgtggaatgaatgattctatataagcaggtcctactctgaccagcttccaaggatggtccctactgcccccacctccacatttcaagggtctcggtccttccctcagtatacattcccacactcctaactgattataacgtgtagtggctggctgagacctaccccacgggttttcctctcttgctctaggtgcatgtacatctccggtgtccctgggacagggaagactgccactgttcatgaagtgatacgctgcctgcagcaggcagcccaagccaatgatgttcctccctttcaatacattgaggtcaatggcatgaagctgacggagccccaccaagtctatgtgcaaatcttgcaggtaagcagagctgtttaggctttttggaaaatgctgtttcttcgtgacacatgaaaaaggaaagagttacttaattttgcgtgtattgcatgttcatgatataccaggcattgtcctttctgtagaggtagcaagggcaaggaagacagaattcttaccctaagagacttcaaagtctaggagctggataatgattacaagccaggaagccagtacttacccacatggtgaaaactgtgagcttacaggtagcagtgtggcaacatggaaaaggggtccgtggcaggccagaggttaagccttgctctttgtccatgggctgttattttggagcaggtaacatccagttatagaattctgtaatagtgattttaagggggcttctggcccagcctgtgactcatttgcatttcaaactcatataccttctttatcttctctttcggtgccttctcttgtccttccaagtaaaggttaagactagattgggaggcagaatataggataccgaagtcctcaggttaaatgcctccctccatttgcagatttaactttaagcccaagggagtaagacccttacagttcctcacaactgtgtttctcctaatgcagaagctaacaggccaaaaagcaacagccaaccatgcggcagaactgctggcaaagcaattctgcacccgagggtcacctcaggaaaccaccgtcctgcttgtggatgaggtgaggtgcccatgggcggacaggagaagaaacagggctgtacctcaggagcaagtgctggatgggagggaggaaagtcctggctcccttctccattcatatgagcccattttctggtgctgagaggcgtgtgtcaatggattgttttggtgctatgacttgggaaacatgcagctaaagcagtggttataggtcttcattttgaagcaccagctcagtctctgtgattgactctgcacctctctcctttgccctggcagctcgaccttctgtggactcacaaacaagacataatgtacaatctctttgactggcccactcataaggaggcccggcttgtggtcctggcaattgccaacacaatggacctgccagagcgaatcatgatgaaccgggtgtccagccgactggtaggttctagggcagttcccatgctgttcttgcagatctgtaagcttggccaagaagttctgcaaaaatggtccaggtgtggtggctcacgcctgtaaaccccgcactttgggaggccaaggcgggcggatcacttgaggtcaggagttcaagaccagcctggccaacacagtgaaaccccgtctctactaaaaatacaaaaattagccaggctaatttttacttaggaagctgaggcaggagaattgcttgaactccggaggcagagtttgcattgagttgagatcgtgccactgcactccagtctggcaacgaagcaagagtccatcccaaaaaaaaaaaagttctgcaaaaatgaatactaaaataaattgggatgttaagaaatgtgatttctgcaatgcttgtagtttctatgttggaatatgtaaccattgcatgattttctgcaaacatcatatcttggtgttctgctgctcgtggacttttaaactgcaccaaaccatggaggtttaattatttaaaaaaaaaatgttttaggctgggcacagtggctcacgcctgtaatcccagcactttgggaggccaaggcaggtggatcacctgaggtcaggagttcgagaccagcctgaccaacatggagaaaccccatctctactaaacagacaaaaattagccaggtgtggtgacgcatgcctgtaatcccagctactcgggaggctgaggcaggagaatctcttgaacccgggaggcggaggttgcggtgagccaggatcacgccactgcactccagcctgggcaacaagtgtgaaactctgtctcaaaaaaaaaaaaaaaaaaaaaaaagttttagcacttataacctgccaggcagtgttaggtgcttggaataatgcaataaaccaggcagatgcaatgtctgccctcacaggccttgcagttcagcaggaagcgcaatgagaaatcatgaagagcctggtaagtgaagccaagtgcagtgacaatgtatagcatagatctgaagatcctctcacccacttcaattaaagcacctcagcttttatctacttccaaatgattctgatagaatcaaaggtccttaggccgggcgtggtggctcatgcctataatcccagtttaggccgggcgtggttgctcacgcctgtaatcccagcactttgggaggccgaggcaggtggatcccgaggtcaggagatcgagaccatcctggctaacacggtgaaactctgtccctactaaaaatacaaaaaaattagctgggcgtggtggtgggcaccagtagtcccagctacttgggaggctgaggcaggagaatgacgtgaacccaggaggcggagcttgcagtgagccgagatcatgccactgcacggtagcctgggcaacagagcaagactccgtctcaaagaaaaaaaaagaatcaaaggtccttaaatgaaatgaaaaaatagttcaaaaactactgccctacaggacaccactggtcattgtcagtaaaggcagtggtagtctaggtatgaaatgtgtaatttgttatatgggacctgggaattgggtttgggggcccaagggtgactttccacctggataatcactgggcagtcaaccaacttattcctctgtcattttggctccccagggtcttaccaggatgtgcttccagccctatacatatagccagctgcagcagatcctaaggtcccggctcaagcatctaaaggcctttgaagatgatgccatccagctggtagccaggaaggtaagtcaccagctgcacccataaatcagtcagcacatctttgctgagtacctgctgggtatgaggccctatgctggtgctctgaggttggagagaaatttagaaagtcgtgtaaaaatatcaaaaaagacaagattatgagaaattccttagccttgttattttatgattagagggccctaaatattgtgggtttatatgcaaactaatatgaattcattcagggagcaagcagttttgcatgatgaaagggacaatatagtcaggtagacaaacctggtttgaattctggctttaacgcttagtaggcatgcagaaagttataggaaagttacttaaaaatttcctgagcctcagttttcttctctgaagaagaatgagagcacttccctcatagggtcattgtgaaaatataacaatatcatgtctattacatgcccagcaaggcacactctccaggctagatatgaggtattagatgcccctctcctccaagtctaataggagaatgctccctgagagttcaccacagactagtctccccggctgctgaggaacaaagtgggttaaatgtctgcctcaagcagaaagaaagaaagaaaaaccgtacatccacaagtatttcagcatgtaaaataattataaacttatttctagtttcctcttgccgacacactcttcaccctgaatggctgtagcagcagcacatgactgtgactcctgcttggaactagctactgtattagggactggggtaagaggtgagccaattgtgtgcctgtctccaggctttgctttccaggagagagatcctcaaagttatcatctaggcattttatgggtagagtttttcacttttgctattatgctatctatctagactatctaagaggctttttcttttctttgaatgatcctttttttatgccacccttttttttttttttgaaacagcatctcactcggtcgcccaggctggagtgcagtggtgtgatctcagctcactgcaacctccgccttctaggttcaagagattctcctgcctcagcctcctgagtagctgggattacaggcgtgtgccaccatgcccagctaatttttgtattttagtagagatggggttttgccatgttggccaggctggtcttgaactcctgacctcaggtgatccacccaccttggcctcccaaagtgctgggattacaggagcaagccactgcgctcggccaatgccatcctatttatttgaaattgtcctttcccgttttcctccaagatgcttctgtcagttgattttggtctctatcttgcatcgttagagactttccacagttgtcttggttgtcctctcaggtgtaagggtggagattaaacagctggctctgaacatgtgagtggggcttattcactatgagatttgctgtgggatgatctgagtgggccagtatcactgtctttcctcctttcccatgggaatagtcagatttctcagtatgcttcccctgtcctgtctggagggcagtgttctgggaatgaggggctggtgtcaggtacagaagaggtcttccagtttggcatgcatatagtaatcatctatttttggtaagggacacctcttctacaataatgcctagcattcctaggaccagagactttttgctaaactttgcttgagaataaatttcctttgttttttttgttttttgttttgagacggagtctcactctgtcgccaggctggagtgcgatggtgcaatttcggcttaccgcaacctccacctcccttgttcaagccattctcctgcctcagcctcccaagtagctgggactataggtgcacaccaccacacccagctaatttttgtatttttagtagagacagggtttaaccatgttggccaggctggtctcaatctcttgacctcctgatccacccacctcagcctcccaaagtgctgggattacagccaataaaacttttatttataaaaacagatggtgagccacactttgttgtttcctgatctaaggcatctttagtttcttaacgtcctcaactttttttaactttcaaccacaaccaaatattctctacttttggctgggtgcggtggctcacgcctgtaatcccagcactttgggaggctgaggcaggtggatcacaaggtcaagagatcgagaccatcctggctaacagggtgaaaccctgtctctactaaaaatacaaaaaattagccgggcgtggtggcacgagcctgtattcccagctactagggaggctgaggcaggagaatcgcttgaacctgggaggctgaggttgcagtgagccgagatcgcaccgctgcactccagcctgggagacagagcgagactccgtttcagaaaaaaaaaaaaaaaaaataccctactttagctaaacaacccccctttacctctttccagcaccactaactcctgagcattttgaggatttttaatgtaacttagatttgttcttggattcctcaatataggtttaggatttggctttctccagtccactacactaaccgctactcttccatgtctttctaacttgcagaattattattattataatttttttttttgagacggtttttcgctctgtcgcccaggctggagtgcagtggcacaatctcggctcactgcaacctccacctcttgggttcatgccattctcctgcctcagcctcccgagtagctgggactacaggtgcccgccaacatgcccagctaattttttgtattttcagtagatacggggtttcactgtgttagccaggatggtctcaatctcctgacctcgtgatctgcttgccttggtctcccaaagtgctgggattacaggcgtgagccaccgcgcctggcactaacttgcaaaattatatttttaaatcttctcctgatgcttcccttccttttagagtcttggggtgggttgttgttgtcattgttttttgagacagtcttgctctgtgacccaggctggagtgcagcagcacaatcttggctcactgcaacctccgcctcccaggttcaagcaattctcctgcctcagcctcctgagtagctgggactacaggcaggcacccgccaccatgcccagctaagttttgtatttttagtagaggcggagttttaccatgttgtccaggctggtcttgaactcctgacctcaagtgatctgcctgccttggcctcccaaagttaaaggattacaggtgtgagccactgcacctggccagagttttggtgttttgtttgttttttttttttgagagggagtctcactctgttgcccaggctggagtgcagtggcacgatctcagctcactgcaacctctgcctcgtgggttcaagcaattctcctgcctcagtctcctgagtagcaggactacaggcatgtgccaccacgcccagctaattttttgtatttttagtagagacggggtttcaccatgttagccaggatggtctctatctcctgacctcgtgatctgcctgctgcagcctcctaaagtgctgggattacaggcgtgagccaccgcgccccgccccagcccggtttttttaacaaagattcagaagacatccaatttggatgctgctcttcctcaaatctcttgcccatagtttcaaagccctctctatttctttacatatgacgaagcgaatctgttttatattctatatcctatagttatgatacctgaagtctttaggggtctgattctgataaccattgattctgctggttcccatgcatatgtggcttggttttcttatttttttgtcttgatttttattttattttactatatgcatggaattcagcatgctcctttatttgagagttaattggggcctgggttgaagttgaattcatttagaatttgtttttttttttttttttttttgcttctaggggcactaccaactgttaccatttttaaaataaaattctccacttgagaattgtaggaaatacaacataaatttgggctccaaatccaagcaagggcttatggttgtaaaaactcgagagtgtctgggtagggtggctcatgcctataatcccagcactttgggaggccaaggtgagaggatcacttgagcccaggagtttgagaccagcctgggcaacatattaaaaccccgtctctacaaaaaatttaaaaattagcccaatgcgatggcatgtgcctgtagtcccagctacttgggaagctgaggtgggaggattgcttgagccgaggaggtggaggctgcagtgagtcatgatcatgccactgcactccagcctgggtgacagagcaagaccctctctcaaacaaaaaaaccaacaaaaagtcggctgggcgcagtgggtcacacctgtaatcccagcactttgggagggtgaaaccccatctctactaaaaatacaaaaaattagccaggtgtggtggcagatgcctttaatctcagctattcgggaggctgaggcaggagaatcgcttgaaccccacaggtggaggttgcagtaagctgagatcccaccactgcactccagcctgggcatcaagagtgaaactctgtctcaaaaataaataaataaataaaacccaagttttttgtgtgtgcccacatccacctagcaccaaggtcaagtaggccgtttttcctgccatccgttctgcgtgatgggtctcactcaccctgtactgaggctgaagtggaggtcaagtttcaggtgcctgcaggatgtcctgttaggttccatgttggctgggccttagcttcttcttgtgtctcccttgtcccagcagcagcccgaagggatgcatagggttgccaagtgtcactgatacccttggggtcagactggtttaggtgtttccttaccccccagagttcccctttcactttgtcttgaggcccttgagtccctgctattcaccacacaaagtgcctcttcaccaggctgtacaggtggtaatgggaggggaggagaactgacgaagcaggaagggctacaggacacccttaccagttcaatactggggattagaggaagggaaaaatgtaagccgatagtcatgtttgtgtcctgggttacttggaaagtgatttttttttttagatggactctagactggagtgcagtggcgtgatcttggctcactgcaacctccacctcccaggttcaagtgactctcctgcctcagcctccccagtagctgagattacaggcatgtgccaccatgcccggctgatttttgtatttttagtagagatagggtttcaccatgttggtcaggctggtcttaaacttctgacctcaagtgatccacctgcctgggcctcccaaagtgctaggattacaggtgtgacccaccgcgccccagaccctggctaatttttgtgtttttagtagagatggggtttcgccatgttggccaggctggtctcaaactcctgacctcaggtgatccgcctgcctcggcctcccaaagttctgggattataggtgtgagccaccgcgtccagccccttcctacattcttgattctggtcctcttagccattgaccaagccgaccccaaattcaccacgtgctgtaaggggtgcctggctatggctttatctccagataggctccacctcaccctcttgtctttggctggctgcttctgggggcacacgtctgtctctatgcaaggagtgagaactctgtttgcagatgcttcaatagtgatcttgaaccaagcgtctctgattttagacttcatttcctgaatagtaaagctgagaatttctgtgttgtccactgtggagttaactgtaaaaccaagacagaggtttggactagaggattagagtcccatgcacaatgtaataattcatttctattcttcctccaggttccctgccagggctaagtacttaactttacgcttatgtccattgccagcactaccaagaatctcttggttcttctgggctaaggtggcctcaggaataaaatattccctcttgtaggtagcagcactgtctggagatgcacgacggtgcctggacatctgcaggcgtgccacagagatctgtgagttctcccagcagaagcctgactcccctggcctggtcaccatagcccactcaatggaagctgtggatgagatgttttcatcatcatacatcacggccatcaagtaagatgctccacttcctgagccttcctggaaggctgtagaaacatgtttccctttctaagcttttactcattcaacctgcacttattaataacacagttatgtttcatagggacattatctagtcagggaaacagaaatataaccctaggataatagaatatttgccacttattgagctatattataggtgtttagggcataaaagtgctatgataggaacaaaaaaaaaaggaagcagctgcttctctcacactgattgatgtgctcagctcatgaaatgagggcacaggtatttatgagtgaccagtgtatttccggatgtagttgctatgtttcctcacttccacagtgacattttctgtatcagtttgagagtttgggggtcagggagatccttgccacataatataggagaaattatttcccgggttttctcttttctaaagacacagaaaagttttctttggctttcctctgggctggggttacagccactgacaaaaactcacatcccctcgtttcctttaagaaattcctctgttctggaacagagcttcctgagagccatcctcgcagagttccgtcgatcaggactggaggaagccacgtttcaacaggtgatctcctcctcttttcaaatccttctagattttggacttacgcttttaaaatacatggaaatttccatgaatgtgtgacactctattttgtgccacctagagtatgtgaaagaataccagaccggcacctattttaatgtgacattttgtagagctgcatgagaagagacctttagcgactggtttctgcatgttagattgaaggcctgtgtgccagacactgttcaaagaatgaggaacaagacaaagttactccctgattacagcttatgttgtagtggagtcaaggctttcagaatgaggccatatttgagaacaaatcacagatcaatccaatccctgcatgggcatagttcaattagatcaagtgagagggatcagtagggcatgtgctttgttagtttacttaagactctagtaattggctgccttggaagatgaattgttaaaggtgtttatgagtgtgtacctgagagtgtgtatgtttgtgtatgtatgttttagacatctttatttaactaaaataagtcaggaaaacattttcctttcagctacttatttattgggttggttgtaaattcttgtttaaaattttagctactcgtcatgttttgcccattactgttctcctcctagagtctgagatagctcttctgcagagagtgactttcattttagtttgtaaacatttcctgaacatctgcagtgtgccattaactgtgatgaatccttgaaccccaagctgatttggttaacatccctgttcctgacaaactcccagtcttggggctgggacggggatagactcatagatatttagaatggaaagtgaccagaaatgctccagatttagctgacccagtagagaacgttagggtaggaatctatgtttccagctatcctcctgcctccctttatttctttattcaattttctctctaggcctttgtgcttttccaagggtcatgccttggcatttgctcactgtacctgataaggaaagtggccttgtagcaaaatttgacttgaattttgacagtctcaattatgaaactctcagcccctggagacaagactatttgtatcaccagtgagagttactagtcattttatatccattaactcacaagggatgtacagtgtattttatagataaaattgaagctcaaaagagtgcagtaacttggccaggtctacatatttaggtaaatggtagcaccaggattcgggcctgctgttttctgattccaaggctagcattccattctgcctctgcattttgtgtaccactggggcaccaactgatgccttctggagtgtttgatatcctgggggccatgtgtctgattttcccaaatgaagaaagaaaggaacagaaaaagccccaggattgtatttcctcttaacctttgccttgctatttgtgtctagatatatagtcaacatgtggcactgtgcagaatggagggactgccgtaccccaccatgtcagagaccatggccgtgtgttctcacctgggctcctgtcgcctcctgcttgtggagcccagcaggaacgatctgctccttcgggtgcggctcaacgtcagccaggatgatgtgctgtatgcgctgaaagacgagtaaaggggcttcacaagttaaaagactggggtcttgctgggttttgttttttgagacagggtcttgctctgtcgcccaggctggagtgcagtggcacgatcatggctcactgcagccttgacttctcaggcttaggtgaccccccaacctcatcctcccaggtggctgaaactacaggcacatgccaccatgcccagctgattttttgtagagacagggcttcaccatgttgccaagctagtctacaaagcatctgattttggaagtacatggaattgttgtaacaaagtatattgaatggaaatggctctcatgtattttggaattttccattaaataatttgctttttcctgagtgtttgtgaagttattacattataatcattacaaacatctgattatgaaaccaaactgtccttcctacaatagtccttccatgtgacttttatttctgttactaggcctgccatttatttaatgctaacatatataaaatataagtacacgatttacttgtatctatataaaatagttctgggagagtatgcaaaaaactggttacactgattacctctggaaagaatcagatggaaagaatcagatggccagggttaggggttagaggaggacttttcactgtatgtcattatctgtcttaagtttcaaataatataaataaaatttaggccaggggcggtggctcacacctgtaatcccagcactttgggaggccgaggcaggtggatcaggagatcgagaccatcctggctaacacggtgaaaccctgtctctactaaaaatacaaaaaaattagccagttgtggtggcgggcgcctgtagtccagctactcgggaggctgaggcaggagagtggcatgaacccgggaggcggagcttgcagtgagctgagatcgcgccactgcactccagcctgagcgacagagtgaaactccgtctcaaaaataaataaataaataaataaataaaatatagtttataaaaaaggaactactggaaataatataaatcataagtaatctctagccacaaatagctagaaagtgtaatttttacaaaggtaccatttaccataaaaacaaaacaaacctttaaatacaaaagatttatatgtcacagaaaatataaggtacttagaaataaattgatttaaatatttatttatttatttattttttccctctgtcaccaaggctggaatgcagtaatggatcatagctcactccagccttaacctcctgggttcaagtaatcctgcctcagcctcctaagtagctgggattccaggtgtgggccaccatgtccgtctcctaggaataagtctaataaagagatgcaagtaatctctagatagaaatcaattccaatcaaaatcttggcaaggtttcttgtatgactttgcagttaattctaatatttatatggaaaccaacaacaggcaatgaacatctaaaacctcatgaagtactgaggctgggcgtgggtggctcatgccggtaatcccaacactttgggaggccaaggcgggtggatcacctgaggtcaggagttcgagaccagcctgatcaatatggtgaaatctcgtttctactaaaaatgcaaaaattagtctggcgtggtggtgtcacctgtagtcccagctacttgggagtcaggagaattgcttgaacccacccaggaggcagaggttgcagtgagctgagatcacaccattgcactccagcctgggcgacagagcaagactccgtctgaaaaaaataaataaaacctaatatgaggtactgaaaaaaaacagccccacccgtgtactagtcctgtcagaaatgcttgtcctaaatttactgatgagaaaattatcagacaaatctaaatttagggagaaactctgcaaagcagctgttcaactcattgaaaatactaatatcacaagaaaaaaaacacaaaacatggaggaactattctacaccaaaggagaatagagacatgagagctaaatgcactatataaaccttgactgggtcctggatttaggaaatataaacaattataaacattattaactatgtattagacagaagtattttgtaagtgttaaattccccgagcgtgataaatttgtgattatgtaggagaatgctgttcttaggagattcataatgaaatatttataagtgatgtattatgtctgcaactcattctcaaatcatttagcaaaaatatgtatttctatattcacatatgtatttataattacatataatggattgaggatcaatatcaatatttttaaaactgcaatgaaaaagaaaaaatgagccaggcacagtggttca

SEQ ID NO: 15787 - DNA, 120727 bp, Human
  misc_feature (1)...(120727): n = A,T,C or G
gcgtggcctacacacatctcagtgggagggcatcctgggtcctgcccaggtacgtggcgtacacgcgtctcagtgatggggcatccctgggtcctgcccgggtgtgtggtgtacactcatctcagtgatggggcatccctgggtcctgtggttcttcatacacaaccctgtctagggaaaaaactagtccatgtcccctggcagctgaatggggcattggctcagggacgaggagaggcagccgacagaagcaggtgcagcgagcctaggggaagcgctcggctgccaaaaggccagattgggcagagtgtggccacggccaggcgtcccggtgacctgttgacaccattctccagctgctggttgcctgtgggctggtgtgttgtgacagaggagggaagagctggggcccccgtggagaacttggctggctgggacttggctgaagcctcagacctgagacagacggtgcgatcctctgctcattcattcgctccacgcactttccccgagagcctgccacaggtggggttgtgggtgctggcgtacagtgatgactcagatgctcacctcctgccccaggggctcaaggacaaaggggcaggattcactaaggtgccagggggccaggtgccatggggagggtgacctggaggaaaggatgtctgggcagatggcagggcaggctcagccagcctcccccatcacactgtgcgagatccgaagatgcctggccagggagtcccgcccggaagatacccggggaggtttaacaagcggacgccaccactgggcagtccggtgcgtaggaggctcctgctggccccaaggctgccggcacggtgatcttcgtgtctccaggacgccctgcggtgccagctcccgctggcccgcacgagtgctgaagcttacccctgctctgcgatgagtgtgagaggggtgtccaccccccgctggcggccccagcccaaggaggtccaccacagccctcgggagcaacactgccacgttctccgttgccagtcgtggtgggtcagagctggggagcaaacaggccaaggggcaggggccggtttgtgggagggtccctcctatagccatgctggtggggctggacgcaggggcctttccgaggccgccctcgtaacccttttggaaaatgtgaagccctgagctgctgacctgcacaccccgctcgctgcactggctcagcctcccctcccaaggtgggtgggctccgtgcctgggctctggagcccaagtggtgctggcagccctggggggttaatgcggctcaacttcccggtcgcctttccttccctcctcctttgaaggaagcccacactggggtgatagaaataagcaccggctccgaggagtctgctgtgagcccctgtccctgccaggcctgggcacagcctcctcgcccacgccctgctgccttgggctccgtcctccgtgcggggccttgttctgagggctgagggctcccctcccacactccagaacctgccctggacccctggagggagtgggctcagtacaaatggtacccaaggaggagggccacaggaagtgacatcgaccggccccccccacctccttattccctataaaaagcaaaatggtgactcagagaggagagttggaagcgtcctgcctcttgctcccactgttaatttttacacttggaattaggcagaaggcaaagaaaacagcagcttgaaatacgcggctgacatgctcttcatcgggtagcaacagcagagccgctcctccccgcctcccagcagccccggagcgggcagggcccggtgcctgctggctctcccccgcccctcaccaggcccaggcccccgcacagcccccgcccgggccaggcgtggatggtgcggccggggccatggctgccgggggccgccgccggcgcccactacgctaccagtccctggcagctctggtggaggattctcagtggcctttcttgttccttgtctcagacttcagctacgggacggacgagtacgacggagaggggaatgaggagcagaaggggcccccggagggctcagagaccatgccgtacatcgatgagtcgcccaccatgtccccgcagctcagcgcccgcagccagggcgggggggatggcgtctccccgactccacctgagggactggctcctggggtaggtacaccggcttttctttctgggtttggggaggggtgacgggaaggcctgggcatcgtgggccaggccctgcttgggttggtctcgagagattgggactggagacgtttggacctggccgttcttggtgcctcgtcatctcgtcctggccctggacccctctcaggctcgggcttccctccccacctgctttgccaacgctgccgcccctgtctctccccgtctactagccgtctgctccccaggcctcccagacccctccgtgcctctttcagctttcccctgttagcctgtctcctccagaggacccaggagaggaccaggctctcctcccctctgcacccaggccaggcagtggctgcatgcgtggcccgtgggctccaggtgttcagatgctgctcccgcaaagccagcctgggcctggtgctccctgtgggtgcaatgagctgcccgctccagccctcctctgttcactctggaagggaacaaactctgatggcatccacctctccttgttgacagagacaagagttctgctccagagagaagcattgtagaaggaatattaagtatgtgctctgagacaggccagggatagaaactgtggagggtttgcggtccttgtcattaacgtgttcctggcgacagggactgacgctgtctgagcgcagctcgtgtgtgcgtgtcggagacacatgaacgagcaaaacagaggttctgggggttgtttgcctggagctggtgggggagaagaatccaagccggtcctctgtggggggtgtgtgttgcaggaggcggtgggagtgccccatccttgcttggtcctgctcgtccgggtgtgttttgtagggggtctccgtcctgccttctgacgtccccagaggagcagtcgctgagatgccacgggctgcctcttcttcctccaggggctagtgcccccccaccccagctgaggccgcctgaaccctcccattcttgagaaccccctgctccttccagccccgccggccaccctccaccccccacagagctctcacccctcttcacacaccggggtggctgttatagcctttggcaacaagggccttggcaacgggcttcccacttgggggaagccacattgctgccatggcaacagaggccgaggccgagtttagcggcagtccaggcgtgcacctgtgggaagggctggcggggggcaggtgggaggcaagggggccggcgagggggttggtcagtgtgttgttgacctgccctaagacgggaggcgggttagagacaagcgtctcggacctgcgggggcagggtttttgccctggttctcctggaggcattgggctcagggtacaaatagtaacccaaggaggcagagcaggtgttcagggacctgaacgggggccaaccaggggagagcaaggaggagaagactctcgctcccatctctgccttcagctctcaaaccacagcagggctcagagccccgcccggggggactcagctctcaccccactgtgagcagctgcaggaagatgctgcggaatcccggtgtggggccagggtctttgccgctgcctgtccccgcgccacctccctctttgctccctgtccctgtgccctgtccttgtcgcgtgaccaccatgactggtttccgtgtccgtcgattttccgattcctttggtgctggcaggtgccttctctcgggagacagatcacgggcgtcacgcacagatgcccccgcctggcgctccggggcttcggggcagaacttgacttggtggctgtgcgtcttgcttggtggctcacgagggactcacttggcttgaggaccttgaaatccagagatgctagagtgactgccccctaaagtgcttgtggcccccagggttgatgtttacaccatcgactagaagccacgcaaggcaggagtagggagcacttgtccagcctggggatcgtccgggcaaaggtcccatccgcggcacctgccttccctcctcggggagcgtttctgccctttccgctgggtcaccggccccacctagtggactctgcagggattgctgtttacacggggtgcctggagggagctgacgcctcttcctgagtacttggggatgttttggttaaaaacactattaataaaagaccgaggtttctgcggcttggctgtgcttatttggccaaacaggtcccctcccctaccaggcttcctgctggggccttgggaacaggggggacttctggaccaaatcagacaattgttgtagatattcagatatctggcttctggcaccgccttatcgctgggccttccacgcccaaatatgcagccaacgggaagcccaaggttgagtctttgtgttagtcagtgttctctagagaaacaaaaccaacagggcgtgtgcgttatctgtatctatatctacatacgaagaaaagtattagaaggaattgattcaggtgattatggaggcttagaggtcctaatctctgcagtcaatagctggagacccaggacagccaatattggttccagtccaagtccaaaggcctgagagctaggagagccagggatgtaaattccagctcataagccagtggactcgaggctcaggaagagccagtgtttcagtccgagtctggaggctggaggaggccaacatcccagctcacgctcaggtagtcaggcgagaggagcttcctcttattctgcctttttgttgattcaggtgttcagtggattggatgaggcccacctatactggggaggagtctttttactcagtccaccaatacacatatcaacctcatcccaaatgcctcacaaatatgtccggattaatgtttggacaagtatctggacaccttgtggcctagtcaggttggcctagaaaatgaagtgtcatactattattccttcagccacccaggatggaaagcagataagctttgcgcagatgaaaatctattactctcaggctgggcgcggtggctcacgcctggaatcccagcactctgggagactgaggcagccagattacctgaggtcaggagtttgagactagcctggccaacatggtgaaaccctgtctctactaaaaatacaaaaattagccgggcgtggtggcacatgcctgtaatcccagctactcaggaggctgaggcgggagaatcacttgaacctgggaggtggaagttgcagcgagccgagatcttgccactgcgctccagcctgggtgacaaagcgagactccatctcaagaaaataaaagaaaatctactctttagctgtgagacattgggcaagtgtcctcataccgctgagcctcagtctccttgtctctagatagctctaactcccctgaaaggtagtggggaggaggccccactgtgagcagctctcagaccacagcagggctcagagccctgccttggggactcagctcccatcccactgtgagcagctctcagaccacagcaaggctcagagccctgcctgggggactcagctcccatcccactgtgagcagctctcagaccacagcagggctcagagccctgccttggggactcagctcccatcccactgtgagcagctctcagaccacagcagggctcagagccctgccttggggactcagctcccatcccactgtgagcagctctcagaccacagcagggctcagagccctgcctggggggactcagctcccatcccactgtgagcagctgcaggaagatgctgcggaatttcagcatgaggggaggcctgcagcattaggcctggctcaccaaagtgcacagcccttggccaccagggcccacaagacttttctcgccaggtttagagggctggggagccaacagcattaccactgcaaagaccaagtctgatcaatatctgctgcaccatgaccgaacctgcttttgcaatcaacctcctttctgccacatggggtggccccgggtgaagccgggtctctgcggtgttggcaggacatgctcctctctccccagcacgcccttccacagccttgcactctgcctttgtcttcttttgtgtccccaagacatggatcccacagaggtattagggtgaaacctgaagccctgccccataaaccctgcccaagtccaggctgagcagggcagcacggcagggccaggcccacagaccacgggtggctccattcagcggagactgcccagtttcactctgagaagaaagggccaggactcatctcagctgacaagtgggggtgtaggttcctaaggcaggaccatggtcttacagaaaacccgcctccccacaggccacagactcctctgtctgcttgcctcttgggaagcttagtaaaaaggggctacaaggcagagagaagaactgggttttgtccccactctaccactgtctcactgtgtggcctgaggggtgtcactcatgactccccaccagagctgcagtttgctcatctgtagtgtgaagacactgagaatttcctccctcctgacctcacagggctcaaacctcacagctgttgtgaggtttctgtgagatggtgtttggcagaatgctttgtcaatgtaaaatcgaaacaggggattagactccagcctgcaggagaacccaaagataagggtggaggcgaattgaaatcctcaccattggccgggtgcggtggctcacgcctgtcatcccagcactttgggaggccgaggtgggtggatcacctgagatcagtagttcaagaccatcctggccagcatggtgaaaccctgtctctactaaaaacatacacaaaaaattagctgggtgtggtggcaggtgcctataatcccagctacttgggagactgaggcaggagaattgctagaacccagtgggggcagaggttgcagtgagctgagatcacgccattgcactccagcagccaggggaacagagtgagatgccatctcaaaagaaaaagaaaaaaaggaaaaaaaaatcatcatcattgtccctatcatcctcttcctcctcctccccctcatcacagctgcttagagaggcttgtgctgaacctttcacgtgttggtttcatttaagagccccaacaactctatgaggtaggtgctataaccatctccacattacaggtgcgaaaactggggctcagagaggtgacgtaatttgcctaagattagctgggcgtggtagttcactcccataatcccatctacaaggggaactgaggcagaaggatcgcttgagcccaggagttggaggctgagaggtgctaggatcacgcctgtgaataggcattgtacccctgcctgggtgacagagcaaggctccatctcttaataatagctattaatattattgtttgtccaagaccatgcagccagcggggcagcgtgttattgaaacttgggtttctatgatgccagagcctgcacagcgctgtcaggtcccgctcacacgccctcccttgtgaagctttcacacccaccccgccgctgatcctactgcagtttgggaggtatgcacggtcacttgtggggtgcatccgccctgtgagatcaggaccttaatccctgatcatctgtgtggaccccagtggaagcttcttggcacctaggggttctcaactggtatttgtggaatggaagcaagtagttctgggatgttcagtcaggaggaagggaggagcaaaggaaggctcaggcaataatgctgggaagaactcaggctcagggataaagctgggaagaactcaggctcagggataacgctgggaagaactcaggctcagggataacgctgggaggaactcaggctcagggataacgctgggaggaactcaggctcagggataacgctggggagaactcaggctcagggataacgctgggaggaactcaggctcagggataacgctgggaggaactcaggctcagggataacgctgggaggaactcaggctcagggataacgctgggaggaactcaggctcagggataacgctgggaagaactgcagcctcttcttccctttcttggtctcttcagaaggcttagggcttgggattcgaggttgctggtaggtgcgtgaagaggcggcatggcagccaggaactcctgagatggtgcctgctccactccctcctgactgctctggacctgggttgtgtggttcagggactcctcgagtttcagcctccgccccccagcagccggcccctgcatttctccccttcctggatcttgggtccctgctgcaaagagaaggacacgagctggaccctcccgtgtgccaggtgctgtgctaggagcccaggggctgccctgccacccaagtcctccagccatggggctgccccccgtttagtagatgaagacactgaggctcagggtggctcctgggcttgtcccagttgggaaggaggtaagtcggaagtaggtaggctagtgccttggttgtgaccctgggtcccgtcatcgctggctcccatcctctctagccctcctggattcacacctggctgggatcttgctcacctctgcatactgttaatcttccctgatgaaccacacctggctggcctggctcatcccacagctctcacgccctgtctgggatctccgtcttctggctagctagcagccctagagttggtgccgtaattacccccattctatagatgaggaaacggaggcacagggagactagatgacatgcccaggtcacacagttggcaagaggcagagctggggctcacatccagagtgcaggggagttttctttctgttttagtttatttgtttcactgtataaacagtgttgtgtaccggcttctcctcaacattagctttattttattttatgtaatttatttatttgagatggcgtctccctctgtcacccaggctggagtccagtggcgcaatctcggctcattgcagcctccgcctcctgggttcaagtgattctcctgcctcagcctcccaagtagctgggattacaggccaccacatccggctaattttgtatttttagtagagatggggtttcatcatgttggccaggctggtcttgaactcccaacctcaggtgatccgcccgcctcggcctcccaaagtgctgggattacaggcgtgagccacctcgcccagcctatgtattttatttttttgagacagagtctccttctgtcacccaggctggagtgcagtggtgtgatctcggctcactgcagcttccgcctcccggggttcaagtgattcttctgcctcagcctccctagtagcggggattacaggcacccgccagtacgcctggctaattttttgtatttttagtagagacggggtttcaccacgttggccaggctggtcttgatctcctgacctcaggtgatctgcccgcctcggcctcccaaagtgctgggattacaggcgtgagccactgcatctggccaacattagctttatgtagttgaactatgtatatgattttggagtgacctgtactagaacagagaggaggcagagggaggagcaaggtgatctggaaggtgacgaatccagtcccatctgtggctgcagttagtggctgcaactgccctggcacttgccctttggtgtcagttcccattggctgaagagctactgagcttcatacagtctggaggtggggcttgagtttctgccaggaaagctgggagagccagggagaagccaagaggcgggagaaagtgcttcaagccgaggacctgccgttgttaaaggcctggaagtgagaacgtgccaggccctttgagaggttactgtcaacagtgagatgggtgagtcatcagctggggccccacggctcttgtttgggctggcttggtggcttcctgctgggcatagagtgagcagtgttttagaaagactcatctgatgtcagcaggagggatgcaggatgaatgtcctgtcacacctgtcctgaaatcctccagcaccttcccttcgcctatggggccccccttccctttgcacagctgtcaaggccttgtgtgacctgacccctggaccccctgcctacctctgtggcctcaggaccaactccgtgctagaattgtgaactctcacgagagagagattttgtcggttttgtaacaaaacttgctcattgcagtctctggtgccgagaactgtgcctggcacacagtaggtgctcagtaaatattagctgaatgaatgcatgaaccagccagactaaactcatgtcattgtgcctcacatagtctctctcctgtctgttccccagccccaccagcatctctaaccactgctttttttttttgagacggagtctctctctgtcacccaggctggagtgcagtggcgcgatctcggctcactgcaacctccgcctcctgggttcaagcgattctcctgcctcagcctcctgagtagctgggactacaggcgtccaccaccacgcctagctaatttttgtatttttagtagagacggggtttcaccgtgttagccaggatggtctcaaactcctgacctcaggtgatctgcctgcctcagcctcccaaagtgctgggattacaggtgtgagccactgcgcccggccataatttttttttttttttttgagacagagtcttgctctgtcgcccagactagagtgcagtggtgtgatctcagctcactgcaaccactgcctcccggattcaaggaattcttgtgcctcatcctccagagtagctgggattacaggcctgtgccacccctcctggttaatttttgtatttttagtagagacagggttttaccacgtagaccaggctggtcacgaactcctgaactcaagtgatctacctgcctcggcctcccaaagtgcgggattaaaggcgtgagccactgcgcccagcctaattttttttttttttttgagacagggtctttctctgtggcccagtctggaacacagtagcacaaacacagttcattgcagcctcaatatcctgacccaagcaatcctcctgcctcagcctcccaagaagccgggaccacaagagcatgccaccacactcagctaattattttttaaaatttttatagagatgaggtcttgccatgttgcccagctggtctcaaactcctgggcttgagtgatcctcctgcctcggcctcccgaactgttgggatttcaggcgtaagccactgcacccggcctatatgtatagtttattcgtggacacaaataaggaaaaatgtataactaactcttagaggctccctctgtcagagggaaccagaggagactttctctttctttattatgtgtgtctacagagttagaattgttagtgatgtaacaggaaaataaagaagttaaaatagaagtgccacgattgggaacgtagagtgggctctgagggcaccagcgggcacatctgacgcagccaacggggagtcacgggaggctccctggaggaggtgacgtttaaagtcgaatctaaaaataagcagtgggccaggtgccgtggctcacacctgtaatcccagccctttgggaggccgaggcgggtggatcacctgaggtcaggggttcgagaccagcctggccaacatgatgaaaccccatctctactaaaaatacaaaaattagccgggcctggtggcgggttcctgtaatcccagctacttgggaggctgaggcgaaagaatgggttgaaccgaggaggcggaggttgcagtgagctgagatcatgccactgcactccagcctgggtgacagagcgagactccgtctcaaaaaaaaaaaaaaaaaaaaaaaaaaatcgcaataggtgtttccatgttatcccttccagaaaagtggcacctcagctgcagagttctgacactgctcccctccccagtacggccttgcccctcccttgacactgccttgggagtcagtcaccaggtcaatctgtccctgagactgtcagctccgcgagggtaggcacggggttccctgtccatggctgcattccgatgctagcacactgcctggtgcacagcaggcggctaacaaatgcttgctgattgggtcaggcggttaacaactgcttgctgattgggtcaggcgttaacaaatgcttgctgattgggtcaggcggttaacaactgcttgctgattgggtcaggcggttaacaaatgcttgctgattgggtcaggcgttaacaaatgcttgctgattgggtcagggaaggagggaatggagggtgggtgtgggggaagactgtggggagtcaaccattggagactgagatttagacttgatggtgtcagaaatctcagtggctgcgaaagatttccaacagtagctaggtgtggtgtgtgcttatgcccctcaccctccatgatgctgttcagcccacttctccaagttcatcttctgtcctctagcaagcagcgcttcttaacctgccttccttcctctcttccttccttccttcctccctccctccctccctcaagacagagtctggctctgttgcccaggctggagtgcagtggtgcgatcatagctcattgcagcctccaactcttgagctcaaacgatcctcccacctcagcctcctgagtacctgagatttcaggtgcgccactgcaaccgggttgctgaagctgcttaaccctttcctttcgggccttctcttctttgcctggaaacccttccctatttccagatgctactcagaagccactgtcctgtgaagctttcactctcaggcagcgttagtgccactgtcctccatccccagggtggctggtaaacgagaacactgcctcgtgtgttcacacgtcctcaccccagacggatcgagagcctgagaacggcaagggccccgtctcccagcctcgtatgtgtgccatgccaggccttttctgggtatgaatgaatgaatgaacagacagatggacagacaagatcaggagccaaagtggggaagtacgtgtggtcgtgtgggtgtaagaggctctaaagcttggtggggtggtggctttggcaaaggaaaagaagaaccgaaggacttggtaaaagggatgtgggggttgagggaaggaagactcgtaagatggcggccgcactaacagaagtggaaacccggaaggggaagctgtttcagaaggaggaagggtcctttggtccagatgtgtggagtggaagggccgtggctgggcttccaagtgaggagacccagtggccggggcaggtgctagacctagagcccagcaagacaccagggctgcagctggcagcgggccaccactggcctggaagggagaagggctgcttctctgggggaagggagcagagggctgaggctgggcccaagcaagtgactccacatttacaggaggcgggagaatgaagggccagcctacaccagagagtggtcggggcagtgcctgcatcaacagggcagctgagggcttggagaaactctagactgcagaggccaaagagtcggagagggaggcctctggctttggaataaaccgtttgggggggcctttgaagcaggctgcttctatggagaacattaggagccaggccgaggcagacggagtgtggagctcaggtccagggctggctcagggcatttgtcagggaaggggagggaagctgtggggactggtgagtcacttcccctccaggggggcaccgagggcctgtgagtggagtctgtgtctgatggaggggcactctcattactcactggaatttccagccaccggggacagggtggagtagagaggccctggatactcagggagtcacttgtgtggggttcagggattttgggaagaagtgggcgtcagtctcaccatgccgtgtagaggtgtggggaacggggacgaggatatcctggcagacttccaagggcacctcatgtcctcttgagtggaggaaggaacacagcaggggcctgtggggttttaggcccttcttcgtgtcacctgcaggtctgactcatgtgggcagcccatgccatgcacttggagcccgccgggcgggagacagaagaacccgtggtaccaggccctgagctggcatacttgtgccctggggaatgccaggcctggtcgttcccaagccctcgccacagcctcacccgcccgcaccaaatgaggaattgtggctgaaagggcccttcagatgcgccctggctatttataacccacccaggcagggacaggggaaaaccaggggctggaaggagatgggtggggtgggggtgtgcctctgttgaaccctggtggcacagttccctgatcaaaggctgttagccctggggcccctcaagggctcaccccgcaatcccctgctctgtatttcagctctgcaacaggatggagcctctctccagggagggcagcttctctgctgccaatggaattgcatgagccccacctagagcccagagcttctgaagaattctggggggagtggggggctgtggcctgaactcgggccacaggtgtggttcatttagacggcaccatgttgttttaaaatgttaattatttgccatcgttttaaaatcaggagcattcctgttaataagccagattttagcttattttgaacagagatcaggcagccatgagcttgcgtttcctccagcagccatcggctggagtgagtggtggtttcaccctgccctacctggctcgcttcaccggctggcctcacccgcaggcctcacccgcaccctcatgggtgccgtttgcaacctttgctccatcgttgggttgtaaaagagcttttcccagggcctcctctggactcctcctcccatggaaggaggtgtatgtgcatctgggaactagggccagggggaccagaatgtggcctcactccctgcacagttgggggttctgcaaccattggagaagccaggggaagctggctgggagtgggcagggccggagatggtgcctgtcctgggttctgtgtgcactccccttgcaggatggctccctgcggtggggtggctgggggggctgcttggaggaggtgggggtgctggtctcagcagtgcctgtgagtaggtgggaggctgctcagaggaggtgggggtcctggtctctgcagcgcctgtgagtaggggggctggtctgtgagtgggggggctgctcagaggaggtgggggtgctggtgtcagtagcgtccgtgagtggggggactgctcggaggaggggggctgcttggaggagggggatcctggtccctgtgagtgggacgcccaccgctcctgtgcaggacagtggtggcgccgcgctcctgcctgggggcaggtcaggcctgtctgttgcaaagcctgactcctccagcggcggcgggacgcggctgtggcttctgggcgggccggggcctcccctccggaagggggctccggcgcatggggactccggggtggctctgggggtcgcccctgctcgccgggctcctggctcggccgcgcgcggggaatgaagatgcgtctgggaagcggcctccccgctccaccccaccccggcccggccgcggcctcctcgctcctcctccgccgcagaagcctccgccagccgcggccccgcaaccccagaggacgggcggctccacctcgcgacgcgcgtttcctgtgtgttcggagcgagcgcgagcccgagccccggagcccgggaagggcgggccctgcggggccgggcgggacacggaggagggcgctgggctgctgtgcggcgggttcgcctccgccacgggccgggcacggcgtcaggggctgcccgggccttgctccccctttcgccgggcgaggacgcgcgaggcggcggcggcggcggcggagcgggctggactaggtccgggatgcagtcccgggtcgggagccccaggccgggcgcgcgggtgtagacctgccccccctcccgcccgcctcctccctcctccctcctcccgccgccgctgcgtggaccccgcttcctgtctgccctccgcgggctccggctgccatggaggaggaagaggaggcgataggcttgctggacaaggttctggaggacgaagatgtgtttctcctggaggagtgcgagctgggaaccccgaccagccccggctcagggtcccccttcctggtggctgtgaaggtgggagcgtgacacgccctgggcgctggggggggccgggccggcgctgccgaaggtgcgcgggagaaatggctgatgcgggcgcagagcgcgcggccgggtggaagccctcggcggagtccgcgagggtcccggccccggcagctgttcccgggggagaggggcgggcctgcctccccgaccggtgtcctcggggcagtggtggccgccccctccaggccagcccagctcagggctccggcggctgtgccaggagtcacctggcgcgcctgtcagcccgagcctcgccgcctccctggagcgggtgggcaggaatcccccgtttccacggcaaccgcaagagaggggccaccctcttcccagccaggagacagggacttggtgtctccgagctgaggcaagagggtgtttgcaaagggcaagagccagaggtcactgagcttccttgaaggaaaagcactgggtcagctgaaggggggagggaacagctggcttggaggctgcagccaggtgggcaggtgcccttcccgaggcgggacaggcagggagcatctgctgggccctggcccacccgctctggggctgacggcgttctctgcagcagtgacccgtcctgtaggagaggttggctcccggtggaactggagggcagtggtggccagaatcccttgaggagcggggcggccccggaaccacgccggctctgtgagtctggcccggcacaccacagcggtcttcctttttctctcctggacacacctctcagagcttccacctcagccttttgctcagctgctctctggttctgtgtcgagaagggaggcccagtgaggatgcgtttcggggagtttgcagactgctaggcgaggctgcctaaccgagtgcccatcggcggggcctagaaggcatgtgcagccagcattgctggggacgggaggctgtccctgaacctctctgggcctccctgcccctcacagaagatggggatcacagtcctgccccacccactctacagtgtggctctgaggaggagccaatggaggtaaaaatagatgcagaaccacgggagatggctgatgtgtgagtatgggtggagcggtggctgcaggcctgggtggggagtggagctgtagggaggctggcagtggctggcaccccaccctgtcttctctgatctggtgctggcgtagggccgtgggggtaagtcacgtctccccgtgggctcagggaggcctctgcacttagggtctgaccagcctccccactaggaacagggtgggaaagtctgctcctgagccaggagtcaggctgggagtagcaatgctgggatgggaggtgtgtggccctcatgggcctcctctgggaagcccccagcacagatgtgggcccactcagaggctgcctcctggacctccccttctgctggaccccggcgtatgcctcagctaagcccgtatttcattctgctcagatgctcagaactctagacatttgcctccgcaattatatcccattctcctggaggaccaggaccatgtcatattcattgctgaacactgcacagtgcttggtgtggggctggtgcctgtgagagtctgcacaatgtgtgaggcccgctggggcccacgaagggtgcaccaggttcccagcctcgctccatctcagaggtgtcctgctgtgtacggcggtggcccacggatgccaagagagcctgagcacgtgtcacacctgaaaacgctgctcctcctgggtccccgtgagcaccgggatggtgtcttcccctctactttgctgccagcatgggggaaggagacctttctcgaatgccggggagttccaggctccctgctccatcctgaacacctctagaattcctccctcctctaccggcattggcctcagagggagaagacaagcaggtggccacagagcggtgggaagaaagctcctggattcattcaacaaacactctcaggttaggtgctcttcagagcaccctgcctggcactgtagagatgacaagaggaacaaggcgtgatcttccctcacaaggcgttcagagcaaggggcaggtacagggagtaggaatagagtacggaagtaggcagggtgggccagatgcggtggcacacgcctgtattcccagcactttgggaggctgaggtgggcggatcacctgaggtcaggagttcgagatcagcctgaccaatatagtgaaaccacatctctactaaaaatacaaaaattagccgggcgtagtggtgggcgtctgtaatcccagctactcaggaggctgaggcaggagaatcgcttgaacctgggaggcagaggttgcagcgagccaagatcatgccactgcattccagcctgggcgacagggtgagactcagtctcaaaaaaaaaaaaaaaaaaaagactgtgagaagagtactgataaaagggcaccaaattcaggggagaagggaccacttctagtggagttggggatggcctggatgcgtgcatgtgtgtgtgtgtgtgcaggccaagggtcatttctggatgatacactcctgtcctgggctgcagaggttcttggcacacccttccctggcagctagtaggaatccaaggcaattctctttgctattactttactttaggggtacttaccttaagcagcagttgcgttgtgagcatgtgcccaagtgccaggcccataaatcaatcctgtttccagtgtcatttccaagacgcttcatcttcctggggggcagaggtaaagttggctgcagttttctccaaagctatagctggagtttgctgcatatctcagcccagacttacctttgaagagttattgatctgtaaaactggtaatgcaaataaaatactgatagcagcgtcatgttgcatttgtaaaatggcttacacttgccaaaaatgtttcatgccattctatttaaagataggtagggttgtgacgggggcgttgtagaaggtgctattttaaggaacttatttgtcaggaataaaaacccttttgtaatgcagattaaccctttaggtatcattctgtgccatttttttttttcttttgagacagagtctcactctgtcacccaggctggagtgcgatggcacaatcatggctctctgtggcctccacctcccagactcaatcagtcctcccacctcagcctccccctcactacaggcacatgccaccacgttgggctaatttttatatttttgtagagacagggtttcaccatgttgcccatgctagtctgtaactcctgggctcaagcaatctgcccctcttggcctcccaaagtgctgggattacaggagtgagccactgagcccagcccaattctgtgccagtttttaatggatcatctgaaacatctctatttctgtttcacctgcccaggtctcttgtgcctgcacatcatgcctgtatcccccatttggatgtttttctaagtgcgggccccacatgtggtgatttgagaaatgatcggtggcacctcgatctatattttgcattttaatggttaagtatatattttaatatatattagaaaaaatatgacctgtacatttttcttacgatttcaaatacgtgtagggtaagactgctttttacaagtcagttcttgggcgcagtggctcatgcctgtaatcccagcactttgggagactgggcgcggtggatcatgaggtcaggagttcaagaccagcctggccaacatggtgaaaccctgtctctactaaaaacacaaaaagtatctgggcgtggtggcgtgcacctgtaatcccaactactcaggaggctgaagcaggagaatcacttgaacccgggagatggaggttgcagtgagccaagatcctgccactgcactccagcctgggtgacacagtgagactctgtctcaaaaaaaaaaaaaaaaaaaaaaagttactgtaaagaacaatattgagtaaagaatagtgcaggtggtggtatgtgagtatggcaaaattttaagggtgggatatgaacaaccgaagtttcaaaacattgcctgtgccctatggtgcctgcctaagacctcagacagcaatagggagcccagaatacggggatccacccttcaggagagaggggccactggaatttggtctttgtcccccagcagttgacccgtcttctctgttctaaattctgccaaggaagcagctgaaagagacttcctcagcgcctagcgctgggagaggagagggtctctcgatgcctctacactgcctcagctgtcctgagactgagatgggccagttgtcctgaggttgatgcttggtgtgggtataagccccaggcacggccacccccacccccaggcccagtggcatctactctgagcagatcctgctgggtactcctggcagccagctgtggcccgtgaactgacttctaccgtctgtgaagcctcagaccctcgctgcatgccctatagccttgagtcgcagccagagagccagccctgcttgttgtcttggaggccagtgctactggagagattgtgtctttgcttggcctggaaccagatgtttggaggctttatttagcctctcaactctgtggaggaccaggcctgagctggccacgccttatctctagacattgttcctaccagagtgacctgacgtctttggtttggcggcttcaagctgccacactgtcagcctagcagattgtgcaggatgctgaggataaacgaacccaccaggactgcatttcacaagttctggctgggaggaagtgaggacaggcagcttcccggtgctggagacaggtaggcagcgtggcagaggctgtgggacctggaactctttagagaactcgctccggagcattctaggcacgtgggcacctctccttcaccttcgtattcccagtgcctggctcccggtgggaatgggtgagtgagtggtgagcctggtttttgatgagacaagagacgccctgcaaagactgaagaaacaatgtgaatttcctcatggctctaaactgggaattgtggagtctgaggaaagctggaaaagatgggagatggaacaggccttcctttggtggtgactgagcaacgggtctcctgttagccaagtgcaccgaggctaatttcccatccgtacgctctccaacgcctttgctccaatctcagccaaaactgcagcgtgaacggggcccagagcaggactcttggggctgactgttgcctcttgagggagggtcttcctgagttgtcttcccatcagaaccagcctttcaagagtggactatgaatggaagtcttgaggggaggatcttgcagaaatgggcgattacagggcttccagggtctatgctcgtgccaggggggatgaagcttgtttgtggctggggctgcaaatccctttcttccccccatcctagtccaaccagctctacagttacagctcacggtgtggcatttgctaaaccctcaggcaaaaccttggttggcagggaacaggagggagtgctagcccccagcacaggggatgagttcccatttgtcaaggctgggaagcagcaggaagacccctgagggtctgacctggaggggctggagctgggggctgttccaggctctgatcttgtcccccggggctacgtgtgctggaggctgtgcaggcctctggcagtcccgactctcggtgcctcaggaagatgataacacctgccaggttttgagactccggtgaattgaaccacaaagatagctaagctcagttcctggaatttgtgaagccgccaataagtaactattgcccttgcctgaagcgtggggtctgtcttgcttttctaatgctgctgaaacaaatcgccacaaacttaagggcttaaaaccacacaaatttattctcttatacagaaatctaaaaaggatctcggcccggctccatggctcacacctgtaatcccagcactttgggaggccgaggcgggcgcatcacctgaggtcaggagtttgagacgagcctggccaacatggtgaaaccccatctctactaaaaatacaaaaattagtgggtgtgatggtggacgcctgtaatcccaggtactcgggaggctgaggcaggagaatcgcttgaacctgggaggcagaggttgcagtgagctgagatcatgccattgcactccagccctgggcgacagagggagactttgtctcaataagtaaatacataaataaatagattaattaaaataaaaaggatctccagggctgcattgcttctggaagctctagggcaagcttttccagcctgcggccatacggcccaggactgctttgaatgtggcccgacacaaatttgtaaactcttaaaacattatatatttttcttttagttcatctgctgtcgttagtgttattgtattttatgtgtggcccaagacagtcgtcttcttccagtgtggctcaggggagccaaaagatcggaagcccctgctctaggggagtgagttcattttattgccatttccagcttccaaaggctctctgcattccttagctcgtggccccatcctctgtcttcaaacctaccagtgtagcatcttccaagcagtccctcaccactaccctgtctccccggccctctcactccccttctgtggccacgatgcctcagggaaagatggcattttaggcagcaggtaaagaacgaaccgaaagctagagacctttgaagatgaggaggctggttctcctgcgtgtgggggagactgagcgatgtcctggctgtgggaaagactggaagggtagggacgggcatccgggccactgcaggtggctcataaaggatatggtgggccccatgtcccagtctagggccgaatctttacttgttttttaaatgtctttccggcagggtgcggtggctcacacctgtaatcccagcactttgggaggccaaggcgggcggatcacgaggtcaggagatcgagaccatcctggctaacacggtgaaatcccggctctactaaaaatacaaaaagttagctgggcgtggtggcgggagcctgtagtcccagctactcgggaggctgaggcaggagaatggcgtgaacccgggaggcggagcttgcagtgagccgagatcgcgccactgcactctagcctgggcgacagagcgagactccgtctctaaaaaaaaaaaaaaaagaaaaaataaatgtctttcccactagagtctaagccacttgagaacaggggccactgtctgtttcccatggtatctatagggcctggtggacattcagtaaatatttattgaatgaataaataaatggacacatagcccagtggaatccccaagtactcgcgttttgcggtattcatactcggtccttggcaagcatcgggcaaggtggcactcttaggagttgaatccagctctggtgtgtgggacaggcaggaggagaggaagagagggaggaaaagtcggttcgagaacccaggtggaaaatagattgagggaagcaaaacgagatgttacaggaggaatatgggtgattgtcttttccttttatatttctgcatgttttgtatattttttataataatatctgacttttatcccctatgaaagtgtcgcttaaaataaaaggaaaggggaaaggggggccgggcgcggtggctcacgcctgtaatcccagcactttgggaggctgaggcggacggatcacctgaggtcaggagttctataccagcctggccaacatggtgaaaccccatctctactaaaaatacaaaaaaaattagtctggcataatggctgggcatggtggctcacacctgtaatcccagcactttgggaggctgaggtgggtggatcacctgaggtcaggagttctatatcagcctggccaacatggtgaaaccccatctctactaaaaatacaaaaattatctgggcatggtggcaggtgcctgtaatcccagctactcgggaggctgaggcaggggaatcactggaacccgggaggcggaggttgcagtgagccgagattgtgccactttacttcagcctaggtgacagagcgagacttcgtctcaaaaaaaaaataaaggtcgggggggaagggcagggaagcagaccgtccacgcagggttttggcctccttgctcatgagctgttggctgtgctttgcgtttgtgcaggtggaagcagggaaaggcctggagatgaggaagctggttctctcggggttcttggccagcgaagagatctacattaaccagctggaagccctgttgctggtgagtacagtccctgctctggggccttccggtccccccgcccgtgttgggtgatgtcatgctctgaagctgcttttggagttggagaggaaaggggaccgtacccgtccctccctgtggacagagtctgcagctggtctgcttctggctgggcatcgggcagcccgggtcattgccagaaagggcctgtgcctctcagctccagctctcaaaaggcaggagaagcacacccggcttagagatggcaaacacacctgtcacccacgaccctggcatagggcatcgtgaacccatcacggtgctctgcctgcctgggcgggggccgagcgccttctccacgctgtgctctgggcagtcattcccaatcaatccagttaagaagtctctgccgtcttgtgtccaagtccttctacctccctgggtgagggaaccgttagtgccatcctgaggccccgtgtcaggaaatatgaggtgggaggctgtgttctttttttttttttttttttttttaagacggagctttgctcttgtcacccaggctggagtgcagtggtgcgatctcggctcactgcaacctctgcctcccgggttcaagtgattctcctgcctcagcctcccgagtggctggaattgcacgtgcacgccaccagtcctggctaatttttgtatttagtagagacaggattttatcatgttggccaggctggtttccaactcctgacctcaggtgatctgcccgccttggcctcccaaagtgctgggattacaggcatgagccactgcgcccggcctgtctgtgttcttttgagaagcggcacagctctgaggcatcaggccaagctcagccctcggtaacatgcctcagttcccctcccagatggaggcatcgttgtgagagtctgattgggaggggaatatgaaaatgttttcggaagataaaagtactacacagatgtgaggtggttttgccttggaagaaagtgctccttagatgtgtctggatgttatgcagagtgatcgtggcgtgtcaatctttcttttgggtattttgcagcctgagacataaggtaattgtcagaaaagggagacgcagaagtgtggatctgtggaagctcattcttaacaagaattctaagatgcacatttaagtacttgccatgacgtgaggtgttgtcacacgtcaaccctgagatgctgtcagtgtcccaggggacttgacatttatgttacccaggaatgactgtgtaaatgtgcaggtgcaggccgggcgccgtggctcagtgcctgtaatcccagcactttgggagccccaggtgggcagatcacttgaggacaggagttcgagaccagcctggccaatgtggtgaaaccttgtctctgctagaaatgcaaaaaaaagccaggcgtggtggtgcatacctgtaatcccagttactcaggaggctgaggcatgagaattgcttgaatctgggggcgaaggtcgtagtgagctgagagtgcgccactgtactccagactggacgacggaagtgaaattcctcaaaaaaaaaggctgggtgcagtggctgacacctgtaatcccagcactttgggaggccgaggtgggtggatcacctgaggtcaggagttcgagaccagcctggccaacatggtgaagccccatctctactaaaaatacaaaaaattagctgggcgtggtggcgggcccctgtaatcccagctactcaggaggctgaggcaggagaatcgcttgaacccgggaggtggaggttgcagtgagccgagtttgcaccattgcactccagccggggcaacaagagtgaaactctgaatgtgcagctgttttgccacacgccaggctgagtacgtcccatctctccaggagtttatctgtgtgtacggagctgttttccaagtgaggggcagtgtggcaggtagctgagggtcctggtctggggccagagctagggcaagacttggccctgccattaagagcaggcgtattgcactgtttctcaaactgtgcctctcagcccatcagtgctttgggttgtgaaatcagtacagtgggttgtgaaaccagtacagtgggttgaaccagcatttttaaaccaatgaaaaaatgtcagcatgcatcatacacgggaaagataagtgagggaactttcggtttgttgtctgtctgtgtgcctgtatatatatgtaattgccgggcccatggtgtcttacacctgttgtgggtttgaaaactgctggctttggccgggcgccgtgtctcaagcctgtaatcccagcactttgggaggctgaggtgggcggatcacgaggtcaggagatccagaccatccttggccaacacggtgaaaccccgtctctactaaaaaagtacaaaaaaaattagccgggcgtggtggcgagcacctgtagtcccagccactcgggaggctgaggcaggagaatggcgtcaacctgggaggcggagcttgcagtgagcagagattgcgccactgcactccagcctgggcgacacagtgagactccatcacaaaaaaaaaaaaaaagaaaagaaaactgctggctttgggcaagccctacataaattccttgagcctccatttctggatctgaagatgagagggatgccattctttctctctctttccatggggttgagaagatcgggagatgctttcgggacctcatacagcgttgagttacttaagacactcaactgttagtggaagaaaggaggacaggcaaagagacaacccgtcagacattcgtgaaacacgtcttccaaaccgtgaattgctgtccaaaaaggaacatagttgtcattactaacagggtgtgtatttgaaaggagttcagacagaggatctagactgcctggccgtactggctccaggctttcagcaggtgaatgagctatcgtgcctcagtttttccatctgcaaactgggtatacaaatagtatgcttttcatggggtcgttgtgaggattaaaggaatttatacacagagttctttttttttttttttttttgagacggagtcttgctctgttgcccaggctggagtgcagtggcacaatctcggctcattataacctccgcctcctgggttcaagccattctcctgtgtcagcttcccaagtagctgagattacaggcacccaccaccacgcccagctaatttttgtatttttagtagagatgagatttcaccatgttggccaggctggtcttgaactcctgacctcaagtgatccgcccgcctcggcctcccaaagtgctgggattacagatgtgagccactgtgtccggcacataaagctcttagaacacagcctgagtgttcgttgacactgttaatttctctattgctgggagaggagacaggttagggcttcgtggtttctgccacaacacacccgttccctgaaggagggagtggcgcctgtccccatcagacacggagcccttagatcccacctgccacccacgagcctcttcctctgggccaagaccaagagcccctccctgctctgcctttctaacagctcatgccccaaaggcagaatctgtggggcaggggcccccttcctgatatgcctggcgcaggttccccccttccccagctgtctcctcccggggcaggttccccccttccccggctctctcctccccgggcaggttccccccttccccagctctctcccggggcaggtttccccccttccccagctgtctcctcctggggcaggttcccccattccccagctctctcctggggcaggtttccccccttccccagctctctcctcccggggcaggttcccccacttcccccagctctctccacccggggcaggttccccccttccccagctctctcctcccggggcaggttcccccccttccccagctctctcctcccggggcgggttccccaccttcccccagctctctcctcctgggcccctgcttggctctttcttgagcagagaccagagggagcaaaggaagaactcgctgggaggccaggtctgtggtaggagggctcaggaagaggagtaggaccctccacagccacagcctcagaagaaaacctcagagtgaaagaatcacacccttcctcctctcctccctgagctgggaacccctgcaccctccccacccctcagctaggaggaagctaaaccttctgctcttcggggtggcctcgcaaaggtgccagcttgaaggaggagaaattcgttccctccatgctcgctttcccactcctgaccccattcccaccgctctgccccagcctgtttgctttcatctgaacacttcctgatatgcaaagggctgggtgtgtgtacctaaaaccatgtgcacacacggggcagacgagcctccacacagaagcctccgtcctggcctctggggtgcttgtgggggtcatcttctggggccctcctgcttcctggtgggctctgattacaggaaaagcctgggagcctgggccgaagtagggggtgaaggaaaaaagatgaagccaactgcattgaaattctggatctccttgacactgggaactgagcttgggaactgtgtcttgctacgctggggccacagggtgaggccactccccagagcccctcccaccgctggccacgactggccctcctggggtggactcctggccacgctgcatcgcaggctctttatctataaaacaggtgaatgaggccttcctccctgggctccagtgacgagtgactcgggtggcatggcagcaagcatgccaggccttctggggcaggaggtggaggaagtgggtacatttctttcccttatttcgaaaggccggtcgctgggggacagagctgacaaacggctatgtgaagtcccactggcaagtgagaaccggcccaggcccgtcttcctgagaagcagctggcctgggagccagggttgaagtcactcacgggtcctctccgagaactcgagtggtgaaatggagagccggggcctgcccttgtccctgcagcaggactggggaggagggggtgcctgagtggtgtgctagcgctttggcagaatggctgtgccgtgccaaagctcagtgtgggtcaccttgcctttcagtccaccctcctgcccctgagcccatacgcaggacttcaccagagacaaataacggcctcgagggtcctggccagccaagggcacacacccagccctgtcccctccccgcgagtgaaatcaggagtaacagccaaggtccccatcgtgtcatgagaaccatctgatgccccaagcgcaggccccgtccttgtgactggctgtgggtgagcgtccatttcttccccttttgcagacggggtgggaagttgaggaggaagcataaccattgtgttttgtcttcgtgtgggtggcagatgagcgcgtcgcggcttctgagaaatcccgtctccttggccttcctgggactgctgaccttcctgcttcccttatttccccctcagtggggactgcgccaaggcggggacaagaattcttgggtatggggattctgtggcgactctgcgggctcctccgtggggtcctgcgttgaggtgaaaaggataaactcttacgacgatgtcaatcctgaagctagttccatgtccctcatggagggtggggagtccccaaagctttcagctcacccacctgggcttggggggacactcttcccttgctcctgcctcccggtgccttctgtttccctgtctggcatgcctctctacgcccccactcctccacctgctcagctctccaaggacctggtatgtgtgcctcctccatgcagccctccaggctactccagcacaaccttggaaccatgtggttggtgcttacagtcagtcgcatcgtccatagtcatttcatctgtgttggcccattttgcccaactggattataaaggtctcagccaggcatggtggctcaacacctgtcatcccagcacttcaagaggccgaggcacgtggatcacttgaagtcaggagtttgagaccagcctgaccaatatggtgaaaccccatatctacaaaaactacaaaaactagctgggcggggtggtggacacctgtaattccagctactcaggaggctgaggcaggagaatcgcttgaacctgggaggcggaggttgcagtgagccgagattgcactattgcactccagcctgggtgacagagtgagactctgtctcaaaaaaaaaaaaaaaaaattgcagtctgggaccatgatcgtgtacgcactgacgggaatgccagtaggtagcgcatggctgtattatcccagtttcacacatgaggctgctggtgacacgaagcccagggatgctgagtgatgtgcgcacagcagagctgcgactcaagcccaccctgcctggcctgcaccaggtggaaccccatgcgcttgcctagcaaggaccagacaccgaggggccgttggttctaggacggcgagggtcagaaggagaggcctgaccggacgcagaggggccgttggttctaggacggtgagggtcagaaggaggggcctgaccggacaccgaggggccattgattctagcacagcgagggtcagaaggagagtcctgactggacactgaggggccgttgtttctagcgcggcgagggtcagaaggagggtcctgctttgtcctgcatggattgttggatctgggctttttagagctcggaggatgaaggagccagaaggcagagcaccatctgggtgtctgagtagatgagacgacttcttccagtgaacatgggttctgtctccatcagagtgaggcgatatatctgagtagatgagacttcatcagaatgaggtgatgtgaggctggagtgaggctgggctgggagtttgccgtggttggctggagctggtggtcgtcgttcagagggagctggcgctggctttggtgttcccttcagtgcagcattttcagcagtggagtcacccattctctgctagaatgcttctcttgtcggaaagctcactacttaatcctatgggggacagctctagtgagcccgaatctgaccccataacttttccccactgttcctgggtctgcagagcaacgtagattaagtctaagcctcgtttttgtttttggagacagagtctggctctgtcacccaggctggagtgcagtggcgcaatcttggctcactgcaacctctgcctcctgagttcaagagattctcctgcctcagcctcctgagtagctgggattacaggtgtgcaccaccacgcccagctaatttttgtagttttagtagagacggggtttcaccatgttggtcagacttgtctcgaactcctggcctcaggtgatctacctgcctcggcctcccaaagtgctaggatgacaggtgtgagccaccgtgaccagccaagtctaagcctctttccacgtggccttcaggtaggtgaagaacatcaacagaatccgacatggctggccgggcgcggtggctcacgcccgtaatcccagcactttgggaggccgaggtgggtggatcacgaggtcaggagatcaagaccatcctggctaacacagtgaaaccccgtctctactaaaaatacaaaaaaaattagccaggcgtggtggcgggcgcctgtagtccctgttacttgggaggctgaggcaggagaatggcgtgaacccgggaggcggagcttgcagtgagccgagatcgcaccactgcactccagcctgggtgacagagcgagactccgtctccaaaaaaaaaagaattcgacgtggctgctctccctctggccaccctgcccttccctgccacaccttccctgtatggcaggttatcaggccctgtgtcctgcagggcctttgcagtacagcctggtcatctttggtttttttttttctgattattcatattcattcattgtaggtgatttataaaatgcagagaaccacactgaggaaatgcctgcacgtcccgttatcccacggtcccactgctaggctggaaggtgatggcatcagctcccggccagtgctgggggttggtctgtgttatctgccacctcaccgtctacactggcaggccctggagcatcttggtatagacaggcaggcattgagaaagagtctgagactggagacccctgccatgcgcagtgggaaggaccatcacggtcgcttagcaatgtctgccacgggggtgggctgcagtgggggacacgtgaacgcccatgcctctccctgtgccaagtgacgggaacttggaacatcagtgaggccaagactggtcttgagtaacttcgggtccctaccttctgagtcctagaaccacattctgtttcttggaaggaaacagctataggcttgagttccctgtcaaccctcccttccactgaagtgtgacaaggagcttatgactcggggcacaggctatcgtggaagaaagacgcggatcctgttaacccagtacaggctgctgctgagctcagctgcgtggtaggggagtgagcccaggcaccacccctcgggcctggcacagctgccaggccaggttcctgctgtcgagtgtgcggcttgttggggcctgtggcagtggctccttgatacaaagctcgtttcagtgccctgcctttggcagccttgtctgggcaggacttgggcagcgggaagggctaacgatcggccccggggcctgccgacactctggtttgtttacccccgacctctgctctttcttcctctgtttctcccagcccatgaaacccctgaaggccaccgccaccacctcccagcccgtgctcaccatccagcagatcgagaccatcttctacaagatccaggacatctatgagatccacaaggagttctatgacaacctgtgccccaaggtgcaacagtgggacagccaggtcaccatgggccacctcttccagaagctggtgagtctgccagggatggagggtcctcacgcagggcctcagtggagcccatagtgttgcaggagcctcaggagaggaccgggcagccctctcggactccttgaaggcctgagacctctccgagtccgggaggaaggcctgggcctgtgtgttatggggtgcctggggccggggccttgactctaggcctcccctggtgcagccctgggagcttctggggtggtggagacaggctgtgtggataggtccttccaggggtggtggagatgggctgtgtggatgggcacttctgtgggagcaccatctctctcccggagggtgctccttctccctcccggagggtgctccgtctttcccggacggtgctccctctctctcccggagggtgctctgaggaaccagccctggaatgaaggcttcttgctgggcttcagtctcctgtccctcagtgaacagaggggcacatgccgggttaggggcatgaggactgctcccctgagacctcgggtctgtaaaaggaagcagttgggcacactggccgatgatcctctcctgaggtcccaagagcaggaagcactgaagcccagccctgctcaccactgcagggtcgggagcggcaggagtgggtgggttaacatgcagacctcgtgttgggaaacgttcacagaagtcttctggttccctgtgcttctgtgacaccctctcccccagctctgccccatctctggctgtgtcccctggaggacccccaggtcagactcatggagctccctccccacctctgctacgtaacgtctgaccgcccagcaggcaagagggagactgggagtccaggccgcggttcttctctgggtgtgagtggccagaggaccttctcctccttcctgccctgttctctgggtgtgagaggctggaggcctcctcccctcccctgccgtgttctggctgaatggacagggctctgcctttctcacgctggagaagactctccctctcctgcctggacactcctaggacctctagctgagtgtgttcagagctgagctccctgcctccggcgtcacctgctccgcttcctgtctttacctcaccgagtgcttcagactctttctggctgcaccccctcccccacctgtcctgtggactccactttttggccgttgctcacagccgccttttcctcttcttggccacccatggccctcacctggacagctgcgtatcctcctgtgtggctcctgcctccaggcccactcacctcccacccccacctctccttagaggggagagagtcactgaaacctcgacggccccttcagcggatccccacggccctcggatgaaggtcaggctccgaggaatggctcgagagaccctttgcacactgacccgtgtccagccccagccttggcagcttcctccccgcacctctgtgctcctgacactggactttctgttctcagttcccagggcaggcactttcttaactcttggtacttgaggccccgtgtgcctgaaacgtccttccccctctcgtctggcctcccctggtcagttcccagcttagaagggacctcctccaagaaggctttccaagtcgccaaatgcaggccttgtgccagtcctcgtagtgagcactagtaactgcctgcctcccccaaaccacaagttccaggaggacggactgcatttcctttttttgttgagacggagtctcactcctgtcgcccaggctggagtgcagtggcgtgatctcggctcactgcaacctcctcctcgcgggttcaagtgattctcctgcctcagcatcccgagtagctgggattacaggcgcccaccatcacacccggctaatttttgtatttttagtagagacggggtttcgccatgtcggccaggctggtctcgaactcctgacctcaggtgatccgcccgcctcggcctcccgaagtgctgggattacaggcgtgagccaccgcgcccggcctgcatttccttcttcttagactcccagaaccagcccagtggtcactgcttgaatgagtgaatgcaccgtgaccttgaccactgggcctcgggagaactcggaagggcatggagggagacgttgcagggcctgagatttctgtcctgagagtcctgtttctccagcacagcttctagagccgtgtcacaaagtgggcttgaatcccagcgctgccagattaaacctgcaactgggcaacttacccaaccgctctgaatcagcttcctcatctgtaaaaaacaggatagtaacagtatttacctcattgggtgattttgaggagttaatatctgaaaactgcatggggctgagtgtggtggctgacgcctgtaatcccagcactttgggaggctgaggctggaagatcacttgaggcttagagttcaagaccagcctgggcaacatagcaagaccctatctctacaaagaaatagaataggcctgactgagcgtggtggctcacgcctgtaatcccagcactttgggaggccggggtgggtggatcgtgaggtcaggagttcgagaccagcctggcctacatggtggaaccccatctctactaaaaatacaaaaaaattagcagggtgtggtggaatgcacctgtagtcccagctactcagggggctgaggcgggagaatcgcttgaacctgggaggcagaggttgcagtgagccaaaaccacaccattgcactccagcctggatgacagactgagactctgtctcaaaaaaaaaaaaaaaaaaaaatggctgggcacagtggctcacgcttataatcccagcaacactttgggaggccaaggtgggcggatcacctgaggtcaggagttcaagaccagcttggccaacatggtgaaaccccgtttctactaaaaatacaaaaattagccgggcatgataacacgcacctgtgatcccagctactactcgggaggctgaggtgggagaatcgcttgaactcgggaggcagaggttgtagtgagccgagatcgtgccactccactccagcctgggcgacaagagcaagactctgtctcaaaaaaagaaatagaatacaataaagtaaaagaaaaagtgcttggaacagggcctggaacatcataaattaataagtactcaataactggtcattatcatcagtgccattattattattattattattattattattattattattattaaattgggaagaggcaccctggaaggtatccttccaagggaatgccacactctggttctagcatacccccccctgctccctccggttcagggatggtgaacacctgtcatcactgcctgctcacctgagctgagtggcctggggggcatcctctcctcatccctcaggagggtagaggagagcaaacctagggttgctggaaacgctgtcacagtttatctttgtcacttggacctggctgtccccggttctggtcttggctccacaggcctggccgtgaatctgctacccaccactttccctccccagcatcgtgaaccgatgcctgaggcccctggggctgcagatttgggagggcccggggggagccgggtcaggtctggcatccggaggtggtttattttcagccgaagactctgggtatttgattattcgttactgagagaagggaattagcgtctctgctgtttgttttatgagatcactccagtgccaggctgctgtttccaggcaacctgcacttcccagttaatgaacctgccaagccaggcctcgggccctaccgcctggggtgactgtggcagcggcagtccctgagattaccgtgaccctggacgcaggcctccgcacggctggctcctgcccctggctcctgggagggtggtgtgccaacccgggcctccaggctttctccttcttgtgggaaagggggcaagaggagccttttcctggaagaatatcggtgatctgactttggcttaggcagcgactgtctagtatgcctcgtgtagcgtgggcattgatgggccgggcctcagtactccctggaaaaggaaataaactccctcccgtccggccccgcccccttttaaggtcaggccccaccccctttaaaactcaggccccgccctcttttaaaagtccggccctgcccccttttaaagtcctgcccttctgcagctgagacctgaatgcctctggccttggcgtcacgccgggcgtccccactcgcgctcccctctggcttttccagatgccccccgctcccctgccccaccagcttcctcaaagggctctgcctctgtactgggaggctccaggctcagccgatgctgcggccagcctgcccccacccctacccccaccccagcctctctgggtccttggggagcatgaggatcctgcagaaagcagagtggtccggggtgggggtccacagcagcccacttcccccagcaccttggtgggaagcagaggcccctgaggaagccaggcagcagctgtatcccccttgctgctgtattgaaaaacatttaaaccagaaactccaaagaataacagcagaaccttctaatgaagaaaatacagcgtcacacatgaaggtggagtctcccctccctcctccctcttgaagcagctactggcatgaatttggtggatagccttccagactgcagtttgtgtgtttactacatatctgtatctattttgggttggcctgtactttaaaaaaaaaaaaaggtcttgctatgttgtccaggctggacttgaactcgggctcaagtgatcctcccacctcagtctcccaagtagcgagggctataggtgtgtgtaccacagctcccagctgcatgtactttaaaaatgtgtctaagccaggcgtggtggctcacgcccgtaatcccaacactttgggaggcggaggcgggtggatcacctgaggtcaggagttcaagaccagcctgaccaatatgacgaaaccctgtctctactaaaaatacaaaaactagccgggtgtggtggtgcgtgcctgtagtcccagttagtcaggaggctgaggcaggagaatcacttgaacccaggaggcggagtttgcagtgagccaagatcgtgccagtgcactccggcctggttgacagagcgagactccatctcaaaaaaaaaaaaaaagtgtataagtatacacatatatcatattttacagttcaacccatgttcgttttggagcttgtcagcaatcgtattttacagttcaacccatgttcgttttggagcttgtcagcaatgctatgtgtaaatcgggtgcatccatgttcatggctgtgtgcgcggcttcccccgtttgtgagcatttgttaccagtccctccactatgaggaggaaaagtgagatggtgaacacccttgagtcccctggggcacacacataggccatttgctccagagcactgctgtctaatggaaatagcttatgagccacgtacatcatttcacattttctaatacccaccttttttttgtttttttgagacggggtcttgctcttgtcacccaggctggagtgcagtgatgcaatctgggctcactgcaacctccacctcctgggttcaagcgattctcctgccttgtcctcccaagtagctgggactacagatgcgtgccaccacgcccggataattttgtatctttagtggagacagggtttcaccattttggccaggctggtctcgaactgccaaccttaggtgatccgcccgcctcggcctcccaaagtgctgggattacagttgtgagccaccgcgcctggcccctaatacccacatttttaaaagtaaaaataggcaggtgaaattaattttgagaatatcttttatttattcccgcagatccaaatattatttgaacatgtaatcagtatttaaaaattaacgaggtaatttacattctcttttacatactaaggctttggaacccactgtgtattttacatgtccggcacgtctcagtttgaaccggccgtatctcaggtgcttggtagcctcaggtagctggtggcgactgcactgaacgatacggctctgcagtttgtatgtaaaagtggatttgctaagcaatcgatgggctgtgcctatccacactgttattagttcaactgaaaataggccatgcctattctcagctttattagttattaacaaattgctctccaaataattgtactaatttacacttccccgagtagtctaagagtttaaattggccgggcgcggtggctcacgcctgtaatcccagcactttgggaggccgaggcgggtggatcacgaggtcaggagatcgacaccatcctggctaacatggtgaaaccccgtctctactaaaaaaaaatacaaaaaattagcctggcgtggtggcgggcgcctgtagtcccaaccactcaggaggctgaggcaggagaatggcgcgaacctgggaggtggagcttgtagtgagccgagatggcatcactgcattccagcctgggtgacagagcgagactccatctcaaaaaaaaaaaaaaaaaaaagttttaattggccgggcgcagtggctcacacctgtaatcccagcactttgggaggccgaggcaggtggatcacctgaggttgggagtttgagaccagcctgaccaatatggagaaacgccgtctctactaaaaatacaagattagccaggcgtggtggcgggcgcctgtaacgccagctactcgggaggctgaggcaggagaatcccttgaatccgggaggttgcggtgagccgagatcgcaccactgtactgcagcctgggcaacaagagcgaaactccatctcaaaacaaaaacaaaaacagggagtttaaatttccccatatgcttgccagccgttgctgtcaattagacttttaaattttgacccttctgatgagtataaaatatctcgtgatggctttaatttgaatttctaccctttggtcccttaagaggaagtgcttatatacagcgcagcgaagcctttccataaatatttggggaattgacttatggagcctcggtttccccttttgcagaaaggggcgatggggtctgccctgcctctcagaagaggcgaggctctgtgtggttgtgactcaggttgtgactgtgtgagtgacaggcaaacgtgtagtgaggctggggctttggctccttggaggtagaggaggtggaagaggtgaggacggggcctcaaggccaagggaaatggaaagacagcatcttcatttgttgttttgttttctttttgagacggagtcttactctgtcacccaggctggagtgcagtgacacgatcttggttcactgcagcctccacctcttgggttcaagcgattctcctgcctcattctcctgagtacctgggattacaggcacgcgccaccatgcccagctaatttttgtatttttagtagagacggggtttcgccatgttggccaggctggtctggaactcctgacctcaggcctcccaaagtgctggggttacaggcgtgagccgccacgcccggccaagacagcacctttaaatgtcgttccccacgctgcacgtggggagggaggcctgagcaggccacacgtgccagctccccccagcacacacacccccctctctccctgctccggctaattccaggatgtgaaggaagtatgagacattaagggatttcaaaccctgggagaccttcaccgtgctgaggaaagctggatgctgtgaagagttgaatttctagcaggccaacaaaggccctagcctggtctccccaaccccagaccccctcattaaccttattggctgagctggtttccatggaaactgtccagttcaaagggacactgtaatatgttcatccctgcgtttccccaagttcccaacgagctgagtgagaggttttcagtgcaggggagctcccggtgctccgtgaagctttcatccattcattaatcctctcccctcccaccctcctctccctctgttccctgactcctccctgcaggccagccagctcggtgtgtacaaagcgtttgtcgataactataaagtcgctctggagacagctgagaagtgcagccagtccaacaaccagttccagaagatctcagaggtaggccgctccccacacagccaccctgagggacaaggagctttgggggctgctcagagcccttggtctcccctccctcgcttgccagtcggtgaagtggttactctaatgggtaacacttagcctgatatttgctttcttgcacctgacattttccctcttaatagaaaacgatctattttatttatttttttattattctctttcagattagagagaggaacaggggaggcaaaaaaaaaaaaaaaaaaaaaaatccaaggcagtgttctcccacaccacactatggtgaccttgagcaagtcacgtcccccctcttggcttttatgtcctgtccggtagaatgaggggtttagaaatggccagataatcctttttttttttttttttttttgagacagagtcttgctctgtcgcccaggctggagtgcagtggcgcggtctcggctcactgcaacctctaccccctgggttcaagtgattctcctgcctcagcctcccaagtagctgggattacaggcgcacaccaccacgcctggctaaggtttgtatttttagtagagatgaggttttgccgtgttggccaggctggtctcgaactcgggtgatgtgcccgtctcagcctcccaaagtgctgacattacaggtgcgagccactgagtccagcttggccagctaatcctgaccttgcttgataagaatcactggggcattgtttaaaacacagatttcctggcaccttccccggagcttctgattcagaaggctttgcgtggggcccaagattctatatttgaacaagcttctgggtaatatttatgacagggaagtcttgaggaaatttggactataggtcgtcttttaaggttcttgccaactctaagactgccatcccataaacacaaaaagggtaagagccacttatgtggagaaggagccttagaatccctggccgggaacacgcgtgcttctgctcctgaggcccagccttcctggccaggaacacgcgtgcttctgctcctgaggcccagcctacctggccgggagcacacgtgcttctgctcctgaggcccagccttcctggctgggaacacgcgtgcttctgctcctgaggcccagccttcctcccgcactcctccacagggcagaggtgcagtcctatctgccatcaacatttctacctaagaggtggcatggagggacagttgcttaggatccttcaggacagagcccagttcatccctttgtccaaaaagacctcagtggcacccctgaagcactggcctgagaggaacagcccccagctcagggcaagagaacctccatcctagaaaaggggagaagcttctgcagttttgggagtcctgccgtaaaggcccctcttggccctttgtgttcccgtctcagctctaacgctagaagagttggggaaacgcagggtagttttcctgaaacttcaggggtgacggtcgatgcccacgtttagaatccaccgagaggcagcagagaagctgacagttggagatgaacatgtcagcttcattactgttaaaaaaatgcagcttggaaaatgtggatttggatctgtagccacagtgggcttgctgacacttcgcctctggaatgaaacgtacctatagaagccgggcgtggcggctcacacctgtcatcccagcactttgggaggccgaggcgggcggatcacctgaggtcaggagtttgagaccagcctggccaacgtggcgaaacgccgtctctactaaagatacaaaaattagccgggcgtggtggtgcacacttgtaatcccagctatttgggaggctgagacaggagaatctcttgaacccgggaggtggaggttgcagtgagctgcgatcacgccactgcactccagtctggtgacagagcgagaccctgtctggaaaaaaaaaagtatctattgagtcccttgcaggaataggaaaacacaggcccctctccacaatgaggacagagcccacgcctcttacccagtgtgcagagagaggatggctgaccatagtttcttctcccagacccatggagcagatgtgtcaccctctgcctgggaggacgaagtgcagggtggggaagtccctctccatggagtcaagtggctggagaggccaggtgcagtggctcacgcctgtaatcccagcactttgggaggccgaggcaggagattggcttgagcccaggagttcaagaccggcctgggaaacatggtgaaaccccgtctctattaaaaatacaaataaaaggggctggagaaatggtgctttccctgcggtttccagcccaacccaggaactacctggactcccctggtctgtgttcagatcagccctgccaaggccgcccaagatcccggggtcagacatggtgcagagagtgtggggtcttctcttggcctgggctgattgcctgttctctgtgcctaggcagaaacccccacacccaaccataagcccctcacagcctgcccaccctggagggcagagccaggcccctggctttctgccaggtggcttctcatcctgactcactcgatgacgtgcttgcttcctgctgaggctgccacttaattactgcaattaggctcctctctgcagcaggagtgatttcataccctagacttcactggagggggcgtgaggaaacattcccgaaatctgggagtccaggcaccagccagagacacaggctggggacgctgagtatcccccacccccccgccccccaaaatatacacacacccaagctccatctccaggagttttctctgtctagaaacagcttgagacagaagtaggaagttcctgctgtctgagcgcttcctcccctgcagaccaagcaggtggcatcacctcggcagctgaccttggcctcatcacctgggcagctgaccttggcctcatcacctgggcacctgaccctggcctcatcacctgggcacctgaccgtggcctcaccttgcctcctgccttccctcccacacccctctttgaggctccgtgtgctccgtctgccaagtggggatggtattacagctccagttgcaggctgcactgtcctgttagcaaaagctggggctggaacgtctctaaaggaggataaagaggcttggagcagatgagtcatcccgggggtctttccagtactcactacctgctgcctggcttgggatccaggaggggcattggctgttcctccctcgaagcttcctctcggacccccagcatgggcagtggtgggtggggagtgtcgggggtgctgggggctgagtaagtgctctctgatgggggtaggatgcagctcactgtcctggggagctcagcatctctgccgaaggtccaccacttccctgctggcgtgtgggacccttccttcctacctcatgggttcctcatgccctaaagattggctggagtacctggcgctggtcaactcaaaccctgtctgcccttggccgacgtgtagggttcctgagtcggggttcctgtaatcacagggctccctgccagcctctttcatctctgggacctggagtcccttccttcttgcccacgccccagccactggactccacgaggctccaggagttcacaggtgtggtgcaggggattggggtggcagaggcagcccatggccatggggctcctttgtctttcttttttttttttttttttttttttttttgagacagagtctcgccctgttgcccaggctggagtgcaatggtgtgatcttggctcactgcaacctccgcctcccaggttcaagcgattctcctgccccagcctcccaagtagctgggattacaggcacctgacaccacacctggctaacttttgtatttttagtagagatggggtttcaccgtgttgaccaggctggtctcgaacttccgacctcaggtgatccgcccaccacggcctctcaaagtgctgggatgactggcgtgagccgccacacccggcctctgttctcatatgtacaccctgagtttcagaactccccttcttgccaggctcacagtgggggctgggagaggtgagggacagaacaggccatgactcctctcctccctttggcaggaactcaaagtgaaaggtcccaaggactccaaggacagccacacgtctgtcaccatggaaggtacctcggggagcgggctggattacaggcacctacctttgtctggctgtgcaggcaacaggctgcgtgaacgcggcgcccttccccttgtgtgtgcgtgtgtgtgagcgcgtgtgagcgtgagcgtgtgtgagcgcgtgtgagtgtgagctgagtgcgcgtgtgcgcgcacgcgaggactctagcctcgtgcccaggcagccagccagctacaaacgtgctcctctttaggatgccagcaggctgctggctccctccctccctacccctcctccccttccccttccctcctctcctcgccacgcgcctccctcccctcccccttgctggaagagcactccggagcggctgcccgatgctggagtccgtgcggcagcatcagcaaggtggctgagtggccgggctgctggtgggcgccggggagcctggagcgatggctgcacgctcccgccgcggggacagaggctgccatggagattctcctcattattcgcttctgctgtaactgcacctatggtaacccaggtgctcgctgtgggaggtggcggaccctcccacctctgggggccggctggagtgggcttagatgtggccggggaggttagagggccgcagggaaggagggtgggcgagcggctggacctgaattcccccttcgttttggcggcatccagcctagagttgaaacctgggggctgctcagagcagggccgcttgcaaatggaaggaccaggctggaggggtccaggtggccccgaggatcggtggggaattggtgggctagtgtgagagaacttcctggaggggctgttagggagagacggcgacgagctgtgcccgcagacgtagtagccctgaggccagggagagggtctgcgggggccaggcacagcgtggcgatgggtggcgatggtccggacggcggcgttgccagccgagagggtgccagcgcgagccggagggagaagttgggagtttctttgtttctggagagaggcgcggaggctgggcggcacggtattgtgtgctccgcgcacatgcagcagtaggcggaggacacggaggggctgtgggagcaggaaggagaggtttgtttccagccgtgagagacccccagccgaggtctgggccctcaactgtggaaggcaggtcggcagggccagcgggagaggggtgtggcaagctactctgtgaaggtcacacacacacacacacacacacacaccacctttcggtggaagggacccggaccatcctccttgcagctcccgcagctggctgggggctgggggaagtcccgggacaggtgcatgtcatcaacacgactgttggtcgtaggaggatgaagccggcccaggtagggaggtgtccagaagcccgtggaccctgcctcaagaggcaagacgtgccaaggggtgccctgcctgcctgtggcagggagtggggtgggcacgtgtggctcccaggccggctgctctgggcctgagtctgtgggagcagcaggcggctggttttaggaccttcctcttccttcccaccaggtgtttcggctctgcacccttctcagtcactttgctttcctatctccctggtaacctggagctccttggagctccttgtcgaaggctgacttgagggggatggtggcttgccggaagagagatggcaggtttcctgggctccttcccaggggcggctgtgctggaggggctgtgtggggccagtgccccctgaccttctcaggaccctcttgatggaagcaagctctgaggcagcctctctcctgcggcccagcagggcggctgcaggaaccctgttctcacttgaaattggcctggtcagcgatcagaggagaaatggtctttttggtctggcctaggagttggtcaggtcttgactctgcctccctgaaaaggaaacgtacccttggcttcctctcccttccccaaaaggaagcttcgactcagtgaaacggacctgggacctggagttcacgttgcttcggtctccgtgatactgttgttgaagtcggcttcaaagtggggaatgaggagtgaaagggccagctcgtgaggagggggctcaccccatcctggtcactctttccaagaacgctcctgtggttcattgaggttttacaggtgctgcctttccctgaagaaggtgcagctcaaagcaaggagtgcgggtggatctacccagctcccaccacttgtagccacaagtctctggcctcagttgccttgtctgtaaaatggggctagtgagaattgcttcccgttttaatcacaggaaataatgagagcaaagcagttaactcagtacccttgggcacagagcgagtacccagcaaactagagagagaccagcttgctgcccaagtcagtgtcagtggagagggagagtgggtgaggccgggcaggaagcaggccagcctgcaggagcccagggacaggggaagggccagagcgagtgcctcaccctgagttctcaggggaccccagcgtgcaggggccgtggggagcacaaacttcagggccgctcttattcccccggttccctccgtatctgatgtggtcccagtgccgccacccccccccgccccccgccccgtgcacctgccctcctggccgcccttccagggctcattccacagccttactcaggtggactctggaggtgaccacagacatgttaataacccctctgaaacccaacctgccatgtgttcagacctctgagcttagtcagaaacctcttcctcttgggacccaagagagggctgcggggagccgataatgcagtgtcagctttctgtggagccgccactccggagcccaccctggcaggtgtctgctgagcttgtgctttcttttgggtctctggggttctccagtgtgattttttccccctgaagatgggctgagccacaggtgggtgccttaaacagcctcagaaatggatcccacctgagctaggacctgggctgcaccctcagtgccgaggataccccaagactggcctcattccttcaagcttccatggcccatggggagggtctctggaaactgctagataagaaagggctacagatatgtcatatgaagtgtatttacgtaaaccagtggttggccgggtactcatgcctgtaatcccaacttttggcagactgaggcaggaggattgcttgaggccaggagttcgagaccagcttgtatttggcttgaggccaggagttcgagacgagcaacatagtgagaccttgtctctatatttatttttatttaaacgaagactcactgtgtcgcccaggctggagtgcaatggcgcaatctcagctcactgcaacctctgcctcctggattcaagagattcccctgcctcagcctcccaagtagttgggattataggcgcctgccaccacacctggctaatttttgtatttttagtagagatggggtttcaccatgttggccaggctgttcttgaactcctgacctcaaatgatccacccgcttcggcctcccaaagtgctgggattacaggcgtgagccaccctgcccggcccctcgtctctatatttttaaaaaaattaaaataaatacataaataaaacataaagcagtggttttcaaccattattatacattcaaatcagtaaagaagctttatagaaatgctgatggcccttgtggtcttgcagagatttgggttgagttgacggggctggggagcaggcatctgtatcttttaaccgctcccccagtgattccgacaggcagccaagctcggactgcgggtaaggctggtggccctgctgaggctgcattttcttcacagccagcagattgctccctgaagtgtctgcttagccgcgcacggggtatttatatctcaggctttggagaactatcgggtttggggcccggctagggcgtgcgtgttcacgctgggacctgtcacaacctggtcttatgggacacccagtctgggatccttcttcccagatgaccaacctgcctctgtcactgcccctgcggcaggaggcccaaggtcatgaccccagggacagagcatccaggtgcaggactgaagctgagcctcctgttgggagggtgggcgcagccgcgtacaggaagggtgttgggaagtgttgatccaccagctgccacctccacctgtccctgctgaatcccagccatcctcacttggtgtccgggttgtggagggtgtggctcttgggggcctgggctggccttgcctgcgtcctcccagcctctttggggctctcatatgtgaggcctaacctgagttgcttcaggaaacctttgcccctcaggctgccacgtgtttgagagcacagccttttttctttttttttgagatggagttttgctcttgttacccaggctggagtgcagtggcatgatcttggctcgctacaacttccgcctcccgggttcaagtgatttccctgcctcagcctcccaaatagctgggattacaggcatgtgccaccacgcctggctaatttttgtatttttaatagagatggggtttcactggttggccaggctggcctcggggagcagagcctttctgtggagatcaggccagcctcctggcctccagcctccctgcctccagccttcctgtgctttgctatctggggtttgaggatgtggggaggggtctttcctctgagagatgaggccagtcctgtggatcacagtgaggcatgccaatcccagctggctgtgcctggccttcagctccaggagcctgagaatgataaggtctggagagctgcccttcctggaaacacagcatgtctccttcccccattctggggtcctgcatgtggcaggtgtgctagactctgcagggcatggctgggtggagctgtgtgattctggggttctgcgtgtggcaggtatgctggactctgcggggcgtggctgggtggagctgtgtgattctggggtcctgcatgtggcaggtgtgctagactctgcagggcatggctgggtggagctgtgtgattctggggttctgcgtgtggcaggtgtgctggactctacggggcgtggctgggtggagctgtgtgattctggggtcctgcgtgtggcaggtgtgctagactctgcggggcgtggctgggtggagctgtgtgattctggggtcctgcgtgtggcaggtgtgctggactcttcggggcgtggctgggtggagctgtgtgattctggggtcctgcgtgtggcaggtgtgctggactcttcggggcgtggctgggtggagctgtgtgattcagggctgggggtccaggagagcatctgccttgagccaggtgaggccaggacaggcctggggaggggggcggggcggctctcgatgaagccatgtctgatgggagaggaggcagggctgcggagggagcaggggctgccagggctgtgtgtcacctgtgtctgctgtttggtcggcccggggagtgagaacagaggtgggggctgccgtgggctcactctggtgtccctcgaggggtgttcacgtgggaagcatgcgggtggggggacgaagctggtctctggggtgttgggttgccctcgtccatcatcctcttcctccttctccctgtctcccccgacagctctgctctacaagcccattgaccgggtcactcggagcaccctagtcctacacgtgagtgtcaagcctccgaatggccagagagggcttaggagttcagtggaagactgagcctgggtgagagggtgctggagtcaccgagaacagtccacctggggaatcaggggttcctaggctccaaggatgcctgtctggcccgcggtatccgtgccgccaggctagggcctgaatacagcttggctactaagcttgacgtggccaggtgctcccggggaggcaggcattcctgcttccccacccgctgcctcctggtctccagtgtccttggagcagctgcagggcagacacagggtttctctcccagctgctcggggggatgagcctccacctggtctccacactggggagagagtatgactgtggccaggagaagagggggcagccagggccctctcccctgctgtgctggctctgattttttttttttttttttttttttgaggcggagtctcactctgtcacccaggctggagtgcagtggtgcgatctcggctcactgcaacctctgcctcctgggttcaagcaattctcctgcctcagcctcccgagtagctgggactacaggcgcccgccaccacgcccagctaatttttatatttttactagagatggggtttcaccacgttgcccaggctggtctcgaacttctgacctcaagtgatcccccgcctcggcctcccaaagtgctgggatttcaggcatgagccgccgtgcccggcctgactctgatttgtagttcagattttgcgggaattaggcaggtccctgagtgcccaccctttggatggggactgagcactccccggtggccacacatcaggccccagagccgctcccctcaactcaccgcctcacccttcccaggacctgctgaagcacacacctgtggaccaccccgactacccgctgctgcaggatgccctccgcatctcccagaacttcctgtccagcatcaacgaggacatcgacccccgccggactgcagtgacaacgcccaagggggaggtgagctcagagcccggcacggcccctcacccaggctgagaagtatcaggtccctcgtccccttctctcacacacgggcggcaggtccctcgtccccttctctcacacacgggcggcaggtccctcgtccccttctctcacacacgggcggcaggtccctcgtccccttctctcacacacgggcggcaggtccctcgtccccttctctcacacacgggcggcaggtccctcgtccccttctctcacacacgggcggcaccgggtgcctcctgcctctccaatcctgatcccccattcccagccaaggagaggttttcagcccttggtcaccctgatgacctgcagctttccaggccctaggctgagaagtttaagtccagtgtctcattaatcctcataataatctagggaggctgggcacagtggctcacacctgtaatcccagcactttgggaggctgaggcaggtggatcacttgagttagaagtttgagaccagcctggccaacatggtgaagccccgtctttactaaaaatacaaaaattagctgggcgtggtggcggatgcctgtagtcccagctactcaggaggctgaggcaggagaattgcttgaacccaggaggcggaggttacagtgagccgagatcgcaccactgcactccagcctgggtgacagagtgagactccatctcagaaataataataacaatccagtgagccagaagaacctgaggctggggagtctctccaggtccaccacgcagtctttcagccactggtgtcagagctggattcctcacctgggactgtctggaggcccacgccggggaagtggcctccgggtgcctcattcttgaatgcagacacctgcctctggccagtgtgatgccgtcagggtctcctaggaagcgaagggagcaggagcttggagctgcttcagctcggcctgcacacgcagtggcttgcggggagcccacagcaggaaaggctggcgttggaggtggtggaggccgtccaggttgccggaatgtccagtgggcacctgcatgtgggacagccgttccctgggggcccttcttgatgcaagggtggggacagcccagcaaggggagtaccaggaagcatgagagggacagttgccttcgtggattggcagccgggcccgggtgaaaggcttcctgtccaggggaggccattaggcggccgttacgagtgaggctgacagggtgtctgctcctgtggtctgtttacgagcccccagggtctcctggggagaaagtggtgagggacaggcctggacagtgtccactgggcagagagagccgattccgtgcggctcctggtgctgatgtgcagcgtctggggatcccgtcgtctgttttactctggggatatctgaaaaatctccagagggcttagcgtaccctccgttttcagtcatcctttttttgagactgaatctcattccatcgtccaggctggagtgcaatggcgtgacctcagctccactgcagcctccaccctctgggttcaagcaattctcctgcctcatcctcccaagtagctgagattacaggcaggcgtcaccatgtctggctagtttttgtatttttagtagagacggggtttcgccacgttggccaggctggtctcaaactcctgacctcaggtgatccacccgcctcagcctcccaaattgctgggatgacaggtgtgaaccactgcgcccggcctcggtcatcttaattgtatactttgaatacgctcacctacgtattacagcagatgtaggtcacaccgtgtatcatacaggaaaggctggcacagatggggacgaccccccggctctgagcgggggttggaaactctggaactcccacgtggagcagaaaccacccagagcccaggttagagttggctgcaggtcccctctgggcactgctgcagtcccaggctggagggcccaggtctcatccccagggggctggagaagccagggaggagtagcacagacaggcctgagtgggtctcgggtctcgggtctcggttgagccggggctagatgaagttcgccgccgcggtcgggagggattgcaaacggggatgttcgtgccccagggtggagaaaccaggtcgtccagggcagggggctccagggttagccgcggagagccccgtgcgttgcacacacttaatgtgccaggcactgtgctgtttcacatgcaccatctcgatgagtcaccttatgaggcagacctcactgtccgcacttaacagaaggtgaatctgggattcagagaggtcagggagcctgtctgagatcacagctgagaagcctgttggcattcaaacccatgcccatgtgactccaaaggcagtgcttgaaccacctttggttaagggatgacaggctatgccgcctctcggtccagtcctccctggctggccgtgcccccgtgtgcaggctctgccctcggccgcattcccctctgagcaggctggggggtctgccatctccctcagacgcgacagctggtgaaggacggcttcctggtggaagtgtcagagagctcccggaagctgcggcacgtcttcctctttacagatgtcctactgtgtgccaagctgaagaagacctctgcagggtgagtgtgtgagtccaggggcacggggcgggggagggggtccggacctctgcggggtgagtgtgcgagtccggggcgggggagggggtcctgacctctgcggggtgagtgtgcgagtccaggggcgggggagggggtccggacctctgcgaggtgagtgtgtgagtccaggggcgggggagggggtcctgacctctgcggggtgagtgtgtgagtccagtggcacagggcgggggagggaggccggaccctgccacccatggagccttcagcaactttgttggttttttttcttttgagacagggtcttgctctgttgcccaggctggagtgcagtggtgcgatctcggctcactgcaacctctgcctcccgggttcaagcgattttcctgcctcagcctcctgagtagctgggattacaggtgcacgccaccatgccaccatgtctggctaatttttgtatttttagtagagacggggttttgccatgttggccaggctgatctcaaactcccaacctcaggtgatctgcccgcctcggcctcccaaagtgctgggattacaggcatgagccaccgcgcctggccggttttttccttttaaaaactatattaattaacttaatttcactacatagccttttttcctgaaagtaagtcatgtttttaattataaagataatataaggccattggaggaaaccccgtcccccactgaagcatgaggtccgactcctgccgcgctgcttccttccctgtttttaaatgttctcatgtttcttcacacagtcgtaatcactgtgaatgcccaatttggggctctgctgtttctgtttcgtgtcataagcattttccctgttgctgcctcatcttcataatcatccttttactttcctgcacgatgttacccgtagatgtgccatcgtctacttaagcattctccttttattagacatctctgaatttctgctaactgcagtgctgtgaatattcaccacgtctcctgctactatttattgagggtttatgccatgccaggtgccgtgacacatgctttgaatacatgatttctagtcctcccaacacctccacaaagtagcgactgttgttccctaatcatagatgagagaggagtcttggagaaggtaaataagcagcccaagctcgcacagctagaggcacaggtgggactggaaccccaagctgacgtgcaaactcctttgagcctccttctctctacccgggagggtgggactggaaccccaagctgatgtgcaagctcctttgagcctccttctctctacccgggagtgtgggtctgctctgtgccttgagcagaggctcattctgcgttcattcacacattcttccacccacacttagtgatcaactgcagtgtgccaagcacaccccttctcacggctgagaagcggcagtctggattcaaacccgtgtctgtgggactcgtttaccatcaggctatcttgcctctcccttcagccctccctggttggctgtgcccccaagtacagcacaggggactccacagccagtgtgttacaccaccaggctatcctacctctcccttcagccctccctggctggctgtgcccccaagtatagctcagggggagcaagccccacgcccacctcaacactcaagggtcagaatgagaagtgcaaatctaagtcctaggggaaggatcgatgattatgaacgtcaataaagggatgactgggcgggcacggtggcttatgcctgtaatcccagcactttgggaggccaaggcgggtggatcacctgaggtcaggagtttgagaccagcctggccaacatggcaaaactccgtctctactgaaagtacaaaaattagctgggtgtgatggcaggcacctataatcccagctacttgggagaatgaggtgggagaatcgcttgaaccctggaggcagaggttggagtgagtggagatcgcgccattgcactccagcctgggaacaagagcaaaactccatctcacaaaataaaaataatttaaaaaataataataataaaggacatgactccctggaactagatcatgtttgagatagttctgaggcagagatggcgataataagcacacatgcttctgcctgtcgtcctttgcgatggcagacattactaatcacatatgcctctgcctgccgtcctttgccatggcagacattactaatcaactagggcacactttcttgctagacttggatgtggctttgtaatcctccacccagtgttgacccatgtgaccactcttgataagaggtggcatttggaataacacctgtattccattgctagcctgaaggatattgaacacggatagtctagaagggagggaggggattgtcgtggggaataggaaaatgtgagcccagccaggaaggcttcgctcttcttgatacctaagtggtttgggatgtttgacaacacgagtcatctgggccagaagcctggtaaggtgaaggggcggagttgctccctgcgggcggggcggaccccagaacccagctttcatcactccagtgtgtgtttcccaatcaggctcctcaggagcagggatcgttcgtgcttctggcgagttctcagtcaacccctgtcagtggttctgtggttctggacccaagagttgaggctggaagagccaggctccctctggctcatggctccctctggctcgtttgcaggaagcaccagcagtatgactgtaagtggtacatccccctggccgacctggtgtttccatcccccgaggaatctgaggccagcccccaggtgcaccccttcccagaccatgagctggaggacatgaagatgaagatctctgccctcaagagtgaaatccagaaggaggtgagcagagcttggtatctgagcctggggccctttgagccagctgtgttgggggaggtggaggcgggaagttgtaaggtttgagactttgagagggagccttgagtgtgtagttactaagggaaagaccccgactacagtagctccaagcagatcgagggggtcagtgctcaggatttcatagggctaacatgggaagtgccctggaaagcagtgcatgttgaacacgatagaaaggggaagcaagtagccaggcgcagtggctcacacctgtaatcccagcactttggaaggccgaggcaggtggatcacctgaggccaggagttcgagaccagcctggccaacatggcaaaaccctgtctctactaaaagtacaaaaattagcagagtgtggtggtgggcacctgtaatcccagctactcgggaggctgaggcaggagaatggcttgaacccgggaggtggaggttgcagtgagccaagaacatgccaatgcactccagtctaggcaatagagtgagattctgtcaaaaacaaaaaaaaaaagtggaggtagagggaagcaagagaagaaaaagcaggcttttgtaaggaaaagcaggacctgtgcaaggaaaaagacctgggaggcctctcagaaactgacagatcaagtaggcaaataaataaggagagagaggacctgaatgccacaattaacatgcttgacttaaaaatgcagagaagcttgtgccctgacagaaaactgagattcttgtcacacacgtttgggaccttcacatttatcctataataggccactaaggaaatctcaaaatttttctgcaagttgatagcatacaagtcatgttcacagaccacagtggagtaaaattagaagtgaacaagaatattggtcagcctgggtgcagtggctcacacctttaatcccagaactttgggaggctgaggatggtggatcgcctgaggtcaggaattcaagatcagcctggccaacatggtaaaaatccatctctactaaaaatacaaaattatccaggcgtggtggatcatgcctgtaatcccagcactttaggaggcccaggcaggcaggtcacctgaggtcaggagtttgagaccagcctggccaacatggtgaaaccccatttctactgaaaatacaaaattagcctggcgtggtggcttccgcctgtaatcccagctactcaggaggctgagacaggagaattgcttgaacctgggaggcagaggttgcattgagctgagattccgctgctgcactccagcctgagcaacagagtgagactgtctcaaaaaaaaaaaaaaaaaaaaaaaagcattggtttggaaagttcaaactgacaaggtaaagaggaaatcaaaattcaaaatgagaactgcaaactgtttagtgctgtctggaaatgagtgtactacataccagtacccatggatgcagccaaagtgctgtttagaggaacatgaatagccctcagttcacataacaacagtgtctagaggaacatgcatagccctcagttcacataacaacagtgtctagaggaacatgcataaccctcagttcacataacagtgtctagaggaacatgcatagccctcagttcacataacaacagtgtctagaggaacatgcatagccctcagttcacataacaacagtgtctagaggaacatgtatagccctcagttcacgtaacaacagtgtctagaggaacatgcatagccctcagttcacgtaacaacagtgtctagaggaaggcaccacgggaggagcatccctgtgagtggaggaagggcctggagcggtttggtcagcttggtctgttttcctcacctctcaggttcagcttaggcctcaccacccctgggaagcttctctgacacccacgcccaccacagtcttggttgggtgccctgtccccagatcctgtggctttttgttcacctgtggctttgcttaaatggtactgaattgtaattgcattgtcagactcctctcttccccactggaatttgaactccagggacagcgctattttcttctgttccatgttcctcatattcgacacgtagaaaacaggtggttagggcccagcgtggtggtttacaccggtaatcccagtactttgggaggctgagacgggtgggtcacttgaggccaggagttcaagaccagcctggccaacatcatgaagccccgtctctatgaaaaatacaaaagttagccgggtgtggtggtgggtgcctgtaatcccagccatgtgggaggctgaggcaaaagaattgtgtgaacccgggaggtggaggttgcagtgagccgagatcacgccactgcactccagcctgggcaacagagtgagtgggactccatctcaaaaaaaaaaaggcacttagtaaacaaacaattattgaagaaaacataaccagatggcctctctgaggattctttcaactcaagcatctccctttgaacaggggaaagcaagatcaccattacagccccaggagtgttcagggctgggggatgtcctaggacagagggtccaactggtggtacatctgcccagagggcttcctcgccagcacagctgtccccctcctgaacggctgggccctgcccacagtgcccgcccaggagcatcctgcgtgcctgtttcccacccgcccctgggaggcttgctgcctccccgttgccccagctgtgcagacgtggccttgtgcccagtcgagtcaacagtcaacactcagtgagccccactggctgtgctgcctggggtgtgccgggtgcctcatgtatatccctgtccagtggaggaagcagacacgccccttgctgaccacagagtgtggtacatgtgagtcactggagaggcacaggtgccgtcctctgagtcacagaagaagcagtgatttgttttttgttttttgtttttttttgagatggagtctcactttgtcactgtcgcccaggctagagtgcagtggcacaatctcggctcactgcaacctccacctcccgggttcaagcaattcttctacctcagcctcctgagtagctgggaataaaggcgtccgccaccacgcctggctaattttttgtatttttagtagagacggggtttcaccgtgttagccaggctggtctcaaactcctgacctcatgatccacccgccccggcctcccaaagtgctgggatgacaggtgtgagccaccgtgctcagccttgttctcttgataataattttttaaattttcatgttttttctaatccccaatataatactggctggttttaatgagaaatgctcgtagtaccagcatgtacagggtaaagctggtcgccactcacctcccgctgctgacagtttgaggtgtattcttctgaactcttctttgcttatgctggtgtgcgcccgcgtgtccaatgagactagactacacgtgctgttttgcaacttcagcattttactctacagtgggtctttgagccctttggatgtatcagattctttttctttctttttgaggtagagtctcgctctgtcacccaggctggagtgcactggtgagatttgggctcactggaacttccacctcccgggttcaagcgattctcgtgcctcagcctcccgagtagctgggattacaggcgcccgccaccacgcccggtagtttttgcatttttagtagagacggggtttcaccacgttggccagggtggtctcgaactcctgacctcaaacgatccgcccacctcggcctcccaaagtgctgggattacaggcgtgagccaccgcgcctggcagtatcagattctttttaacaactgcctcctgctctgtcgcttggctgcatacaaatgtttttgggtgtttggattgtctctgattcttcgctcttagcaggcaagtcaacagtaaacatcactgcgcaggtgcctctgcagtaggttccctccaggtgggatgggcagggcagggtgagtgtgcgcttaattgacaggcttttacctctgaaaaagctgtgactggtggcattccccctgcggtgtgtgagggtgactgtcccccacagtgtcacaacactggctgtgaacattctttacaattttgccagtccagtgggttaaaaagaacaaaacaccatagaggtgaattctaactgaggagcttgaggatggccttgggagctgagacttgaagcataatggtggttaataaaagggagggggtcctttacgaaacagacagaaacttggaacattgagggagcaggctctgcccgcagaggatgaatgtctggtgagagggggaggctgagccgacgggacctggtgggttgtctgccgggcagggaggctggaaccctgccatgggggccttggtgccaggctagcaggtggggcttcaggctgaaaggtgtctgaggtttctttaagcaggtgtctctgttgtacccaggatttaatgtgtagaggcagcagagtgacagtacagagaggttaatactactgtaatatttgtattatttagggttctcaagagaaggaggcatagcaccccgcccagggccacgtggagaggtgccagctttgaacaggaggcaggaatggaaagaaagtgtggccacagcttttctgtggagaaacagggcagggaaagggcttggcaccagctggcttccgttatgtcggcagccctgggctagaggagtggtctctggtgacctggtccctggccctgggtgacgtggggcagaggagatgctggcttggcgagtgagcgtcgggtagagaaggtggttggggacatgggctctggatcagtgggtgtgtgtatgaaagctgtgctcatagggcatcactgacaggcttaggaattagtgagccctgtgggggagcagtttctcacccagctacccgcctctcctgccacaagatgtcaaaacatcacgaaatacggaaaatgtaaagagcatgttaacacacagtggagtgtcgtgcttagtgctgctcgtgagaaaggcccgagtgtgaggggaaccctctgtgtccccatctcctgcagaaagccaacaaaggccagagccgggccatcgagcgcctgaagaagaagatgtttgagaatgagttcctgctgctgctcaactcccccacaatcccgttcaggatccacaatcggaatggaaaggtcaggatgggtgggggtgggaccaagacagccccttccttagtccagagcagcccactctgtggctcctggccctgacctgtacgaaccggaaactcaggccccctcttcctgaggaggctgccatggctccagctgttgactcgctctcccctctcgtgtggaatgagtgccctctgctggccgtccctggcacagccgctcctgtcaccttggcttcccaggaaggagctcccccttcacccacccacccccagctgcctcctcctgcaaggtcagctgtgcctggataaggaggagctttgggccgggcacagtggctcatgcctgtcatcccagcactttgggaggctgaggcaggcgaatcacctgaggtcaagagtttgagaccagcctggccaacatggcaaaactctgtctctactaaaaacacaaaaattagccgggcgtggtggtgggcacctgtaatcccagctactcaggaggctgaggcaggagattggcgtgaacccgggaggtggaggttgcagtgagccgagattttgccattgcactagagcctgggcaacaagagcgagactctgtctcaaaaaaaaaaaaaaaaaaaaagataaaaggagctttgttggggtccccaggatctgggagtacgctttgcctgactgtggtcacccactttattcttatctcctctcttcagagttacctgttcctactgtcctcggactacgagaggtcagagtggagagaagcaattcagaaactacagaagaagggtaaattcctgcctcttccacgctccccaatgatgtccgtggcattgatgggccttttgtatttctaagcgtttcatgtccagtatcacgtctttggccctcgcagtcaccctcagaggtgccagggtgagcgtttaaggatgttacggattaattgagacccaaagaatctaactgattggctgaaagacatgatgatttagtcctgggactggacccagagcccagcctgggctttctctctctctctacctctctctctctctcacacacacacacacagagacacacacacacacatacacagaggctgggtacggtggcttacgcctgtaatcccagtcaggagtttgagatcagcctgggcaacgtggtgaaaccccgtctctactaaaaacacaaaaattagccaggtgtggtggtgggcacctgtaatcccagctactcaggaggctgaagcaggagaatcccttgaacctgagaggcggaggttgcagtgagctgagatcacagcactgcactccagcctgggcgacagagtgagactccgtttaaaaaaaaaacgaaaacaaaacgcatacaccacacacacacacacacacacacacacacacacacacacacctcttcagttagattctcctactctgacccctctcacagcatctacaccagtcctgctgtgtccacaaatccttccccctccctcgcaaggaccaagtctgccccagggattaagccgtcttcctgcagcagcccccagggaagagcagccggtcctggtggaccagtgcccacgctcccttctctctcggctctccctccagatctccaggcctttgtcctgagctcagtggagctccaggtgctcacaggatcctgtttcaagcttaggactgtacacaacattcctgtcaccagcaataaagacggtaagctcgggaaccagaggtggcccaaccggcaggtcccagccctcagagcgtggccggcttcccgtaaggactcagacagacatgtggctgtaaatggctgatccctgctcggctgtgctgagactgttgagtggccaggacacagcttgggtaggggtgactgtctactgagttcccagatgaccccagcttttccttgggcccctctgtctggcttgggagaactggcaccctggtgcactgagattgtgctgttaatatattcatgagagagcagacccggtagataaaatggtgtatgggaaatgaggctggaagtttccagggaccagctcttgaaaggccttgaatcccaagcaagggagtttggaattcatgctgtaagcccgggagtctgggggggttttgagcagtggggagctgtgatcagggctgggaactgaccggagtgggtgtattctagctgcctgtgtgctgggaaagggtccactttgtgaacggggtcctgaaggcaagctttcctcgacataaatcattagcagaatgatttatcatattggtcagttttcagtgccaggataggcaggatttggagggagagacagtacccatggggaatggtactaagtccctgggccaggatggtgggtgtgctggacccccccaggctgagtggaggagagaaggaccccctagccctaccccgggcagctcacatataaggccgccgtggccttcggaaactttttcatctggccaccaggtggtgatgttggaccaagactcagctgagtctcataccccgtctgcctcccgccggcctggggtggaggctgaggggatccgctgaccaccctctgccctgggggcttttctctcttgcagacgatgagtctccaggactctatggcttccttcatgtcatcgtccactctgccaagggatttaagcaatcagccagtaagtgccctggccaggacgaggttgggtgggccattgtggattctgcactgctctgcccaggatggggccctgccagcacgcctttagacatggggcattcccctggaggccagaaaccagctcctcttggcagggaggtcacccctggcctttgtctccaaagtcctctttctcaagccctccctgaagctgtctgaaacctaggggccgggcgcggtggctcacgcctgtaatcccagcactttgggaggcccaggcgggcggatcacgaggtcaggagttcgagaccatccgggccaacatggtgaaaccccgtctctactaaaaatactaaaattagcgtgggcatggcggtggacgcctgtagtcccagctacttgggaggctgaggccagagaatcccttgaacccgggaggcggaggttgctgtgagctgagatcatggcattgcactccaccctgggcgacagagcgagaatccgtctcaaaaaaaaaaaaaagaaaccgagtgcgacaaacacatggactccaacttcatatctgagggcgacaaacacgtggactccaacttcatatctgcccatgacaaactgtgtgaccttgggcaagtttcttaacctctctgggcctccactaaaaggcagtcacgcttgtgaattttgacccgagagcaggctgggatatgatcgtgtgtgtgcaacgctggtgtgctgccacgctcatcgctttttctccccttcccccttgtgggttcctcgtactaaatctgtttttagtgtctcacaaagtaggattgcactttttaatttttaaaaaatttttttttagagacaggttctccccatgttggccaggctggtcttgaactcctgggctcaagccatcctcccacctcagcctcccaaagtgctgagattacaggcgtgagctgctgcgcccggcctggttgcgctttttatctacctgttatccacacgggaatctgtgagtcagttagacagctaatagtttctacccatttgccagaggaggtaaccgagtcacagagaggagaaaagacttaacatcacagaggatcagaaaccctgactctctccctctccacctgcccctcccactccctgctcttcactggcaggtggggtctgccctcacccctccctgcagcgccccacacagaggtgactccccgggccgttagagcagcctttcccaggaagcctccctgagttcctgggggcaaactggcctcccttctttgtcccttctttgtgcccacatcccctcaggttccttgtgcccccatcccctcaggttccttgtgcccccatcccctcaggttctttgtgcccccgtcccctgaggttccttgtatccccatccctttgaggttccttgtgcccccatcccctgaggttccttgtgcccccatcctgctcagggcaagctggttatggcacctgtcatgctgttttgtcacttaacaatttgcgtctcccactgtgagttctctgagggcgggaaccaggtctcctttaccctgggatgcatgggagctcagaaatgtggagtgaagtcgttaatttacacagcacctaccgtgcacctggagaaggtgagaacatggctggcgtgtggacgtactcacatgtgcaaagcctgtggcgtgttcagagcctctcagtctcacggtccgctctgagcctccggcatcccgccgaggtcacggaaaccatccctgttttacacacgaggacgccaaggcttggaggggctcaaggttccttcctggggtcacacagtagcaggtggtgcagcagaatccacgtcttccggcaccagagccggagctctaaccttttgggcacttctcgatgtctggccgggaacaccacacggtccctcaggctgcttgttaccgtggaagcttcctgaaccctctccagacccatagacctcccttcttgggggctgccgctgaggagcttctggctagtgagctctgaagcactgtcccacccatgtctggaccaggcgccgccactccctctcctgcttcccgttggccgggaggtcctcgcctcagggagccgacccgtggcctcccagcctgggcgggtgtcagagccggctgagctgctccaaaatctctctttacccccagattatcctcactcccttcgccaccgccacccctgacccactcatatgtctgttctcactcagaggtgaggccctgtgtcttcagccgtggtaaactcaggacctctggacaggcaggcccagggtgtaggcaccatgacttttcctgctgtgcagacaggaacccggggagagaagggaggtgatctgtgcagagctggggtgtggacccagatggtctgactccggaaccctcgctctgaccctgtgagccgtccccagctccttccggaaccctccctctgaccctgtgaaccctcccccagcccgttccggaaccctccctctgaccctgtgaaccctcccccagccccttccggaaccctccctctgaccctgtgaaccctcccccagccccttccggaaccctccctctgaccctgtgagccctcccccagccccttccggaaccctccctctgaccctgtgagccctccccagcccctcgaggaggggctcacaccgagatcaatccatgatgacagcacttcatggcccgtctcaaacacacaggcccactccctggtctggcccaggctggggtgctcagggcctctgtgttgttcacctgcaaatccccagccccgttctgtgtgttctgaggcccacctgggtcttctttctgttgctccagctggaggcttcttggggtagctgcactgtcctttctgcaggaaagctggtttttttggtttttttttttttgagaaagagtcacttggtcgcccaggctggagtgcagtggtgccatctcagctcactgcaacttccacaccccaggttcaagcgattgtcctgcctcagcctcccgagtagctgggactacaggcatgtgccaccacgccgggctcacttttgtatttttagtagagatggggtttcaccatgttggtcaggctggtctcaaactcctgacctcaggtgatctgcccaccttggcctcccaaagtgctgggatttacaggcgtgagccaccttgcccggccaggaaagctgttctgatggagaatggcccagctgggcagctgcaggggctaagtggagtaagccacctgcactgtatgcccgcactgtgacctctgacgttgtttcacgctgcagagggttggccatagtgtcccaaaggcacctcccacaccacctctggtaccctgggaacaacctcggcatctccctggaggtgggaggactgctggggtccgagcccagggcgggtgtgggtttgcagagggcctggggtccgtgccggtgctgtggcctcagcagttgggtcccaaggtagattttcagcctgaaggccagggtggaagatggaaatgccggggaaagcccccggccctgccctcccgccccagccctccactgccttgttacctggagcgcttggtggtggtgggagcctcgttcaccgtgtgccagctgggttcccagccctgttcttggtactgcgggtacaccggcaggcaggaaaacccaggcttctctccacatggtgtttacgtcgtggggggagagagactagggacgcacgagtagagaagatccctttggtttatgttaagtgcagcggaggaaaccacagcaccctgggcttggggatgtgggcgttgttggtcgtcaccgcggcaggggatgctccgagcattcaggacccagaggcagggctgctaaacgcctcccaccccaaatgccgctgttgaggcctgggcacccatgttacggggagaggtggctccagggcggtcagtgaagagtttgtggtgtcgtctccatggtgaggaagatgtggagacggaacagtcaagggccctttagagggaggaggaggccagagtgtggggagggccgaggtgggaagggcagagtgtggggagggccgaggtgggaagggcagagtgtggggagggctgaggtaggaagggcagagtgtggggtgagccgaggtggggagggctgagcccctaagaagggggcaggggagaagccagatggtcccgggcttcagggaggagagagccaagatgccatccgtggggacgttggaaaggacagatgcgatgtccccctccatcctgagtgccgccccagctgccccaccctggccccactcactcagtatctccgtctgtccttcccccacagacctgtactgtaccctggaggtggattccttcggctattttgtcagcaaagccaaaaccagggtgttccgggacacagcggagcccaagtgggatgaggtgagtggcaggggctggcatctctgtggggaccccaccaccccgtgctcgtggcttgtctgctggggacggccagcccattggttggaccagctatgtctgcacccccctttctgctccctgctcctctggcttctgatcgcggtgtgtgtctgggtgtcagaccctgtggtgtcagctcaggcccccagactccaggggtgatgggaggcctctgggagctccagaaaatctgacgtgtccttcgtgggccgtgcttactccctcctccttgcaaagctgaggcacgcacctgccggaaagccaggcctcccagcttcagaggttcagggccctttgtcccatctttccccaggagtttgagatcgagctggagggctcccagtccctgaggatcctgtgctatgagaagtgctatgacaagaccaaggtcaacaaggacaacaatgagatcgtggacaagatcatgggcaaaggacagatccaggtgaggccagggcgccggggcgaggctgagggagcctccaggaggtggttccagttgaaaaggaattctggtcaaggagcctgctctttcgtgattttggttccaagctggttggaggaaagttcccaggaggtggttctcccctccctgctagaggtggctgcctgttgtggccccggaagcccaggcgtgtgcgtggctcctcaggtgggtcatctgcgcttctgcaagatggaaacaaccagctttgttttcacacgccagctttagtctatgggtggttgtttcccggaacgccatgttgagaaggactcagaggctgcgtcggtgaacgggagggaggaatgctgtgtgtgaggagccgtgtctgccattgacgggggaccggagttaggcacacggaccaggcgtttgctcttctgcccgaaagacttagggtcctgctggttggcttggggggaggggggtctctgacttgttgttagggtggccggaccttactcagctgcgttgggagtctgtggcttcgggtggggactctgggtgttagtagaggctgcacctcgggttaagggtatttatgcttctgggtgcggtggctcacgcctgtaatcccagcaccttgggaggccgaggtgggtggatcacgaggtcaggagttcgagaccagcctggccaacatggcgaaaccccatctctactaaaaatacaaaaattagcaggtcgtggtggcgggcgcctgtaatcccagctactcagtaggctgaggcaggagaatcgcttgaacccaggaggtagaggttgcagtgagctgagatcgcgcctgggtgatggagtcagaccgtgtctccaaaaaaataaaaataaataaaaacagcatttatgcctcaactgtgcttttggctccctataaacatatatagggaaaaggcctctgtgtgtgcagtctgtgtctctgaaacattctgccaattttgaagatggctgctattcaccaacctattaagagaagtaggcttgggagcgggaaaaggcgtgacgtggtggagccgctcacactcccgtctggtacctcgtgtggcctcgtgctgtgccgcaagtggtctggtttgggggtagattctgtgaccatgaaatgaagggagacggtaactgacccgtactgaggttgagcctcgggcgttgggcgtgctgagcttcttgacagtggccgcagacgtgatccaggcacagctgggcgccgagcttcttgaccgtggccccggacgtgatccaggcgcagctgggcgccgagcttcttgaccgtggccccggacgtgatccaggcgcagctgggcgccgagcttcttgaccgtggccccggaggtgatccaggcggcagctgggcgccgagcttcttgaccgtggccccggacgtgatccaggcgcagctgggcgccgagcttcttgaccgtggccccggacgtgatccaggcgcagctgggcgccgagcttcttgaccgtggcccaagaggtgatccaggcgcaggctgcgatggctccgtctacaacagggagctgaacgatgctttttagcaggaagcatttgttctctgatgcattgtcatggccaccgagtttggtatctggctcttacctgcaggtccttggtagcattgcccctggggagctgtgtgggtctcccactcgctgccccatctcaggctccagtgtttgaaccaggggccccacgtggaggggcctggcctctgccgcatacgccccgtgttcctaaacacgtctctttccgatgctgtggggtctgcaccctgcttctcagtactcgtcactagggagacagggctgccaggcaactgccagccagtccttcgtgatttaggaaatgggctctagagattcagtccctgggacctgctctctgtggggataaggggagggagccccatctccctgtccctgggctgggctagagggacaggcacggaagggttctgggctggcctgtgcagccccaggagacgcccaggcaagagacgagcggtcgccacgccacactccctgggccactggtggctgtggaatagaagagttacaaggatgtgccgggcagccagccccgtgggcacggtgggccccagcccctcgagaactcagctcccaaggcccgagggcacattcccccacctggacttcagccccattgcttccctccttctcactcagctgcacaagccccgggggaaacacaccatcagtcactgcaagcctcttggagacaggagcagatagaggcagtgggggagggaggaagccaggttatgtttggcaaagcagaaggcagagtctggtaaggaaaatgtttctgtgtttaagcttcgaggaatgttaaatgcctgggagttgatattaaaagaaacataaaccttcctgctgccagctgacctgggcctgtgagcggacagttcagagccagagtcccctgcaggcctttgaagtcccccagcactcagcatgccaaggcccggccctggccctccgctgcagaaccatctcaccagcctgccttcggcgggggaggcatgccccaggggcgggctgtggcttagaaagtctcgccccgtgactgccctcagagccaccgtggatggccaggctgggtgacgagtccacacggagctgttcccacgaacccgggccccacggagccacggaacggtctgtcgccacagcttgtctctgccttcactccggccacacatctaaggaagggagctggcactagcctctggaatgcagtctttctgcccgccagcaggcgctgaggacatagtcggaggtggctttgagatagggcccagccctcggggatattcagggggcctgtaggaaaggcaggaggaggagggcagtctctgaggcccccacttctctctaagccccctcccagcagcccatccagagaaagcaaggggccctacggcctaagcgcaggcatttgctgctgtgatgaggcccccactctgggtcgcctgatggggcagtggggcaggagtctcagcggcggggtggggtgggggaagcatttagtgacagacagatggcagcatgcgtcaccaatgtgtgtccagcacttgtgctcctggaggccgcttcccaaatgccatctcctcgtgtgatccttgtcgtgatcctccagggagaatgacagtccctcctccccatcttacagatgaggacactggggtactgaggttaagtaccttggccaaggcatctctgcgtatggtatgtgggaaaggccatgttccctcctctgtgccatgtccccacgtctcaggcctttgtcaacgaatccctcagcccggacagagggccgtggcatggctaatggcttggagaagcagctgaggtgctgctttatggcataaggtgagcgtcctttgtcttggagtcctctgggcaggggacacttgtgcctggtgcccctgggaggaaggagaggagcatgtgcgggaaagagcaggaggccgaggtgggctgatcacgaggtcaggagttcgagaccagcctggccaacatggcaaaacccctttcctactaaaaatacaaaaattagccaggcgtggtggcacgcacccataatcccagcactttgggaggccgaggcgggcggattacaaggtcgggagttcgagacccgcctggccaacatggcgaaaccctgtttctactaaaaatacaagaattagctgggtgtggggcccacgcctgtaatcccagcactttgggaggccgaggcgggcggattaggaggtcgggagtttgagactcgcctggccaacatggcgaaaccccgtctctactagaaatataaaaattagccaggggtggtcgtgcgtgcctgtaatcccagcacttcgggaggccagggcggggggatcacctgaggtcaggagttcgaaaccagcctggtcaacgtggtgaaaccctgtgtctactaaaaaaacaaaaattagccaggcgtgatggcgggcacctgtaatcccagctacttgggaggctgagggaggagaatcacttgaacctgggaggtggaggttgtagtgagctgagattgctccattgcactccagcctggacaagacagaatgagattctgtctggggaaaaaaaagaaaagaaaacagcaggaggggtacttagcatgcgtctgtgaggtccccagcccaggagggggtcctggcctccagggacccactgtcagattggaaagacgagtatattggtccatgttctccagtgagaagaatgctagatgtcagccacaatagccgtacacacataagcgagcccaggacgagcccagcacggtgctaaatgcttccatctgctgtctcaggagatcttcccaggaccctgtgggagaggaatatcatcacagctagaaagatgaggaagctggggctaaggagcccggccaaggccatgtgcccaggagtgggccagggcgggcagctggctgcagagcccatttctagatgtcctgctgcctcctgctataagaagacggaagattgtcctgctgtaagaagacggaagattgtcctgctgtaagaagacggaagattgtcctgctgtaagaagacggaagattgtcctgctgtaagaagatggaagattgtcctgctataagaagatggaagattgtcccgcaggaattcagaggcagaaaggtcaccatgggctggaattagggaggcttcaaggaggaggtggaacgagagcgatttggaagccctgggttttttaattccaaaagcaatgtttgtatgagaaagaaaattgcagtagaagcaaagagacttgaaacctaatcagaaaccatccttcctccggctcctccgaagcagccagtttattctgtgccttttcccttcttgaggtatacacatttttatgtagatttaatcagggcctgttttgtctgtttttctgttttcatggattattataaacctccttttctctagagctgtatggagtcttcttaagcacctttttggatactttgttaaaagtactttatattctttgtagaaatcttggtatagagcagccagcgcaattgctatgctaaggctctgtgttattccagcaaggtgcgcaggctccgcttccgcagaagggagtagggtgggagttccggaggacagacccgcctggcagggaggcacgaatgtgaagggagggtcccaggaaagtcaggagcctcagcaggggtggcggggagctgcaagcaaggccagtagaaggaatgaataaaaggaggggattcctgggggtttggccggaagaggtatttttttttttttgagatggggtcttgctgtgctgcccaggctggagggcaatggcgcaatctcggctcactgcaacctctgcctcccaggttcacgccattctcctgtcccagcctcccgagtagctgggattacaggcgcccaccaccatgcccagctgatttttattagtagtagtagagacagggtttcaccatgttgaccaggctggtctcaaactcctgagctcaggtgatctgcccacctcagcctcccaaagtgctgggattacaggcgtgagccacggcacccggcctggaataaatcttagagggcgtttaatccaatcctgttttccggagagaaggaaatggacaccagcaagggtgagcgaggcagccgcggtcacagagcttgttagtgggtgaacaagggccccagactcagggaccccatccaggtccgcttagctgggagccccccctccaccggctcttgcccctgcccccggcgtagtctgccctggctcctggtcccaggggactccactgtgtttatcctactctatttccagccttgccgctccagctgcaacctacccgctagctgattagcatattcccagggtccggcccttcttggcgggctgggcctgaggagagcgctttcccttggggccccacagctcagtttctgccagcgtccccagactggagaagggcctgagaccaagaagctacttaaacctgaggggccctctgcaccccctgcccgccccccggccctgcgtcattccctcgctcaccgcaggctggggacagcccccaccccacagtccacctctgctccctgtgcctgggaggcagctccacttccccacgtgcctgccagggcagcccctccctgggcacagcagcgctgaagaccctgtggtgggaggggcaggttccaggccaggaagggagtgtgagccaccgcgtccggcctttattctttttaaagaaaaaatagtggtagaagccaggcatagtagctcacgtggtgtagctgtggactacttgggaggctaaggaggctagagtgagctaaggattgcgctactgtactccagcctgggtgacagagcaagagtctatctccactgaaaaaaataaaaaataaaagattgtagtgaaatatacataacataaagttaccattttaataaattttaggggccgggcgcggtggctcacgcctgtaatcccagcactttgggaggccgaggtagatggatcacctgaggtcaggagttcaagaccagcctggccaacatggtgagaccccatctctacaaagattaaaaaaaattagccgggcgtggtggtgcacgcctgtagtcccagctattcgggacactgaggctggagaattgcttgaacctgggaggcagaggttgcagtgagccaagatcatgccactgcactccagcctgggcaatagagtgagactccatctcaaaaaataataatttttgggtgcacagctccgtggccataggtggatttggtgctgtgcagccgttgccagtgtgcatatccagaacttgttggccctccccagccgaaaccccatccccattaaatcataactccccactcctgcacccttagcctccagtaaccacctgcctgctttctgtctgtacgaatttgtccagtctgggaaccttacgtaggtggaatcagacagcatttgtcctcctcatgtccttgagcttcacccatatgccgttgtgtgtctgaatttcctccctttctgaggctggatacaatttccctggatgtagatgccacgtctctttatctgcccgtccgtccgtggatgtaggtgccacgtctgtttatccgtctgtggatataggtgccacatctgtttatccatccatccgtccgtgaatgtaggtgccatgtctgtttatccatccatccatccgtggatgtaggtgccacgtctatttatccatccatctgtggatgtaggtgccacgtctgtttgtccttctgtctgtccgtggatgtaggtgccacgtctcttcgtccatccatccgtctgtggacgtaggtgccatgtctgtttacccatccatccgtccatggatgtaggtgccacatctgtttatccatccgtccgtggatgtaggtgccatatctgtttgtccacccacccgtggatgtagctgccacgtctgtttatccgcctgtccatctgtggatgtagctgccatgtctatttatccatccgtccgtggatgtaggtgccacgtctgtttatccatccgttcgtggatgtaggtgccacgtctgtttattcatccgtttgtggatgtagctgccacgtctgtttatccatccatccgcggatgtaggtgccacgtctgtttatccatccattcatggatgtaggtgccatgtctgtttatccgtccgtccgtggatgtaggtgccatgtctgtttatccgtccgtccgtccatccgtgcacatttgggttgtttccacccaaaacgctcttgcctttcgttgagaaaaagaaccttgtccctgaggatggagacagcacagcctccttctctccagacccaagctctgtcccccacctgcctcccagctgtaatagatgagcaggacccgtgaccctagggcatgactggtcactattagtctcctgtagttgaagcacacagttgggccccctgcctcggccttctctccccctcccggccaagtgtccctgccccttgaccccttcacccttcttcctgggtcagctctttcctcccctggtcagtggtttaggtgcatcgaatgcagacgcagtcaccctgaggccgcgggaacaacctctggtcccttgacttcttggcatctcagtttcttcttttatttatttacttatttatatttatttgagatggagtctctctctgtcgcccaggctgagtgtaatggcgcagtcttggctcactgcaacctccgtctcccgggttcaagtgattctcctgtctcagtctcctggttagctgggattaaaggcgcccgccaccatgcccagctaattttcgtatttttagtagagacggggttttgccatgttggccaggctggtctcgaactcctgaccttgtgatccacccgcctcagcctcccaaagtgctgggatgacaggcgtgagccaccgcacccggccaagtttctttattgattcagtgggggtaactattcctaccccaccttcagcactggcttaaaggatctcacatacctggaagagccagtcggtgctgtgacgtgtgcgtccacgctttcacctgttcactcacttgtttctgtttacgatacatcctctgaatggcaggccctgggctgtgggtacaaagaatgaccaggacctcaccgtctggtaaagaaaacaagagaacttaggccaggcacggtggttcatgcctgtaatcccagcactttaggaggccgaggcgggcggatcatgaggtcaggagttcgagaccagcctggccaacatggtgaaacgccgtctctactaaaaatagaaaaatcagccgggcgtgatggtgcgctcctgtaatcccagctactcgggaggctgaggcaggagaatggtgtgaaccaggacccaggaggtggaggttgcggtgagccgagattgcgccattacactccagcctgggctacagagcgagactctgtctcaaaaaaaggaaaacgagaacttggatcgttagccagtgttgccggggttttgaggccagacagatcttgcggggctgagtctagctttctccatcgttagttgggagaacagagcgagtatctttgcctctgagcctcagcttcctgacctgtcagatgggctgtaagaggactgaatgtgagggtccatgaaaccctggacccggggcctggcatggagtcagtacgtggtttgccctaagctggcgggttcaggcaccctgtcccccacccccttccagtggttctgggtgtcacttgtccagcagccccctcctaaaggctgtcacctataagtggtcccctgggtcggggcctttggctggccgaggcagcattattttcttaagctgatggggtcagactggctttgctgaaccaacctcatagcaggggcggggaagtcaaggctggggccctcaatgccggctggcccgaggtttccctgccatgacccagcacggcagctctgagcttggcctggtgtggtcggaaacaaggggcctttgtcagcggctggggagcagcttctggtttcaattactctggagagcacgaggaagcttgcagagaacgtggggccggagcccgccagggcaggagtcaagggctcccctgccccacttccctccctctgacccccaaggggtgtcttgtccccattcgaccctgcctgagggtcctgcgcgtgcgtcctgggggccctgggttgtgagcccagagccccttccagctccggccccctctcgttcttcatagtggtactgggacccctcccaggaagatgatcgacggccggtaacgtgggtcctcagtgcttccccgttccaggcctcacgcgtgggccacactgaccacagccgggcccctggccctgagggaggccttgattcaactgggaaggaacacaggcctttccctttggttccatctctcccgtccccaacccctgccctggcactcacagcccccatagctccctgtcgtgggacaccggagtgacctctccctggaagatcagcccgcgtcggcgcccgccaaggccaggagtgcgtgtcaggccccgcctcggctcctggcttaggagttccgcctccctgctgcttgccaccctcacagctggcccacgtggggctcttccctctgccgccacccccacccctgtgccagttccccaggcacatagggaccgtggaggctgagccccaggcctggttctacttcctgctgactctccacttcctcccagggccccgtgactgcagccattgtcctgctctggccctgcccaccccagctgtttcgggcacatttgttctccagcccagactcccacctgctgtccctcttcaaggcaggtctagacgcctggttctccttggagagtgggcagcagagcctgtcctgggtgggggaagtcgggggagggtccctcgagagtgcctgccctgccgtcgaaagcttttccaaacgtggggcacgaacctctctcgtcagccctgctcagctgcctccatcgcccaggtgttcctgattttgggagcctggactctgcccagtggattctgggcaggaagcatccagcaggaagcagatggaggtgtgagtcggctccccccgctcccctccacccctgggaagtgccgcctcagcaggcaggcttggcgcccgctccccctgacccgcctctgaagggtgggcaccatgcagagaagccggtccagacaggacctcaggagccgatgcagtcaggccctgagaacatccagcctcccgacagaccaaaaaaaggtgttctcagctctgggtgccgggctcccagactcagaggcacgggacctgggtttgatcttagccggccaacctcgggtgacccttcagagagtgtcctctcgggtccgtggcattcagcgaactcgccgaggcgaaagccgcagacatagattcctccccgtgagccgctaacctccctgctggcggaggctgctgcttcctcctaggaatccaaaggatcagctccagggttgtcccactttccgtgttttctgaaagcttcaagagaaggatgccacagaagggttgccagagaatttcttgagttagggctgaggctgcagatgaatgctgagcgggggtcacctttagggtgggctctgctggcctccctcaagcctgcggccaccgcagactcacagcagcccctcgtggccagccccgcccttgccgtggcctgggggcgtggacattggtggtgctgggcgagggtctaagccccagtgtagcctgtagctttgggctggggcagggagggatgggcacaccgtgttcacgccctcggaggcaagtgctgagctgccctggcttcaggaaagaccctagcgcggctggagacgcaagatgacccagacacacccgcctgacccactagacaggtgctgtcccctctcgaggctgccagggcgaacccacagccactgagcaaaagccctgagtttcccaaaggagggagagaagcagagacacgactggagctgcaggttcagcgtctgacccagaggtgtccttacaaagcccctaatctctcagacccccacgtcccccaccccgagggagagcgaggccttcgggagaactgcctctaggagctgctgggaacctaaggtttgagctgtagatgcctgaaaggagggcggggcgctgaggtgtgcctcagattctgcctgtggggcgtgggaattccggggagggacgtgagccccaaggcaggcgaggggtggtggaaaagcaggtgtgagccagtgggccccacgtcccctcttcagccagggcgcctgctctctctgcttctgcttttatccgacgaggtgggcagggagacgtcggcataaaatttcatttggaaaaaacggcaggggtgcgtcctcagcagaaaagaaatctcaccggagaccatgtgtctgttccgagctcctgatttgacagctgtggaaactgaacccagagaaaaacacagccgttgagtccacaggtccctggctcccagggctttgcttctggccaccgtgagctcggagcttgggtggaagggaggtgttcgggaatccagaatgaagaaagagcagggaggctcggcgaccccatcccaccttcaggcctcagcccctcctgcctcaggctgcaatttatggctgtgctgggagacccggccacaccccctccttcccgggaggaggagcaggcaagcagcccaggggggctccagcggtagggacagcatactgaggggccacgccctgcccactctgtccctgggtgagttttgttctagataagcaagatgttcccaaaggctcaagtgcatttttcacccttttccatgaccaaatgtgctgtgagaatcgctagggtttgccagggacgggctgtcgggacacttctcctgcagcagacaagctcttgggctgtttcagcctctcctccgtacctagaaccaccgagcaccctggcgacaccagcctgacgtggccagagagaggctggaggtcaggcagagggaggctggagctgtgtgagaagcagcacgtactcgggactgccctatgagccggcacaggcctttggggagttgggaggacagcaggttaccttgggcaggcctaggtctgggccgtagagcaactgatttcatcctgactgccttcttccttacactgtgcccatcttcaaccttgagcccaccctggacccctctcccagccccacctggatggatgggtgggtgggtggatggatggatggatggatggaaggatgggtgggtgggtggatggatgggtggatggatggatggatgggtggatggatggaaggaaggaaggatggaaggaaggaaggatggaaggaaggaaagaaagaaacaaacatagctcctagggtctaatctgccattggctgctgggtgactcctgtccccaggctgaatgcaggctctgaacattgcaaatacccagaggtatccgatgggtggggagaaaaacctagagtgagtctcagtgtctcattctgggaagacatttggccttccagtccgcaggttttggttagggtcggtacaggaaatggtcagaacacacagtaagaatgcagtgaccacagagccaccgagttgggggacactcccgtccccactcccccacagctgtccccggaacgtgccatcctcccgcccaactcgcacgccctgtgtgggcgctgggcaccccgggctcccatgctcggcctgcttgtctctctctcatcctggagcctgcacctgtctttgggcaggagccactggcaggctctctgcagcccccaaagcctcgggtccgccctgctctcctccagcaccttcttgccccccagcctcgggtccgccctgctctcctccagcaccttcttgtcccccagctctggtcctctgatgcccagccggtgccctgatcctctggtgctgagagagggagtgttcttggcagacctgagccacatcccctcggtccccatcctcagctgggtgccaggctcctcctgggctctggactctctgggcggcctcttggggctctccccgccccaactggctcccaggctatccccactggggcgcctgtggccttggtctagctggctgctcagaaaccccctctcctggagtcatttgcgctagcggataggacgaggaatcggggttcaagtgtgggctgggggagaggagcgtcgttctggtgggaaaaaggaggtcactccaggaaagcggcagctgcatttctaggttctgaggcagaaccttcctcctggtgctcacaggctggaggatttgcctggaagccgtccccacccccagctgtcaccgaggcagccccactgcagcctttgcccctcccgctcgcacagggcaggatgtgaccttttttcctcgttgatgccgccactgaacaccttaacccgattttacctcagtcacagctgtgctgggtggcatgaccccctccctaggtgtaatgcggggtcccacccacgtctccccggggacagcccctctcactccccttgcagagagcctggggaggggctgagggaggatgggatggtccactaggaatgtttttaattccaaaggcagtgacatctgttcgtgggggccttaccaccaggctctgtttatccagccgggggagtcttgcaggtcgtctgaggagggctctggcaggtgtgggggatggaaggggtaggggggaacaggtgtagcgggatggaaggggtgggggagaaggtgtaggggatggaaggggtggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaggtgtagggggtggaaggggtgggggggagcaggtttaggggatggaaggagtgagggaggaaggagagtggccccttcccaggtggttgggatagcctgagctgaacccagcagagatgaggaggggtccgtggtgggctgcagcgactagaattcagacttctgcttttgctggggacatctgtcttgcacagatcttcttccacccaagaccattgactccaggaagcaatgagtcgggcttgggggagagaaggcaagtctgcgctgtccccagaggaagcccccagtccatagggaggaagggaaagatgagcgtctcaggggaagactcccaactcggctacccatctgcgaaggcacttatgtcaccatggagaccagctggccatcgttcatccagtccgagcttgctttacctagacaagtattgagcctgtggtacctaagacagatgagtgccgggccttgggaacgggattcacacggcccccttctcccccacacccggcggcagggaggggcgtgcattctcgcagtctgcaccctgtggcctgggacccagcccgagggaaggggaccataggccagtgaggggccgattctgaagttaagtcacggcaccaggagcactgtggcgcaaacgtggagagcagttataatggcatcctaccagccagttacatgacagccattgcacgtttgctggagggaggtagagtaaagctgggacccagcgagggtggatggcctttccctacagccccgagggccccacgctgacccctctcctccaggaagccttccccagttgcctccagctggaaattgtatctctcgatgttcgtggcattttgtctgtcctgttctgaggccgtaatatgggattttgtgcgggttttgtccatctgggcgtggtgcctagtaggtgcacaagtgacccgtgccaaatgcacaaatgcttgtctgcctcctgttgatggacatctctgctttcttggctgcccctttgtcaagcactgacttttgattcgtctctgtgatgccttaacccccaccccagggtcgggcacgcagccaggccctcagtcactacctctagagtgacatgagtggggccaggtgcagtggttcatgcctgtaaacccagcactgtgggaggctgaggtcaggagtttgagaccagcctggccagcatggtgaaacctcgtctctgcgaaaaatacaaaaattagccgggcgtggtggtgggtgtgtgtagtcccatctactcaaggggctgaggcaggagagttgcttgagctggggaggcggaggctgcagtgagccaagattgcaccactgcactccagcctgggcaacagagcaagacactgcctcaaaaaaaaaaaaaaaaaaatgacatgagtgggaccaagcagtggggcctgaggagtgagcagagccttcctggaggagatggctttgtggctgtgtgaaggggctgtctgggtcctcctggagccctggaaggggcaggcgaaggaggggtggagaagggtgactgaggcctcagttaggggacacaggcatgttcctacctccgtccgtctctccacctccccctcaggcggtgctggtgaggctgttgtggctcagcccccacttagcagctcaggtttgaggaagttccgtgtgcaccgtccaggggtgcgtgtgacgtgtgagccaggaagaagtggagctggtctggccgcccctgcagggacagtgaagaccgaggcccggttctagcccaggcaggacgccccaaggcccccctccaccagccaggtggaagatagtccagggccagatcctgccacactagggcatcacagtgagtgacaggggtgtgggctttggagttagccagacctccgtttgtgttccagcttgtcctggccttggacacgtagctcagcttgtcagagcccttcgtttcctcagaggtaaagcggggatgctggtactgacttcatacagttgggaggggtaagtgacttaatccatgatgcctggtccctgccagccttccacgaaggacagctctgactacggctgtctctgcagggaagccacctattcctcaaaaacaccaaggcctctgaggagaaatcccgacacctgcctggctggtgacgccggatgccgagggctcgtctctgggccccgacccacctgccttggggtcaaccaagaaatgtcctgacccagctctttttcctgaatccaaagcatcatccatgtttgagtaaggcacagtgcttgtgagcaccaagggctttggagggacctccccatcctcacttggcactgtgtaaccctggcaagaactggacctcctgaccccctgtcctcacctctctagaacagggcagtaacaccaacatgacaagaatgtgaggctcacatgcagtcgggcgtttgaaagacctggttcgcggttgccacggtgcaaatactggtttcctttctgtgccgtgctggggtctgcagaggtccgaggccccagacacccctgggttttgcatagttaaacatttgggattcagcctttctcttttctctgaataccgtactctaacttgcactgttaccttgagacgtaatttgtgtcctagtctctgcggttagaaagttcactaaattgaaggtcaagaacaagttcttctctctctcaaggcgcccagcacggacgcgggtggttgcccgtggcgtcctctgcgcccagcacggacgcgggtggttgcccgtggcgtcctctgcgcccagcacggacgcgggtggttgcccgtggcgtcctctgcgcccagcacggacgcgggtggttgcccgtggcgtcctctgcgcccagcacggacgcgggtggttgcccgtggcgtcctctgcgcccagcacggacgcgggtggttgcccgtggcgtcctctgcgcccagcacggacgcgggtggttgcccgtggcgtcctctgcgcccagcacggacgcgggtggttgcccgtggcgtcctctgcgcccagcacggacgcgggtggttgcccgtggcgtcctctgcccctggcagcggaaaccttttttggtgaggtgcaaagggccacggttcaaagtgacccctcaagaggcatctctggctggacgtgtgacccgcgtcgtttcgggcttttgctcctgtccctgagcagatcagtgacccgattcccactgggattcccacactaggggtctcctttatccttacatttctcacctgaggaggcttctgagtgccggtccacaagggtctggccgggtcaccaagctggctctgaggaaggtgcctggggcagaagttgggggtggggaagtgcgaccccagggcagtcagagtcttttgcccggggaggagggcagctgtttgtggccaaaatgcagcccccgcctggcccccggcccctccgcttggcccctggagcagcccggtgggcaacacggggacccagcagggagggactggggtgtggggctggtgtaaactttattgcgagggagggcggcggggtcggggaggagcagcgcccttgccagggatgaaacccggggttggggcttggaggggcggccctgggcctgggaggcggcgctcagcctgggctgcagcctcgcggagggcggggaaggagggatgcggaggagggaggagggaggagggacgcggacggagggagggagggaggggagcgcggggagggagggagggagggaggcgagcgcggggaaagccggcgggactagggaactagcgggactggcagccgggactgagcgctccacaggcgccttctctccagcgccgcgtcccgtcccccccggcatgaccgacgtcctgccccagcccgactgcagcccgaaggcggggcgcgaacccctggcgctggaggagtcggggagcaagcgcccccccaacaccggcgcccggctctggggccgcgtgcgcaacaagctgctccgaaacaaggtgcccgcgggggctggaggttccggggggtgggggctcgggggcgctgcggggctcggggggctgcgggggctgcgggggctgatggggtcccgctcccgccccctccgtggagtcccgggacagagctggggtctgtgcgcgtccctctaagtggcttgaacttgatggcgaacgctggggccgcccccacccggaccctggcgctcgggcatctgcccctgcctcgggagaagggaggtttcttctcggcaggtggaccctgctttccactccgggagtgcaaacagcgcacggggagacgcctgcctctgggtctatgtcttgccgccctgttcagcctctacctgatccctgcatccagcgggccttgctggctgcccctttgctgaggggcgccgaccgcagcaccgtctgccgtgtgaggtttctctgtgcaggattgtggggaggggagatgctgccgggtctgggggctcgaggcttcccttcagggaccacccatctgactgtgggcccagtgcccgccgggcaccaggcgttccgtccatgtgccagggcagaccgccggtgcccctgcagccccagacctgagttgggattaaaatctgagatagaagccgactgtcctgcagctgggcaggctgcctcggggctggcttggggccctggcatcaggcatgtgaggaagagccagacccagcgcccagcgcacaggaagtgctcgataactctgcagatcaaatcaactgtccgagttagctgtctcagagtgccagtccggctggccagggctgggcccatccatcaagagagcaacaagggaggccttggccagtccgtggtggggatctgcagctcctcctgaggctcacaggacctctctgcaggctcttactgccagccggcattgaggctcctggcatcagccaggacgaagtgatcttgggctcactggcccctcgttttgtttcagctcctgccatggggcatacttgacctcccagaggtgacatcagccctggaaagtgctgggcagggcagcaacttgagctgtactgcactggcccctgtgtcaccttcagcctccctggggactgggctagcagagccctgctggccccagctgctgccagagcccctctgtgctgaggcagctgtctgtgcccggcagcgtggactcatcccctccccagcccctgctgaggccagcaggcaccagcccagagctcaccatccatccccaaacgtcagggttggcaagaaactgacctggcaggttccgggtccagcgccagccaaacagggcgcttccagtttacctgcccctttgaggaggtgcctggtgggcagggggcaacttttaaacctgaggtcccagactttcagttctttccctatgcatttgtggccggcagaactgagaagccccttcaagaattccttagctgggtttgcctctggcagtgcctggtggctccgtgtctgatggggatctctgggcaggggtggtggccaggcagacgccgggctattgagctgctgagcagttggcgtcagtgcagctcagggtggccccggccctgggctgctctgtgtgacgagcgattccatcccctaacgtgtgctgtgtgccacagtgtgtccgtgtcgtggacgcaggggtcagcgctgtggcggacggagggacgtctgccacagtgtgtccgtgtcgtggacgcaggggtcagcgctgtggtggacggagggacgtctgccacagtgtgtccgtgtcgtggacacgggtcagcgctgtggtggacggagggacgtctgccctgtgcttcccacctcactgtgcgcaggccagcgggtgagcagcagagtcaaagggccaggcctcttgctttctatcctcagccacattaacctggcattttcctgcaggagcttcacagttgggccgaggggctgggactaggcagtttcgtttcggtggggtaagggaagggtgcctggtactgcccagactggcaggagggattgcctcattaactcctcgttaactttgccctgagtgatgctgtgggtgcgagaaacaccggtggccctcctgcttccactgacctgaaggttcattaaaggctggaggcggggcgtgactcatccagggctgggattaaacaatctgttcagatggaaaggtctcatgatcagaactgagcctttaaatagtgcagggcctctggtttctgggggagaggaggcagggacactcacggaggatcctttgggtaccagcgggggtgtccgtggttgggctgttcttgtcaccagaggagagttcaggggccaaagcctcattccagcccctgacttggcagtcagctttttgtgcgagtgtttagctgggagacacgtggcatctgggtttgtgggttcagccagggctctcggtattgaacttcgcgtttctacttttctttccttttccctgtttgttttttttttttttgcctcaaatcacactcaagtagaccaggcccggtgccttcctctccctcccatccttccctcttctagattcttggttgagctttggatgggaaggggctgaattctagattctcgcttgagctttggaggggaaggggctgaaggaggaacccccccaccccgcccccgcagcatccccttgtgggagccgtgaggaggctaagagggcctgaagggaggccggtccagaagcatttgtctgtcggggaagttgaggcccttatagagcaaccaagtccaagacgctcctgacccagaccaggccagatgctggccggcggtggggactcaggctgagccggcagggtctaaggagattgagtgcagcttcaggtgaccttgtctctgccctgaagcacagccacgtgggtctgagaatcccctacttccaaagagctcctcttaagctggacaccggcactgctgacccccacggtgagtcccgtgttctgtgatgggagctgctgcctttgcttcagagaggatcagaggtgttacctgaggaagggcggggtggagagcccctcttgggccattcggggaagcttcaggctcatgatggtcttagaagaaggtccctttcttggatcacctgatgtcaggagtccaagaccagcctggccaacatggagaagccccgtctcaactaacaatgcaaaaattagccaagtgtggtggctcacgcctgtcatcccagcactttgggaggcagaggcgggtggatcacctgaggtcaggcgttcgagaccagcctggccaacatggtgaaaccccgtgtctactaaaaatacaaaaaaaaaaaaaatagccgggcatggtggcgggcacctgtaatcccagctgctagggaggctgaggcaggagcatcgcttgaacctgggaggtggaggttgcagtgagccgagatcatgccactgcactccagcctgggcaacagagcgagactcggtcttggggtggggggaggaaagggtccctttctttgtcagcttgatcgccaccgcaggacaaccccacccctcacagagcctgtcgtttattccttcttgatggtaccaggtgtgcagaccacgtgcacaccccagaggttcactctaccactcacttggccatcgagggtacacaggtgctgggtacaagatacagatatgtcttgggctcgtctactttattttataatccagtctgggcgtcaggaaagatctcgcagccttctgcaatagaagtctggcctggcccggctgcccaccgcccttccttgtttcccggtgggaagaaagcttcatcgtgcgtcttctctgttcacacacacccccatagcgacccctcagccacagacaggggactacattgctgcctcccccgagagctggaggcccctacaccagcccacctcttcctgggcctatgtgtgggtcctgactgcggccaggctggctgacaggttggcagtggggtcgggcgaccctccctcttttccacagcacttacccacctgccgagtgggcagacctcactgctggggcctcatgagtactctctgatctctctgccaggccagctcccaagaggcttgcttgagtccgcagagcgggaaccctggactctgagaatctgatgaaggttctggaggccactcagacacagagccaccccatgcacacactgtgtgcgacttcagagggggctgcagacatcaaggcgggaaccctgctctgagtgaacttggcaaggtgccgcttcttggtacctagggagggtagaagggcgctggtcctccccggcctccctgcaggccacagacggcttggccagccagcggtgctgggcgcggtgccccagcttttggatggctctggaccagggagaggagaacctgccaatcaagggggttcctcaaaggccaaagctgcctgagcccagtgttgctgtagtacccagaggcaatgaggccccagacattttggaaggagcccccaagcctgcaggtgtggctgggggagctgccccaggcattttggaaggagcccccaagcctgcaggtgtgagtctgggggagctgccccaggcattttggaaggagcccccaagcctgcaggtgtgagtctgggggagctgccccaggcattttggaagcgcccccaagcctgcaggtgtgagtctgggggagctgccaggtgttggccacagggcgctggtgctggagaggcctggccctctgctgagtggcctcgctcactgcccaggtggttgggaactggtcagcaggtgctgttctttgacctcgtttcccctgtgaactcatgctggggcaggaagatgtttgtgtcctgacggccccccagcaccttcgaggaacagacagtcccctgcgcctgtgacctgcctgccccaccctggggagaaacgcagcgtcagtcctgggtccagtgagccgtagacccttggccctccaggatgggccctggagaggcgggaggggcccgtggagctggtcctgggcttctgtagagaggccaggaggccccaggatccccacagagacttccccagtcccgcttcaagacagcggaaccagctcctgagccgaaatctggagggatctcctttctggaccgtgaccccagccggggctggtaccgatgaccggcacagccagagccgtgacatccacagcgcccttcccatccgatgcctggatgccgtggctgtgctcggggaggcctccggggtccccagcccctcaggctcatgtggcacaaggtgccagagaagacagggcgccaggccggtgggagtcaaggtttcccatttttctcgtctcagtctgctacttaactgctgtgtgcccgcgagtacatccctttgcctctctggttctctggtatcagctcaatgaaggagctgaacaggatgatctcctggaatccagttcatgtgatgatcttggccatgtctcaagattcctagtcctaaaccttaaaccctgagcaccctgggagagtctgtcacagggctgcacctgggccaatgccagccattcagtggacacgggagcagggggtttagtgggaacacagggcttcttgacccctgtcctgaagcagccccggcggggagccattatcacctccttcccccatgccccagttggttcctctggcctgtgagtattgccggagcaccttccacgtgccaggcctgcaggaactagggacacagaggcgcccgagacagacgagaccctgtctgcaggaggagtccgtcaacaaatgagatccttgccggtcagatgagtgctgtgaaaaaaataaacacaactgggtaacgcagtagagagtgacggggggatgcctggcttgagaggatcacttttgaacgaagatttaaatgacaagaagaattcagccataaaaaacctgggggcagtgcattccaggccaaagaaccggcaaggtccacaccccgaggcaggtgtgctcagaggcagagggggacagtgtggggcgttacgtggggtcaggggacggcggccaggcgacgtggggccctgcggttcaggacagggcctttaatccgaatgcagtgggaagccgcggggtgttcaagcacagttctgtgacgatatgttttgaacacgtactgtacgaggcatcattcttagcctgtgacgcaactgaggtgacacttacaaggtgctgttattcacactgtttatttatttatttgtttgggttcttttgtttttgtttgctgttgttgttttgagacagagtcttgctgtgtcgcccaggctggagtgcaatggcgcgatctcggctcgctgcagcctccgcctcccgggttcaagcgattctcctgcctcagcctcctgagtagctgggattacaggtgcccgccaccacgcccggccaagttttgtatttttttttttttttttttgagacggagtctcgctgtcgcccaggctggagtgcagtggcgcaatcttggctcactgcaggctccgccccctggggttcacgccattctcctgcctcagcctcccgagtagctgggactacaggcgcccgccacctcgcccggctaattttttgtatttttagtagagacggggtttcaccgtgttagccaggctggtcttgaactcctgacctcaggtgatccacccgcctcagcttcccaaagtgctgagattacaggcgtgagtcactgcgccaggcctaaatgtgttttgaattttgttttacatttttaatttttttttttttttttttgtgggagtctcactctctcgcccaggctggagtgcagtggcaccatctcggctcactgcagcctccatctcccaggctcaagcaatcctcccacctcagcctcccaagtagctgggtctacaggcatgtaccaacatgcctggctaatttttgtattttttgtaaagacgaggtttcgttatgttgcgcaggctgatgttgaacttctggcttcagtggatccacctgcctccgcctcccacagtgctggattacaggcgggagcccccgtgcctggcccagactgtttttatatatgaggaatgaggctcagagagagacccagatgaagtcacgtgagtggcttagccgaggggcgatgttcagaccccggccactcagcctcagcgcaggctctcacccgcggtgtcctgccttccgtggccggttggggttgggctgcgtgccccagatgggagcgtctggagacgccgggctcctgcccgtcaggcatcagtgtggtgcccgtcctggcacgctgtgcatagcaacaggcaagacggttcttctcgacgacgccactgaacgtgagactcggagcaaggcaaggcctgggaggggccgctcagagctgacctgggccctggaattgctggagcccctcacgtccccggcagcaagctccatgcccagaaagtgttctgggcccgggcagggagggtgaagctggtatcagagaaggctgttgatgctgctttttttttttttttttttttttttgagatggagtctcgctctgtcgcccaggctggagtacaatggcatgatctgggctcaccgcaagctccgcctcccaggttcaagcaattctcctgcctcagtgtcccgaatagctgggactacaggcgtgcaccaccacgccggggtaatttttgtatttttagtagagacagggtttctccatgttggccaggctggtctcgaactcctgacctcaggtgatcctcccacctaggcctcccacagtgctgggattacaggtgtgaaccaccgcgcccagccctgttaatgtttcttaaccactccaggtccagctcgaggcttcagagcccatggaggtctgacaggtccttggccttcccgtggcctccagcgtgaagcttcctggtcaggaccacagaaggcctctcatcttggactttgacctctgagggcgcccctttcctttcaggacagggcctccgtgttgctttggccctggcctgttccttttctcaagagggccccactgcccctgcccttgccactctggcatcctcgacctgccctgggctggggcagggccggcttcctggctggtatttgtagcccagttctgagctgaagctgaagcctccaggctgcctgcacagggaggcagtggtggggtgggctggccctgaggaagacggagccctaggccgctgggggagatgtgcctggctgtggggcctccaagagcagcccaggtttggattttgtctgcttctcctcaaggtcagccatgcccagcccgggggctaaaagcaaagtgggtgccagggcaggcagaggctctggagtggacgtggggccggcagaggcgctggagtggacgtggggccggcagaggcgctggagtggacgtggggccggcagaggcgctgtagtggacgtggggccggcagaggctctgcagtggacgtggggccggcagaggcgctggagcggacgtggggcaggcagaggctctgcagtggacgtggggccggcagaggctctggagcggacgtggggcaggcagaggtgctagaatggacgctggggaaggcaggttgctgcgggtgctaagaggctagcctgccttggacaaaagcgtcgttcagagctgctaatccccttcctcccatgaggcttggggaacttcgaagttctctggtgttggaggggaagccagccgaggccctgggacacggcatcagcccgagcctatctgtggctggcctgggtatggcaggtgggcacaccttggctgcaggacaccttggctacaagggagcctggctgaccctgcagggtgagggctggagaggcggagcctgcctggcctagcagtgtggatgccaagccatgggaagatgtgtggagagtttatggagcctggcccggtgtccccaacccagctgctgagctggaagccaggggtaggtcctggcagcccctccctctctgccctgcctctctcggagtcgctcggagcagtcacgttgacggaatcctccggcgcctcctcgagggaggagaggcagggtcttggcaactcccgtctcccccgttgccagcttgccagccccgccgtgcctctcacgcctgtggtctgccccaatgacaggccggcttcggtgtcccaaggggacccagccctgagcgtggggctgcccttgggggagggcaggggaaagccagcccgggctgccaccgtggccgctggcctgggagccccaggaaacgtgcccaccctcagacccgatgcctggctcagggcctgggctccgcggcccctccagggcaggcgtgaaatgtgcccacacagctccaccttccacgtggttccctgtccgggggccacttgcactgaggtccttctggagtcattttctgtttttttttttttttttttgagacagagtcttgctctgttgcccaggctggagtgcagtggtgctatcttggctcactgcaacccctgcctcccgggttcaagtgatttccggctaattttgtatttttagtagagatggggtttcgtcaggttggccaggctggtctcgaactcctgagctcgagtgatccgcccgcctctgcctcccagagtgctgggattacaggcatgagccaccgcgcccggctgggagtcattttctagcgttcctgtcccacctctcaggaacagatttaccacctttgttgtgaagaagcattttttttttttttctgccgccaggctggagtgcagtggcacaatctcaactccggctcactgcaacctccgcctcccgggttcaagcgattctcctgcctcagcctccccagtagctgggattacaggcacccgccaccacgcctggctgatttttgtatttttagtagagacggggtttcgccacgttggtcaggttggtctcgatctcctgaccttgtgatccgcccgcctcggcctcccaaagtgctgggatgacaggcgtgagccaccgcacctggctgaagaagcacttttttttatgaacctctgcaaccccctctgagggaaaccctcccgcattctgggatgccggggctcagagggtggagggtagaagagcgccagccgtgagaggcaggatggggcggcccccgagggcagggctgtgcctggaggcagggctcctcggggggtcagctcctgggcggtgggagtgaccgagtgggctcctgagggaagcggctttcaggaaggaggcggaggcctgggagctcttggggccctggcaaatgtggtcttcagattcccgtcgtccagtgagcccctggatcacgtcctgagtggcgtccactgaaggctgcttgggacctctgctcccccctccactgagacccccagtggccagttctaagtcccacctgccttgggcagggccaccacaggccccttactgtggattaaagggccctgggtgagggcttgtgggaggggaggtggtggaaaccatctccgaagaccttggggcgagctgcgtgctggagtggagagtgtggcccagcaggcaggagcactgggttggaatgggggctctgccacctccgagggagcaggagtggagaccggagggagcgtgcccctgaatccgagcacggggagctggccgggagcagccctccgggcagaggcaggagaaatggggtcacctgccccagggggtgagaggtgagccgagaggaagggctgagaccctcaggggcatccccaggatgttcctgaaactcagccctggaggacgctcaggtgtgcgtggagcaccctctgccctggagcctcaaatcctctccccgctgcggggccactttgctgattcctgccccaaacatgaggtcacttcggtccagaaaggcgaggcgacctccaccagccacctacgggattcttggcagagaatccacgctcaccttcgggtcttcactcctgctccctcggaggtgacggagccccatttcaacccggtgcccctgcctgctgggttttcgccgcaggggacctggtcgtctcctggacatgagcccccagcgccagcgtttctctttgggagaggcctgaatgcgcagtcatgatttgaccaggcgaagtgcccagacaaagagaaaacagtcggccggatgcgggggctcacgcctggaatcccagcactttgggaggccgaggcgggtggatcacctgaggtcaggagttggagaccagcctggccaacacggtgaaaccccgtctctactaaaaatacaaaaattagccgggcgtggtggctcgtgcctgtagccccagctactcgggaggctgaggcaggagaatcgctcgaacccgaaggtggaggttgcagtgagctgagatcgcgccactgcactccagcctgggcgacagagtgcgactccgtctcaaaaaaaaaagagaaggaaatagttgagctgctctcagtgaccatgtacggcccagtcgtcgacccctggcccagtcgttcgtccgccttttggctccacgatgttttgcagcctgtttctgtctcctgcctgtggcccaccttggggaggccccagtgctcgtgtgcccctggtggtcttcccagcctgacccttcacgagctccctctgtctccctgcttcaggtgatcagacatcccccaagtacctgctcccctgggcccatggaaggcacctgtctgctgggaccagagggtgagcagtcaggtgtcccatccaccaacgtcccaggggccagcccctccaccccggtgctaatctcatcaggaaatagcacagtccacatttcccaggagttataaatagccagcgcagttgcgggcagcagcgtttctctggaaaatgtacgctgtgcctctccctccctcctctgtgtttaaatgatatcctgaaatagacttggtttctggaggctgatagcctcctgggaaacagagcgtcgttgtcagggcaccgtggggccaggcaggcctctctgagcggataccagggccacacctgcagcagataccagggccacacctgcagcaggcaccaggaagatgtcagggcttgaggggcttacagcttaggaaagtgcccctggcccaggcctggcctcagaaggggctggagtgtgtgagacagcagcaagtgtcgcctgggaggctgcagagggtagatcttagtggagcaggaaggcagagaggacccaaagtttcccactgtgacctggggctctccgagaaggctctctggaggaggcggggcgagaactgggccttagcatcaggaggtgcagtcctgggtcagatgtgcccaggttgaacctggcagctggagcggaagtgatgggcacgaggcagcgggagggctgtactgggggtggcctcccagcaccaggtctgcccaccgggtcgggacacacaccaggaggcccgatgttgcctttctgaggaagcagcagttacagcagctgcgggtcatggacttcacacattctgcagtttcagcagagagggtgctgggggccttgattttgaaccccagctctgacttcctaggtgtgcactgggtaaattcctcactctcgttaagctgcagcatcctcatctgtgagatgggagcggctatgagagcttaaaccgcatatgtctgctatcatgatcatgaacgcagatgctgtgtgtagaggattcatcagtgtcagacttgcaggaagagctcgagataagtccgttgctctcactcttccataacagccctgtgagtcaggtgtggatgcctccatgaggaaattgaagttcacggaggtgaaaggccttgcccgagtgcgcacggttgaatgggagactcagatcagcctgcctccaaatcctgcacactccccccgaccaggttgtgtccaggtccccctgagacttgggaagggaccattggctcagcttcctgcagaagctgccaggaggcacccagtcgtgggaagctggggcggaggaggggctgtgggtgaatcggaccaggggccatggaattggcctgaggcttatgctgatgtgtggagagacctgcctcaagaaggggtggtctcaaaacatcgaactgcgccccataaatacatacaactgcaatgtgtcaattaaaaaataagggcccgggccaggcgtggtggctcacgcccgtaatcccagcactttgggaggccgaggtgggcgaatcacgaggtcaggagatcaagaccatcctggctaacacggtgaaaccccgtctctactaaaaatacaaaaaattagccgggggtggtggcgggcgcctgtagtcccagctactcaggaggctgaggcaggagaatggcgtgaacccgggaggcggagcttgcagtgagccaggatcgcgccacagcactccagcctgggcgacagagcaagactccgtctcaaaaataaataaataaataaaaaataagggcccacacagtggtacatgcctgtaatgccagctcttcaggaggctgaggcaggaggatcactgaagcccagggcaacatagcagcctggacggcacagtgagaccctgtctctagaaaaataaatacaggccgagtgcggtggctcacgcctgtcatcccagcactttgggaggccaaggtgggcggaccacctgaggtttggagttcaagaccagcctgggcaacatggtgaaaccccatctctactaaaaataaaaaaattggccaggcatggtggctcacacttgtaatcccagcactttgggaggccaaggtgggtgggtcatttgaggtcaggagttcgagaccagcctggccaacatggtgaaaccctgtctctactaaaaatacaaaaattagccgggtgtgatggtgcgcacctgtagtcccagctaattgggaggctgaggcagaagaatcggttgaacctgggagacgggttgcagtcagccgagatcacaccactgcactccagcctgggcaacaagagtgaaactctgtctcaaaaaaaaaaaaaaaaaaaaaagagggcatggccgctccagaatgtttcttccaagggtagcatctcagttgacaaagagcatttgattcctccaccctgtgtggctactgctgggggacagagctggggacagacccaggcccggctccgtgtccagacgagatgaaggaactacgagggacagcctgtgtgatccaggagggtttgcaaagaacagaagcagcttagaggggagagaggtttcgggaaagtaaggccagagctggggcttcctttgagaccctgtaggacccctgcctccagccgggctggtgatggcctcacgcttccccgtgtgtgaagaggtgcccggagcagtggttctcccctgaggggcacttggttctctgcacacacccaacttctgtctcctgttctgggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtgcctggctgtctttttaattatgtactgccaatcatggtactaactaatcctgaatatattttgaatatttggagccttgtggtctctggaaatttttgttttcaatgtatacagattttttttgtggaagcaaaatgtaatggtgaataaaggacttgaaaatataaaaatataaactaggacaacattctttaggagaaatggaatagaaacaaattcaaggagagaagatccaggagctctgtgagggaaagaagagcttgtttgtgtagttttttgttgttgttgttttttttgagacggagtctcactctgtcgcccaggctggagtgcagtggtgtgatctccgctcactgcaacctccacctactgggttcatgccattctcctgcctcagcctccccagcagctgggactacaggcgcccaccaccgcgcccggctaattttttgtatttttttttttttagtagagacggggtttcaccgtgttagccaggatggtctcgatctcctgacctcgtgatccgcctccctcggcctcccaaagtgctgggattacaggcatgagccaccgtgcctggcctgttttcttaatattgaattttgagagttttatataataagccctgaaattgggtaatattagccctatagctgtgttctttttcaacattgtttagatgttttttctttttttttgagacggagtctcgctctgtcgcccaggctggagtgcagtggcgcgatctcggctcactgcaagctctgcctcccgggttcacgctattctcctgcctcagcctcccaagtagctgggactacaggcgcccgccaccacgcccggctaattttttgtatttttagtagagacggggtttcaccgtgttagccaggatggtctcgatctcctgagctcgtgatctgcctgccttggcctctcaaagtgctgggattacaggcgtgagccgccacgcctggcctcgtgtagtttttaaatggatgagtgtgggtatcacgtcgctggggtatttagatcccactgaatccatgagaaggaatgatgtcacacttttattttaggatggcaatattgacatgattttggaaatcatactctttgcaactatttaaacttggaaatgttcagattttgacttcagaaagtgccagggagcgcacagttgctcagaattagttcgcaggtgcacaggcagacgggcgcgaaggcccccgagttacagaaacagaacgtggaacagtcctgtgtgagggttgcctctgacctcccctggggtccgcacctccctgggctccagcccgagcctggggacttcccctgtggaggatttgcttatttgggagccaatggcttgacccaagttttctccctgaatcttcccagcaatcccagggaggcaggttctgttgcagatggaataactgaggcttagtgagtttaaaacttgccaggattcaaacccaggcagcctcctgtgcgcgggctcctgactcttcaacacctccacgtggatgggctggttccctcctgatggacttgagcgcctcctaatcaggtgcttaccttttgtgagcctcagtttctgcatctgtgaaatggggtaataatacccatgtcccgggctggcagccaggagtgcctaacagggtgtgccctgcctcccccacggtgggtaacagagtgtgccctgcctcccccacggcgggtaacagggtgtgccctgcctcccccacggcgggtaacagggtgtgccctgcctcccccacggcggccacaggggcctgggggctagggtccccccaaagggttgatttccaggtaaacatcagcttatcccagctgctcacttccgccttcctgactgtgtagctggctctgagcagtgctgacccacggggagatctctggcttggcctccgagctggcacctctctcacccacattctctctctgcagctggacccacaaaccgtggagaccaagaactggcacacggacgtgattgagatgaacggggtgagccggggatgggaatgatcagtggcgtgagccgggaggtggaacgtctgtgcagcaggtgggcagcccggccctgtggctgctcctggggccgctgtgccgcctcgacctccccgcagcccagccccctctcccctcctgcccacaccctgcccgctgctgtcctgcaggtgttgtgttgagggagacctgggtgtgagctagccctcatttgcagtcttggggaggggacccctgtgttttgggggcattcctcgggcactcacaccctggggaatctttacctgcctcaccccccaaccagatcaaagtggaattttccatgaaattcaccagccgagatatgagcctgaagaggaccccgtccaaaaagcagaccggcgtcttcggtgtgaagatcagcgtggtgacgaagtaggtgctgcctcgggtctcccagtcctggcgtcggtgccccgggtcccccccagcccgggccccccagccctccccgccggtgcccatcctggcacctaatcagttaccccccgctcggcggtggcagatggccggtgtggatctagagtggccgcagaggcgctcacaggacacttcagaagcacgcgagccagcacctaaacgctggaaggtctcttgtgagatcccagatcgtctgctcctcgtaacaagcgggaagctctgtcagccgggggcctacgtttgggctcggcaccaacggggactggcggcccctcgggaaagggcacgtgtcccccggttcaccaccaccctggccccttgtctcaggcctgacccacctcctcatgtgggctgcctgctgggcctcctacaagcatctgaatctgggggacgttctttccctagagtctcggccttaccttcccaagttcccaaggcttctcctgcccacgtccgtcgatgccccttcggcaggcctcgggtgggctggctggggtggggtgcggtggcctctctctctgccctgcccctgcccccgccccagctctccatcccaaatgctagaagctctccagggtgtgtgtgtgctgggtgggggttgctacgggagagctgtcgtgggggctgccctccacccatcctcacgctccaccccaggcgggagcgctccaaggtgccctacatcgtccggcagtgtgtggaggaggtggagaagaggggtatcgaggaggttggcatctacaggatatcgggcgtggccacggacatccaggcgctcaaggccgtcttcgatgccagtgagtctgggaggcccagccggggcaggtgtggctgtgtctgagcaggctggtgggatggacaggagagctcgggggaaccaggagcctccctggagaggaggcttgctctgcttcagagtccccgtggcaagtgctttctcttgtaatcccctcccctccaatctcttgtcccttgctgcaggtaagcaactgcagaaactcacaagggccgactcacttgcccaggatgacccaacttgtaggttttggttctggacttaaaactcagatctgactccagtgtctttcttgctagttcctgggtgcctggtgagccgcagggaaagagctttgagcctgcacctgctgtctccagggccccaggtcccctctggggcagtgctgcctctgcgtgaagcccaccatggtgaggcctgacctttctggtttctcctccctgctcctgctggttcaggtgcagcagccacataccccactgtcaagaaacctgcactggccaggcagggatgaatccgtggggagcctggagtggaggacggggtggggcctgggaactggccggcgttggtgcctctgtgcagcctagaagctgaggctttgtcggaacatgcttttacgtgtgaaaagtgtgcaatgccttccagagaggggcttagcgatggagaggttccagtcggaaggaagctgcaggccacatggtatgaatgtggctctgaactctgggtgatggatttcactccccaaacaccctttcccaagcagccacagcagatggcccccaggctatctctccctgttcccccaaccccgacccacagagccgagtcacagacacctgtgggccctctctacatcctgctcttccaggggagaccagaaccagagctggagtgggtgggggctgtgtcaggatgggtcgggggtggaacggggctgctggcccagctaaggctgcctgacctcggccccacccctgcagataacaaggacatcctgctgatgctgagtgacatggacatcaacgccatcgccgggacgctcaagctgtacttccgggaactgcccgagccgctcctcacggaccgactctacccagccttcatggagggcatcggtgaggccctgagggctcctaggactgggctgggccagactgagccaggactccctgcccggagaagtaaccagcaggagaaatatctgtggcttcctttgctggctgaccttcccagtgcactggggcctgtggctgaggggtccgagggtgaggtgtggcctgctgggacctggtgcagacactgggccctttctcgcctgcctcttgcccctgatgtccccatgggcagccccttctgcttcctatttggacgttggcctcttgcttggaagctcgagcatccagggaagactgccctgaggtgagtggccagaagccagcatcccagaaccaaggaggaggctggcttaagccatagggcactcgagatgggttgtgctgagccttccagcgggaccacacaccgtcccgtcacctctgcggagggccccggccagcaggccttccgcctccacccacctgggccaaacccagccccaaggaatcccttcagccttctctgctcctggggcagactggagcttcagcccccacggaaggctgcttgcacccacgctccagcagcagaaggggtggagaaagagaatccaccgctggcaggatatgtccctactggcttaaccttagccacacagaccagggggtgtcctgttacgagacaggggatgccccagcacccaaggcctatgcagtcagctgcaggaagggggtctgctcccaccagccggcctcctggctgagttaccagtcgtggtggggcctcctggaggaagcagctgctgacagcccacccagacaccaggccctcccctgtggggtctgctccccaaaggcctggaagcctgggctctctcccgcaggggcccacagcctcacgaccacaggggccctggcggggagccccaggagccaaacgccacactggcccttctctcccacagccctgtcagaccctgctgccaaggaaaactgcatgatgcacctgctccgctccctgcccgaccccaacctcatcaccttcctcttcctgctggaacacttgaaaaggtaacggggagcggccccaaccccacctcctcagtccctcctcatgaaaaggtaacggggaggggccccaaccccacctcctcagtccctcctcgtgaaaaggtaacggggagtggccccaaccccacctcctcagtccctcctcgtgggtgctggcctccatcgggctgtctgtggggagtgagagtttgctttccaagttcttgcactcatgtttttctgttttgagaaatatttgggtcccgtaaccagtagtaacctcaaatattgaccatagaatgctcagaatggcagggtgagagcccaggactacaggcaggttttataatcagtgggtcccaacctactggtggttcattcaacgaatgtagccatttctagatgcagtggggggtggacagcagtggggggtggacagcagtggggggtggacagcagtggggaatggacagtagtggggatggacagcagtgggggacagacagcaggaggatacattgtaagccttgatgcaggtgctgcttttcagttacatagagacgtgtggactgtgttacagcatgggttgtattgtgggccacagtcaaaaaaggtgaaacccactggtcttggcccacacctcactagacatagggaaactgagtccccacaccaggcggagacttgcttgggttagtagcagacctgtccttagagccctcaacttccagatcctaaattcagacccttcttgccttcccaccaccctttctagtcaggtccaaccaagagtggctaaagttggttgtacttgtagcaaagttcagaggtcctcaggcttgcgtggggaggtggtccctgggcgtcccttaaacccacctgcacgccaggaccggggagccccctcagactgctctgcggaacaattcttccctgagctcagccccagctcagggccaggccccccgctgcagctcagccacgccaggctcgggagagccagtggagacctggacgcgcccggggctggtgtcttgtttttcccatcatgaaacatttttcctctggtttggccaggactagagccccaaccaattccgaaagcatttggcaagccttgtggggaggagtgggaagggaaaattcattcggcttccaccctgggaactgggcacagtctgttcccacatctgggcccctggctggaccgtgtgcgcgcgtgtggtgaggggctggccccgctgcacagctgcctgttggcatcacagtgtttgtttgcctgtttccaaagcaggcgcagccacagctcctgcctggagggtgggaatgatggtattgagggtgagaggcgctgcttagggtgggtgggtctcagcccagaaacattttttgagactgaaggagaaccagaggccctctgatatgtttgctgaccctgggcctgcctggacaccagccctgatggcagctcctgctgttaccccagggaagcatcgcagagcatctggcctgttgagtaagagaagcaggagaggatccagagggaggacaatcctgggtcccacgaggcagacggagaggcataggaggcagccctgggtcccatgaggcggacccttccggagaggcacaagaggaagccctgggtcccacgaggccgacctttccggacaggcacggggggacagtccccgggctcatctggaagtagggctgctcctgccccagcacagctggcagagccccgggtctagctagtgactcctgctgggctccaggccctgcctgcctttctcccctgccccacccaccttaactcttcttttgggccacttagcacatgagaaagcaacagagcggtaggtcctggaggcagctaccggggttcaaatcccagctctaccagttgctggctgtgtgaccttgggcaagtcacttaacccctctgtacttcggtttcttcatctacacgatgggggtgacgataatcatatttacctcaaaggactgcggcgagtgtgagttgttccagggagttttcagaacagcatctgctctcaggcaagggagctggagttggcatctgtgggctccctggctctggcagttcaccatcagttcagggggacccagcagctggagatgttagcacagaacactggcacatggctggggccctgctctcctggatgagtccccttcccccgggggaggtccccactcctaggagacagagacgaggtgaccccttccaggagtccttcaggagctcccacagcgaaggccaagggtcctggagctccgagtggctgctgaggaagggcttctttcctccccatcttctccttcttagggttgccgagaaggagcccatcaacaaaatgtcacttcacaacctggctaccgtgtttggacccacgttactgagaccctcagaagtggagagcaaagcacacctcacctcggctgcggacatctggtcccatgacgtcatggcgcaggtatcctggcaccgcccgggcccgtggctggcggagggtgacggtcccatgacgtcatggcgcaggtaccctggcaccgcccgggcccgtggctggcggagggtgacggtcccatgacgtcatggcgcaggtaccctggcaccgcccgggcccgtggctggcggagggtgacggtcccatgacgtcatggcgcaggtaccctggcaccgcccgggcccgtggctggcggagggtgacggtcccatgacgtcatggcgcaggtaccctggcaccgcccgggcccgtggctggcggagggtgacggtcccatgacgtcatggcgcaggtaccctggcaccgcccgggcccgtggctggcggagggtgacggtcccatgacatcatggcacaggtaccctggcaccgcctgggcccgtggctggcggagggtgagaccagccccttaggaggagagagaacagctcagagtccccacacctcttccctcgtgggaagctgggttgatgggctatggggtgtcaccagggaggcaggactgcagacacttctgcccctcccaggccaaaacaaacatgtgagcctagaccagggcccagagatgctggctgcattctcaggagggcctcagtctcagaaagcaagcccaggggtggggagatgctgggcccttgtcctcatgggtggaagctctgaggttgcttccaagggcgggaggcttccctgggattcctgcaagacccagagcaggggccggactgtggccgcctcaggacagagcagaagcttatggccaggttggggaagtggccctaggcccccgaccctctgccccgtagcaccttccacggctgcagaaaggcaaacacacctgggctccccaggaaggggcggtggccggagccagtctagggagtgggaggggcaacacaggctggagtcagcaaggacgaggccaaggacagggagcccagcctccgccttcctgtctccccacaggtccaggtcctcctctactacctgcagcacccccccatttccttcgcagaactcaagcggaacacactgtacttctccaccgacgtgtagcccgaggcagggtggctgcgggcgggtggtggaaccagcccctccagcctggggtccaactcagacttgaaagactgcaatagaaaactcccaaacccagcactccagactcgagggaagccagcttccaagaactggaatgcgtacgtcttttgtgccaccttgtacaaagccggctgcccagccccagcctcaccaccgcatcccacctcctgccctccatacctctagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgcctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagcagggacccgacttgcagacgcattgcccggtactaggaaggagtgaggtgtgttcccaccgtacacttcccacacgagctgcggctgccagcctcgggccatcagcctaggagagcagatgcagctccaggggctcgacttatagccagttacagctccccggctcttctgtgtggcagagcgtcgtttccgggccctcagggctggggagctcagttcccattgcttgtgctcagggctgagtcttaaagaagggtttgccggccctaacgctgcagcgcgtgcgcggtgagaggccctttttgagcctgtttactcctgtggccttgggcagaacagtaaatactctgtgcacggaggaaagacatgcccaagaggaaggaagtactgaccatcggctgcctgtgagcagcttagcaaggagcccttgctccctgggaaaggcggtgaacttgagtctaaagatgcagtgcctggcccttcctaaggtccctgcctggcatccgagtgtcggtgtgtggcacagaaggctcctgcttgcttccaaagtgatggacaggaaggggcagagtgagtcacggcccagactgggcaccttcgcgtctcagcctcagggagccccacagccccaagctcgctgaggcaacgtgagaacaggctatgggaaggctgcaaaggctgagaaatgcaaaggctcatatttataaatcccacccccagagtggggagggtcaggtgccagacctggactaaactgcaccaaggaaacacccagcagggtctcctgtgagccggggaccatgcagcccgaaacctccagtcactgcgcccggcaggagtcaggagccagggactgtgcagcctggaacctccagtcactgtgcccagcagggtgggctgtgcccagcaggagtcaggctaagaaacgccaggtctgcctgttcttgctgggcaatggctgatggctgccagtttctgctgatacacaggtaggatgggacccttcatgaatatctgactttaataagttggtaaggatatatttttttgtctatgttctgtttcaacttatgtagattattataaattgatgtaaaccacgtgagaggaaaatgttaataaaaaatgcaaagccccatcatttgcacaaaactcagccctgtggtgtggatgtttgtgttcgcggtggtccagggaagccaccaatgtaaatatttaactcttccagctgcatccagatgtgagtttccaggaatctgtttacctagttcactccccttgagcctccctgtggcccacgggggctggggcagagctgcggggaggtgggctggagccctctccttgctcttcacaaaggcctccggatcagccagcatccaggctgcttctggctcacctttgccatgtgctgctacagtacaaatgtcccacctggccatcggtgtgccttgaaagtggcatgaagttgtccactgaacaggaagcgtcttcttttatgtaaacgcttctctacgctttccttcaaagtggcatatctttgaggcagccttttggtctaatctgcttgtcagagaagctgggtctccgagggcccaccctccctttgagagagtcagtggcgtgaatattggctcccaccagccaaagcaactggacactgagtttattctgaagatcaggaacagatgtctctgaaaattgctgtttggtttatgagctcatactggctccccagccatcgaaaacaggaaactattcatctctcgagtgaataggcagcgtggacaatgcctcgcttactgaaccgatgggtactgacagccctggcgctcatcttttccaaggctgttgtgagggcagcatctcttgtatttggtcccacgtgctagactgaaagatggaagatcccaggcatcctaggactttgacaggtaccaggtgggaatgtctgcccttgcttcagagtgcttgtaggtgtcctatatttagggacagcagaggaaacaatttgttctgagctctagggaacgctccaactggcctagcagtgatgaagcctcctagctgtgagactgggaggggcgttatatagaattcactgtaaaaggacatgagccctgagcaggaactcacattcattccaagaaaatggcaaacatgacccaaggaaggtgttaccagctgggtttgacatcatcactcatgtacaaacactcgggcctccaggccatgtacactgagtgtgaacgctggttaagagtgtgtgggccagaagacagggcagatgaggaagaaggcaaaaaaggaaaggatagaggaattaccgtattataggaaaaaggagactcatcaccactggctgaaggtgcccagcactgtgtggcccccaccaagcgacctgcctgtgccccacccaagagcaaaggcctgactccagcagtgtcatccccccacagagcaccagggtaaagcagcaccagtgctgaagcccaactgtagacggatttttttttttttttttaaatatccatggcacacaactaggccaagaaaaataccacaaggtcaagtcgaaaacacgacatgttaaaacacttccttgaccctggagaacgaggatggtggtgaacagcccctcagcgacgtctgatcttggccagtagctgctgtgaccgagtcaccaagatgaccacagcaggacccttcacatgtggcctcaagctcggccaggtccagcagtcacgtcgtgaaggcagtgtgtgcctctcggccggcacaggaggggcccatcgagttcatggatgggatttcactgcatcccaggaaaaggctgggctgggcttcttgaggcaggccctggcagatgtaatgagcttggtgaggatgacacagtcctctaacaaccctgcctcagcgccccatcccccgcttccctgggagctttctcattctttcccttcagatgttatctttgggccacccggcactatttttggaatagggaatttgaaaataaaatacaaataaaccaaccttttgaactgtaaggtgtgtggcggtgggggaggggagtgtatttttaaaaaaaaaacaaggatgacagaacacaaaacaagtgagataattggttggacggcatcagtccgcctt

SEQ ID NO: 15788 - DNA, 120727 bp, Human; identical to SEQ ID NO: 15787
  misc_feature (1)...(120727): n = A,T,C or G

SEQ ID NO: 15789 - DNA, 20850 bp, Human
gcaggcatcctcacccactttcatggcagagaaaaccaagcttggagtggggtagcttgggatcacacagctagcaaatgatggagtgaagattccagtccaggtcttctggctgcatgtccagtgctctgtcagtaaaatcctggctgttaagggccaccctgagacagaggcaaaccccagtttacacccccccagtgcaggaagtggttttcgagggcagatgcagagcccggcatccgtggtggctgtgatgaatcatcggagtgagagctgcaggttgtccctgggtcagcaaacctggctgctcagtgagtagctgtgtgatgttggacaagtcactttcagcagcccaccactaccctcaacccaacatccggtgggcatctggggcccaggagccaaagctggtatgagtgtgaactctgggtgtcatagctgccatccctccttagcctattctgagctctggattggatttgggagaggatttgattaggtcctaaacagtgactccatttagagggcctggttcatttcctgtgtgcttacagcagatgagacatgggcagaattaacctggtccagccaagccaaagaagtgatggatgggaaagacacagacccccaccttgggagggtggggcagtggcttccagcactctagacccaaggccctgggtgagcaagctggtcttcctggggcgccctggctggattcttgttacttcagctgttgcaacagctgtctcactgggtccccagctgcctgtacttcctctatcagagcagtccccatgctccttcaaactagttgtctaacctctgttttttctacttaactgagggcagagattgtgtctgacttgttccctgccgtcctcctagtacctacctcagtgcttggagaatgcatgaatgtatgcgtgccccagtcctccctgccatccacacatcctgcccacattccccagagcagctttgacacagcacagctctgcctgtggcatttcgttgctcacagggcaaatcccatgcccaccatgtgttctgcaacctccccctcatctttgcctcccctcctgccctaattttctcctacacttgccaccctcccacccctgggtttctcgggtttcctataattgctccggagctcccgtcaaaccacttcccaccccagctctcccaagaacaggggccttaccaaacctgcacgcagtccctgttcatacagacctgcctgggagcacagaaagaaccatgagctctgggccctgttcgccagcatctgctgatgtgggatgcacccaggtgcggggcctcaggcagcactccaggctgttcctcctccttctacagccctctgaggtccccaaacacttgtgtgtaaggctccaaggaaacagggagagaccctgggcaggagatatgagttctaatcctgcatcagcctctcattcttaggtaattcctttaccctctgggaccccaggtttcttatctctaaaataagaccactgatagctcccattgtatcaaaagcttttccagggccaggcactgtgaggagactcaaatagtcctgtgagtccagtatgatatcactgggctcaattccagatgaggaaacggaggctctgaggtgttgagaggcttggccagagttgcacagctaaaaagtggccccattgggatcaaaatcagcctggctcgggtatctgagcacataaccactgggccctctgagaacccttccatcttggttagtttctcggctgatctctctgggtaggtgccctctgggggcagtacccctgcctgagtggcacttcccctcctggctttgtttggtttggcctcgatttagaacagggttggcagaggcaggctgacttgcatttctggttttgggtttgttgctgcactttccccaaggggtgggcgggctctgactgacagtcaccactgggacaggcctgggccccaccctcaccacccaggaaaggggaaatgcggcccgctccccactcagtgccactctgtgccactccgtgccaggccctgagggcacccggttgctgcttccttccgtctttccccaaggactatcagaggcaggtggctgggccagggggtgggtcggggggaggtctggccatgtggtagggtgataggactgaggggccccagggagctggctgcagggcagtttgtttctcctgatggagaatgctccctggtgggtggggcgatgggctggggactggtttgttcatggggacagagatcagaagtgggcttgagaagaacagggccagaaggcctggactctggccccagcctagcccctaatttgtgcagggtggctttgggcaagtcactaagtcactgtctagactgggccctcagccttcctgtctacccaatggagggtctttctgtccacctgggaacagcctgataggactgaagcacagcccttagtttccagatgagaattctggactggaggccctgacattacaattgccaacactgactctggtgtttggcaaaatttggtgtatgtgggaaacacgtgcctctggttgaggtccttaacttcagaatttccctctagatcaatgctttttaaagcactaactccaacaccaccatcttctgtaggagctttcgagctttccagcttttccagcatacgctcctgatctgttactcaggcatgctggttatcccatttcatacgtggacaccttgaggcctaaaggttggtgactggctctacctgacacctctgtgtgattctaggttgccccttgctcctctctgggcctcagcctttctgtctatgcagtggggatttcggatcgctgttgtttcagagtctgaggctatgaggtctgagagggcccttgtgtggagtcacctctgagctgcaggcaggatttccagggcaagaaggccacagcatcagcaggcacctgtctttggcctgtgagccatagcctaaggcgtgcccttcccgaccttggccagatcacgctagagtcctccaaggcctcccctcccttgcccagccaccttctctgctctgcagggctccactttcactttcacactcccaggctgtggctcttacccgtgccgagctttcacatccgctcacatctgtgctcccagatgccagcgtgacccctgacacgtgtgtgcagcagcctgcagctgccccaagccatggctgaacactgactcccagctgtggggcttcaccattacagactccccagggcttcaaagacttctcagcttcgagcatggcttttggctgtcagggcagctgtacaatagtgggtaagtcaccggcctttgggctcagttttctcatccatcaaatggacattaatgatttctacaatgagagctcttaacccatgttctgggggtacttacccctgaagttttctgccagtgtgcgcgtgtgcccgcaggtgcacacattcccaagcatctgttcagttcccgagtatgggtgaggtctttccctttcattagttctcagcagctatggcttcttgaagacagaacctgggctctaaataaatagttccagctccggcattcctggtccttgactgggaggggcccaccccagacttgagaactgcctccctgtgtggttgtggcaccatggacactcctgactttctcggggccccaatcttctggtgacatagctgctattcagactttcattaagagaaatgtttttctctttgcacatgaaatctactgtcgaaactcagcaaaaccccctaggatcccgagggttgtgtgtgaggcaggagatgctgtgttttttgaggaatccctgagcttcctccaagcagtttaaaaatccctgggtgggtgattcttcagggaggttccgtgtgtctgcgacatctggtgagtccaggtgtggacaatattttaaagttccggtttcattccagtttaatagtttcaaaaagatacttaagcgttcagagcacattcttgtttgaatgactcattaggattttttaaacttgagttcaggtagaagacaccctgggctgggttcagtgactgccctggcttggttctggtccataagcagagactgcctggttctcctttatccccagaggcaactttgaccctgtttccttttctgtaaaatggggacagtgatgcttcttttatagggttgtcgggaaggccacataagagagtggggtcaagctggcctggcacctgccaaagcaggagctagatagatagtggttatctctccctcttctcctataaatgaccagctgtgtttttgatggagcagaaagttcaagcaagaagacagggtgagaattgttacccagctaagtcaaaggggctttgggggttccatctggcacctcagctttcagactgggggcccggggttcaggccactgcctgatttcatgtcagctcatgcatggtgtctggcatcttggagcctcctcttctgaactgttcttgttttctttttgtttcccagatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaaggtgagaaagctaaagggggagggagaaggatacatgcaatgtggggagggctggcccaggggctgcagggaatgagaagtcaccatgttccacccccactatcctggcagcctcccagcgaactttccacctgttggacagaagataaaactgaggcccaatgggaccaagaaggcagagcatggacttaaacacatgactttaggattccagatgctgtgttcttatagctccactggtccccacagaaagcagagcaggtgtagcttagcccaggccattgtgtatttggatttaaaagatctgagatagtagctggagaaatagagttacagcctagccagactagaaatccatcagccagtcacaatgacaacacacatttattccgtgtccacattatcctaagcagtttacattaactcattaactctcacaacagccctttgaagtagatagtatttttgtgcccattttacagcagaggaaaccgaggcaaagagaggttatctaacttgctccaggttacacagtgtatcagtgtctgaactagaattagaatctggttccagggccagtgctcttaaccaaccaccacaccgtttgcctctcgtgaatatttatatgtagatgaataagtatttatggatttcctgctgtgtaccaggccctgcgctctgcaacatggcaggagccacagaagtgtgtgaggctggtctcaacctgagagaaataagttaactgtgtgagccttgaaagtggcctaacagtgaacagattgcgccatgatcttgaagcctaccagctagtttgggtctgggctctgtttcttactatgtggctttggttgagtcactcaactcctctgagccatagttttcttctctgaaaagtaggggttaatagcactcacatcccagaatggttgaggatgaatggaagaggctggtgcctgataacactagccgcttgagaggcggccctcagggaatgctgggccccactccttctcttgaaatgcaacagccagtgcaaggtgttggtgtgaggctaggtgagtaggggtgctcagtgcccatggagcacaactgactcagagatctagaacttcaggaggacagaccccagggcctaaagccatcagggaaagcttctggaggaagatacctctcagcttggccttgaaggatgaacaggattagaataaacagagaggtagaggcaagcattctttggctagagcagagcattcctaaagggcagatgcctggcacaggtgctgctattcctccctccaacccatggcagacatcattaatggattccagcatacttcctcaccaagttgggacatgtcctcagaagcctgcttagcttcttagccactagcaagaaggcagacttaccttctggggagatgccttctgctgaaagctagtcattctgacagggcaggctggggccctccagaaaagggtcttgaactttggccttggaactaaatctccgtttcctcatctgtaagcgtgtgtggttctcacactgtggtgtgctccggaatcaccaaggggaggtaattaatatgtgattcctagtccccatacccagaactctggaatcagaatctctaggggtggtgcccagaccctatattttaaacatgccccgagggatcatgatcttgccaaagtttgaatatcaccatcttaggccatttcttgatggtttctacaggagagagtccggaacgctgtccttccaaggcaaggcctcaggctcattcagatcaggcctggccactcctctttggagggcggttgaggcccacctgccttgggcttcccaatcctgattcccccactacacccttcccagttctattcccctcaccacacttgctccaataaaactatttatatacagataaattcacacacattcatatgtatgcatttatctaattccccagctcagttgacctcggctcctattttgggacacatactcctgcctgggagtctagcaggcctggaccagctctctcttgtctcagcttcctcctttgggtgcccaaggttcccactggcaccctcccctgtcccaccaacttttagccggtcacttcctttcttgggtttgagtggctgagctggcagagacatcagaggctgcccccagcctggtggtggccacccttccatgtggcttccacacaccagttcctgagccctttgccattcacatcctgccctcttccaccagtagcttcagtaggaaacttgtcaagaggagatgaagccccggatgggacaaacaccgtggtctagctccatctcttactggtactgggccttgggcaagtccctgcccctctgtgagccacagtttcctccttggtgaaatgggtatggtaataatgcctccttcctagggttgctgggaaaattaaatagcttaacacaggtaaaacatttagggcagtacctggcgctcagcacctggtgggtgctgcataaatggtaatcatgttatgtggagggggagggggagaagagcagtaaccagggtagtactggctgtgccgccattcgaagtaccaccagaccccatttctcaccttcctgacactgctgcaaagtggacaggcacttggcttacagtgggaggctgaggctagtgagagatattttgtccccagccacacagcagcaagtgatgatggcactggacgaggcctcaccattgtctagtcagtcctctgtggctctgccctagactctgagacctcatgctgatgaggggccgggggtgggggactggcagagggacagtggcaggttcccccatgacttctatcttcctggctttggcctggctcttctgggagggtcccctgatgctgatgggccactattcctaggcaatgccaggcaagaggtgaagaggggaggggtgaagtgttcaggctgtggagtcagacagacccaggttcaagtctcagctctgcctcctcctccctggctctgagaccttggccaagttgcttctttctctgagcttcggttttctcttattaatggaacacggagtcccccgggagttgtcccaagggttccagggcgcagtacgtagaaagcttgggctggtcatttgtgctgctgtgcggataagctgaggctgcccagagtacatgctgcctgccacagggtgacattcagtctcgacgttgtctccggtccacacccctgttatcctgccctcttatgtgctgagcaatttctactgtgagtaggaatgtcagaacaggcagacctcagagatagtctgctcgaccatggtgatctcacagatgggctgactgagtccagagagggagagccccctgcccccactccccgccatggttctccagctggccatcccctgggtgtggcgccctgtgctgagttgagtggtctcatggtgccccctgccgccagacccctgccttcctggctgctccctggaggccctgcagagcagatcacaggccttcttcctggggagtcaaggaagccccggagaataattgtgtttgggtccaggatgctgccattgaattctagtccagcctatctggctcagcacagagggtcatgggctattctttgacagtgaggagaccacaggctgcagcccttccctggccctgcttccttcctcccctgcaggggactggcctgggcagaggtggtccacagagggtgccagccctgtttcactaagctcccacgtaggtcagagatcagacgagaggaccccaaaaatgccttccagctccaagacgataataccttcaagcctcctatttttaaaaagcctaaagaattatttcggatgtgtaaacaagtaagtatagagtttaaatccactgtttccacgtggttccatggggcctgccaggctgggctggatcggagagggcagccatggatggccagggagccccagaagtccgaccaggaccaatagggaaaccagctgagccctgctcacagacgagcgctcagtcactagtgggctctggacccagaccacagttctctgctacttgttagttcagagagcccaggccagttatcaaactgccctgggcatctgtttcctcagctgcacactgaggggaaatatcagtaactagctcttagaatcgttgccaagattaaatgagataaagtatgttaaaacactttggcccggcacctgacatgtagtgaacgctcaataaataatggcaaaacccatgctagctgagagtacttgctcactgctgtgtgttgggcgctgtgctgagcacgtccccgtgttaacttacataatcctcaccacagccctttgagggaagtccggttattacccgcattttacaaataaggaaactgaggcacagagagggatgtaactgagctaaggtcaatgagctaataaatgattgagctaagcttcaaatccaggcaattaaaaatctacactcttaatcattactataattacagttataattacagtaagaattataattattgttccaagaggtggtgagctcctagtccctggaggtggctggatgaggctgggcagggcccagggattctgcctggagtgaaggaagggctgtatggtcctggactcacctccatctgcttttcagctggacaaggtcacatagtgagacagtggggagaagatggaaaggagaatccctttggagggcctttgcagactaggccctgggcaggcattgatgcagctgtgggaggggagggaagagtctgaggagccactctggccccctccaaggtcagaggccaaagcctccctgcagctatggtgagtccctagggctgggaatcagaacccgattttttcacctcaatttctccttggctcacaggctctttttggtgctggggtttccccagcagcccagggggctgactcctagggccagagctgcccagcccctctgtcaggctgctaggcttgggtcagtccctgctgaagacactctcctccccacagtggaaggaagagcccatttcccagcagcgcagaggctgaggatggcggctgggtgggagtggtccccaggcccattgtgtggagccgataaagtacggaagctgaggttagaatgggaggaagcccagggcccgagggctctttcccacgggtgggggccttgggcatggccttgccaggccagcatgagtgcagcctgtatgtgcactgaagggtgccctgaatggtgacagtggtaacactcactgggcaatgaccactggttactgaggttagcgtgggtgccaggactgggccttggggtccagagtttatcctggtgaaccttccatcagccctgtgaagtggctgtcactatgcctaagccatagctaaaaaaatggaagccgagaggctaggaaacttacccaaagttggtgaaagcaggatttatatccaggtctggttccaaacacttgctctgaaatcacacaccatacggtgtgtgcctctgtgtgcacgtacacacatgtatgtttacaactctggtggggcagcattctcaggaaggaggcagcacttcccgagtctttcacaggaaacattaaaatgtgttctgaccttgcatttttgagtagcagcatcctctggtggagaaacacaggccttgaattgaggcagattccagctctgtcacttacatgctgggtctccttggggaagtgacttaaattctctgagcctctatttactttataggtttattgtgaggtttaatgagatagtatctgaattatgccccatccagggtctggcctatagtatgagctaaatgaaggtgtaattcatccatccatccactcatccactccttcatccatccacccacccacccacccatccatctattcacccatgcattcatctaccatccacccacccacccacccatccatctattcacccatgcattcatatatccatccactcatccatccatccacccatccatccatctatccacccacccacccatatattcatccatccatccatccatccactcatctatccatccacctatccacatatccatccatccatccatccatccatccatccatccatccatccatgcaggtgggagactcacaaaagcatcccccgaggaaggaattgcacatggagatgaagaccttctgttggttggaaggcagagttgaggaggttgctgaagtaggggccaggctggagagataactgaaggaataactgaatggaactttctgccctgatcctaagatggtagatccagtcgtgttacggagtttgaatgttatcccgagggcactagggagccatggaaagctataaggcaagagaggtgcactcaggcctgtgtaatgatttattttatacactgctgaccatctcaggtctcctttgaacttcagaatcctgacttaatcattatgatcctgattttagaaattaaggaatagaggcttagagaggggcagggattggcctagtgacacagcagaagccctgccctctcacctgctcactgcctgcaatgaagcctctgtcctgagtgccagccgtctggcttctccccagtgagctggggacctgactgtcccaggaggagatccctgtggccggagagtctgccaggccgattccacttcatggccaggctgttcccagcagtggggtttccctccctcacctgtgtgccgcgggtgggggctttggggatggaaggggctggtggcagggaatgttgggtctctgagcctctgtttacttaggcaggagttcctgggtgcccagactgcatcgtgtctgtcttctctccgcagatgagcggggctgacaccgttggggatgatgacgaagcctcccggaagagaaagagcaaaaacctgtacgttgggaagatccctggcttctgcgctcctcttcctcccttgccccagggcttgtctctcctctaggggtccaggtggggagaagaggttgtgcctggtcccgcccacaaccccagacagacaccaaggaaaaactggatcttggaactttgcagtgaccccaaagtggggtcacctgggtcctgagcattctctccaagtgaggcaaagtgctgattcagtacccggaagccacagtgaaccagaagcaaccagcccgtttgccctggctttagcccagcttctgagccaagcagggaccaagtgacttcaacaactcctttgctccctctgggcccaagagtgacctgagaaggggtggaactgacagtcattggctcctctttctcttcctgagctcctgaatgctaatagtctcaggcattgccaggagggggcgctgctggcccagctgccgaatcccgcactcgccaagcctttctggccacactcaggccttcttatactatagggtgtttgttagaggtgtcaatgaaaaagatgtgtgtgtgggttctcaggtcttcttctacccccaggcctaagaccctggagactcgggggaggtatagggaggaggcagtggggtgcatgcacagtgacacctccagaggaagcccctccccaccaggtcctgtagcacccaccactaggcaggaattgggctatagggaggagcctcctgcaaccctcttctctggccttgaccgtgggtggggtccactaccctagaaagccttcctcaccccagctgccttgacctctccagctttctgcagcaactgttggcttctcttactccacagccaattgcattttcttagcaaggtgaaatgcataaaccaaaacagtcccttgcaccaaccatcttcacttaaccttttgtaggatgagagaggatccagggggtgccaggactgttgaatgtggtgctggaagtgggaggtgtagggaagcagtgtgtggcgcagagggcaggcatcccgggtgctggagcagccctgtctagcctcctttcaatgtaggtgctgccttttgaattgcctgaagcccacactttttttttttggagacagagtctccttctgtcacccaggctggagtgcgatcttggcttgctgcaacctccgcctcccaagttcaagcagttcttgtccctcagcctcccaagtagctgcgattacaggtgtgtgccatcacacccagcaaattttttttgtacttttagtagagatgggggttttgccatgttggccaggctgttctcaaactcctggcctcaagtgatcttcccgcctcggcctcccaaagtgctgggattacagacatgagccaccatgcctggcctctgaaggtcatactcttaaaagcttagacgaagagtcttagaacatctacggtaataataagaataaccattaatgtttattatgccccgcactgttctgtgtgtatttcatatgtaatctaatttaatctttaccactacttttattttccgttctgttctttcttattgaccttacccttattttacacgtgaataaactactgtgcaaagaggctaagttacatggcaagaaagtggtggggttgggacctggagacctggcctgctggcttctgtttgaggaaacagcttgacagagaaaaaaccttgataggaaacttgagagatcaggaaacgtgtcaaagggcacacagctggtaactgctggagctgggatttgaacccaagactagctccagagcctgggatcagcctcccctgcaggactctccttcattagacagggtgtctaggtcttagtgccattttaagcttgaatagcatcagaagtataaatgcttcaaacttaccaaacccccttgaaagtttaattattaaatttcttttgcacgtctttagttatgtgatttttgaataatcaatttttcattttcatttttggtttgagtcagcattttccatctttgggaggatggagaccaaaacttaaagtgaaacatttattattcgaaaatcacaaaaccatgcacacaacattaaataattaaactttaaaatggtgtttttgtaagtttataggacttgtacttctgaagttattcaggcttaaaactactaagatgttggggtcctgctgtatattcatgactggatgtcgccaatgcaggtgactgaggctgagaggccggctggcaggagccattctctgggaggtgccctgtacagggggtctagggaaaagaggggcgaacatgagcaagaggcatttaactcctttcttgccagcagtttcacccagtgctgaattctgctgcctccttggggaccggcaaggctaaaaatggttcttggctaaaaatagccagtcctgccaccccggtggtgggcagtgcctcccctggctccctccttccctttcagcaatttgctgacttgtcccccaccccccaccactgtctccctgctgccatggtaacgaggaggccagtcacaaatagctgggactggcttcctgccggggcggccccagaggctgtcccttgcagacacatgcccctttcacggctccctctcagggttggccagaaggaatttttttttccgctccccctcctggtccctcccatttcctggctcctcctgtctgagtcccagccccggcttgtgcctgggagtccagtcatcaggccaggattccagagagcgtgtgtggctgcagcctgcaccgttgctgcccgctgcccaggacgcggggtgggggacaggagccagagtggtgcctcctacagaccaatctgcggccccaaggtggggggccctacagagatgctccgaggcatgtacctcactcgcaacgggaacctgcagaggcgacacacgatgaaggagtaggtgccctcgacccagctctcccgactctggatttgcaggggcgagtgggccaggctgagcaaccctcttttctgcttctgtccccagagccaaggacatgaagaacaagctggggatcttcagacggcggaatgagtcccctggagcccctcccgcgggcaaggcagacaaaatgatgaagtcattcaagtaggtcctccctggcaccctgggaccctttggggaactcactggctccccggggagtaggactgagtggtagggttgaggggaaggggcttgccggcttgatccagctctgggggagacaggctttcacagagggagctgggtacctggcaagcagctaccctcacagggagcagctgccctagggggaaggctaggtggggtggagatgggggctggaagggaccctggccccgggaaagagggtgggcctccttcctgggcgccccagctgggctcagctgcagactgggcccagggcagtaaacaaaggccgcctggcccagcttcccccaaggttcccaagcctctcagtgccctcactgtgtttcctccctcacccctcaggcccacctcagaggaagccctcaagtggggcgagtccttggagaagctgctggttcacaaatgtaagttgggcctgcctgcccactccctgtgccctctctccctctccccttcgcccccatccagaccctgtgtagctggtgctagagaggccgccttccctctcctcggccgtcagggtgtccttgctgttgcggaggggctgagcctaagctgaggcccttggtctggccttggagccagcttctgccagcccctccccgtccatgtgagctggcactgcctgccggaggcccgtgggacctgtgtgctcagatccatattcccagaataagaataaacatttctacgtactgagggctttcacggcgccaaatgtgcctgccatctcatgggcagggtcccatcggctcctcccagggctccgggagacagaatcgatagtccccatttcacagatgaagacactgaggcatagagagggggagaccccactgagaccctgaaagaggcagtggcagggctggggccacatcccagggctcctggctgtcggggacgggcattgtactcagctcccagcacgcccatctttaaagtcctgtaggggtaagctgaggcatcttaagggcaggagaggctgagtttgcctcttaccccaggatccgttctcctcacagacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtaggacctcagggcagaccctccgctcctccaatccccagggcccagtggcccttcagctgcaaggtggcagccagcagcacaggaaggggagaggccagaatgactccatgagcccaggtacccagcagggaagatgcaagctaggatcaggggaagaacagaatcccagttagtaataaaaatggccaccaccaaggcactgccgcatgccaggcatgtgctgagccctttatgtatgcgttctcatgtttaatccacacaacaacctgtgaaacgaagagacaggctgggcacagtggctcatgcctgtaatcccagcactttgggaagccgagccaggcggatcacttgaggtcaggagttcgagaccagcctggccaacagggcgaaaccccatctctactaaaattacaaaattagccaggtgtggtgatgggcgcctgtggtcccagctactcgggaggctgaggcaggataatcgcttgaacccgggaggcggaggttgcagtgagccgagatcgcaccactgcactccagcctgagtgacagagacaaatcataattgctcccatctattgagtgcctactgtgtgccaggcactatgcgcaaagcacattatatggatgatcttgcttggttttcacgctttgaggaatgtactattattcctagctggtagataagacaactgaagctcaccgcacttaagtaatttgcttcaagtcacacacccaggtgtggcactgctaggatttgaacccaggaagcctaaccctcagggtggtattttcagccttataaatgctgccagccctacaggaaatgactgagccaggacttgaatcctctggtctgagggtctctacttcagatgaaccttaagatgtggggcaaaggggcttggaggtgagaggctggatgggtcccttccaggcacatgggccctagggtcagtccccagcaggcagccctgaccatgtccccctctgcctccccaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggccgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttgaccctttttgtgtgttcctggtcttgagccttcccagggtggctggggctgggagggttggtcgttgggctgttgattcagccactgctctcttgccatcacctgcccccatcctggagcccgatacactgatacactggtgagggctgctctcccatgccttcctctgtgccaggcactgtgccactcatcctagtggtcactgcatctcctccccaagcctgggaggtagggcttatccccattttacagatgaggagatggaagcacagacagggaaggtcacgtagccagcaggtggcaggggttcagcccaagtctgactgtctgcaaagcctgggctctgccggctacaggatggagtccttgcttatcgccagctggccacatgtctttcagcaagttccttcaattctctgcctcgccacaccctgaggtttgaatagaactttcacgtggtgcagggatggctggtgaaggtagacggggccagaatctcaggaagggtggtggtgggcttatggaggcctctgggcagaaggaacagctgtggagacaggagataggactcacagagtctttctgtggccctgggtaaggctttccccactgtgcctttgtttcccctcctacctaacagaagatgcgagtttaggaaaggcccagggcatccttcaagggaggacctgggccacttgcctagaagtgggcagaagaggcccagagtccaggccaagctgaaggcaaagctgaccccacatatataacctcccaggggccagggcatggcccagggtggggtctggctcagcagggctgtcttagattaagctagatggagttgatgcaggaggagctgggccccgtctccttggatcttgttccctgcctggggtcctgcagacttggagctgcagacgacatggggctgtacagctccctcctccctgcctgcccttactcatctccctgggcaaggccagccctgttggcccctctgcacagtgagaggatcagaattgttggtctctggaggccttcagggagttggactgagccctcttcagggttacaggggactagagccagggcctgggtgtggagcagaagctgagcagggcttcatcaggaggaagaggtgggctgtctgactgccgctctgaccacacctgacttttcctgccccgcttgcaaatgggacccctaatgcttgctcacccttgaaacccatttggaagaatcttctgtgcaacaacagtagcctaggtcagcagagaacccccttccctctgctccccggcagccgtggcctctccttgactagcccgtactgagtcaggcatgggtttttctgtctccaaaggctttggaatcaggcaatcctgggtttgagtcttgtctttgctactgacttgctctgtaaccttggcaagtcactgcccatccctgagcctgcaaaaatggggatgattctattgtcttctcagtgctgggatgaacagccagtgagccagttctgcagaaaggtcctaacctggggccaggtataccgtaggtgcttgatacatgttggcaccagagggtgagcccctccaggagtggtgctgggtctttctccaggacctggcaatgagtgtcattgggctttataaactgtgaagagctttcccactgtagagattcagtgtctcacagaggctggaagggcctgggaagagtcgtgcttctaattctgaacaagggcaccttccaggttttttccaggcctgagatttggggacctgacagctgggaaaactggggcccagggaagactataatactactccctactcccccaaaatggtagaggcagtactgggtctgagcccaggacttccctgcctgacctggcctctctcgcatcttctgctgggaggagccactgggtccacaaggagacccacctttccagttctttatattctagggattcagtttagggccaggccttccctcttc

SEQ ID NO: 15790 - DNA, 107827 bp, Human
tgctgggattacaggcgtgagccaccgcgcccggccggttattgtggttttaatttcatggtactccatttatcttggcctgttttttaaaaaaatatgcaatgtcctcttttgagaataagaattaggtattttctttttattattattattatactttaagttttagggtacatgtgcacaatgtgctggttagttacatatgtatacatgtgccatgctggtgtgctgcacccattaactcaagaattaggtattttctaaaattgggtcctgcttcatgggctaaatatattttgaaggagtaaattttggctggagcagtttattccttttctcatgtgtcacatcctttttcccccacaggattttttgtttgtttgtttctctgttttagagacagggtattgctgtgttgcccaggctagtcttgaattcttgggcccaagttgggattacaggcgtgagccaccacaccagcttccaccagagagttaaacaaacaaacaaacaaaaaactttgtttattctcctttgagattgactaattaatctttgttgatgtctagaagtcaagagttgatggttttaaacttggaagagttgaacaaagaggatatagggtctgccgctcttccttctccctccaaacatggcaggggaaaaggttcagaagcagtgcctgggtcattgtccgtctcgttgtcttagctttccttggtatccacctgcttcaggactctaatttttattttttcaacctctgttgtttgtgactgtttcttaacctggtgtgtctctttttctctaaacctcgatgttttggttttagtgactctatctttgcatttctatttcattacctgctctgtcagcatttctgcctatctgtaccaatctcggtctgtctctgaacgcaaatgtatctctcatgtgtttcgacccaccaccccctaatcccttactctctgctttgtcctcctgcctcagcctcccaagtagctgggatgacaggcgcccaccactgcgcccggctaatttttgtatttttagtagagacagggtttcgccatgttggccaggctggtcttgaactcctgacctcgtgatccgcccgcctcggcctcccaaagtgctaggattacaggcgtgagccacctcgcccggacttaatttttgtatttttagtagagacctggtctcaaactcctgacctcaagtgatccgcccgcctcggcctcccaaagtgctgggatgataggcgtgagacaccgcgccctcccttctgctttgtacttcttcatcgtacttatcacaacttgagcattacacgtatttgtctgtctcctctctctaaaaggtaacttctataagggtggatccccaggaacatggagtgtgctcaacaaacatctgaactaacctgattggcgtatcctctcagtgtctccttttagtctcgacaattgtgtttcacactttctcagtatgcaaatatctttctcggtctgggtcatgcctttcggtttctgccccagtgcagaggcctctaagtttatcagcgtgtggaccacagattcgcagaggcctgagctgcggcgctgccgggatatggcgcgtcgtcgggcctcaagcacagcccggggtccctcgctggctctgttcggaccctgctcggtcgctcgcctgggccccagccatctctcacttcagcccatgagttctgccccacgtctgtctccctgggtgtcttaagagacgcgacccgcaccgacgcccccgcgaatgcaccgcgaatgcacgtgaccgcgcctagtggcgccccctcagtcaacgccgtcgcagtgcccctcccgaagcccgccgcttccgccggcccgcgcggccccgcccccagccgcgaggaaccaatccgcatgcacacttcttgtccccgccccggcaccctcctcggcgcgcgcccctccctccgcccgcccgccggcccgcccgtcagtctggcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtggtgagtgtccgcgaccggccacgcccggcccccccaccgcccggggccgcagcggacgcagcctcggcctcgcccgcgcctcggcctcaggcgccgcggcgacctcgaacccggacttcaccgcggtccgcgcgccagggctcgggcgcggccccgggccggttgaggtttaggtgttgttgctcgcggttcccgggccttcggtcgctcgggaaggggctcagggagtggcgcggggggcgtaggccggtactagtggacccttggccccgggcgcagcgcggcctttaaagtctggaccctcgggaaggcaacggaagggtccccacccctcaatttgctagtatcatggccttcttttggactttcgattgtaaaactgtgaattccatcagatgcttgtcggtgttggcggcggtggctgctgaggtcctgaaagcgttttgcctccgcgtgtgtgcagaacaccgaaataatcgtttttctctcttcgcctctgtttgcagccaacggctttcattaaatatcctcagcggtgctaatggtggtctccgcgcaggctttctaaaatggattactgacgccagtgttggtggcatatttccgtcttgaagtttttacttctaagtggattttaatatcgtactgctggcgtttcaggaaggataaactaacattactctcttgatttgttaaagatccgtttagagttgggcctaatttgactttttttttagcccccaagtgagctcttttaccagcataaatgctcccagatgttttagcccaattgctatggactcctgttaatgatttagtggtcattatgtatgcagccttaatggagttcttgcagaatcacacgtagactccctcatcttgattcaggtcccttagaaaagtgaaatgatagtgacggttttttttttccccccgagacggggtctcgctctgtctccaggctgaagtgcagtggcgtgacctcggttcacttcaacctccgcctcctgggttcaagcgattcttcttcctcagcttcccgagtagctgggactacaggcgcgcgacaccacgcccggcccatttttgtattttttagtagagacagggtttcaccatgttggccaggatggtatcgatgtattgatctcgtgatccgcccgcctcggcctcccaaagtgctgggattacaggcgtgagccaccgcgcccggctgatggtagtttttattagagcaaactagcgatagcattttgtgctggtgaggacttgtggaaatagatttccttaaatctgaatcttgtgaatgtgtcttttgtgttgactgaagaaagtaaactaataatttattgaacccttcgtggcaggtactgtgctacatatattatttcattttatttgagcagccacattgagggaggaaaagatggtgttattccttttttcaggtgagaaagtatttcgaggtgaagccaattcttgaggtcatagaactagagttattaagattgtagactgagattctactagacacactatagctcttttcagctgtttttaggaaaacactctgcgttccttagtgtaattaatacttgcagaattttctgtatcttactgttataaagtaaatataagtctgtttcggaaatgtattcaaatttcaatcataattttagaaatgccatagaaggtatgttttaccaagtattgtagctagatagaaagattagttaaaattctttttaaagagattttaattgaatctttaatgttttcactttgtttaggagcaaaatgctgaatacaactgtgaaaattaatgtgaactcacaggcttaggagccaagacagaatttaaattaggtcgagcctgaaagaaataaggccctaaaaagtaatggagagaaagtattgccagtagcatcatttctccaccacacatcgcattgctgttgcactcactgggaagtgtgccagtgaacatgtctcattatgagaggctcagaatttcccatcacatcctttggcccttttaacaagattagcttatctaaaatgtggactgaaaaaagtattttacgtttaggacatgtcaattgaaaagatacccccatctgataagatttctcctgtctgataaggtttttactagtctgaagttgtttagatgtgggaactacttctgtcactgctgtaggcttgtttgaccttctgactctccatttgaaatgctaagtcccctttttgtgattgtcgtttcctaagtgaaatacaaatgtaattggaatttgaatccaagatccagattatagccttttatcaggttgatgaaataccctgctgttaaccttctccattgcacattattagcatttaataaatattggctaacagtgctggatttatggagggctcgttgaaatattcactaatatttgaatggtgatcttttaaaaaatgcttccaaaaggatttatggatttctagccattttttagatttacccccttctgtttccttatcagttcattaggaattgtgactattttgtttagagtcctttcctaatgattatgtagaggatgtaaagatgaagagtgggatttgagttgggcctttaagagtgggtgtgattttgatatgcagataataggaacaagtgacagcttgagctgtggaatctaatcttggaaatgtacttaggtggcaaactgtagaggactccaaaggcaaaactaagtttgactgtatatttgttcagtggaggaagcatcttatttatttatttatttgtttatttttttttttgaggtggagtctcactcttgttgcctaggctgtagtgcagtggcatgacctcggctcactgcaacctctgcctcctaggttcaagcgattctcctgcctcagcctcctgagtagctgggactacaggcgcgtgccaccatgctcagctaattttttttttgtatttttgtagagacagcgttttgccatgttggccaagatggtctcaaactcctgacctcaggtggtccccctgacttcagcctcccaaagtgctgtgattacaggctttagtcaccgtgcccggcctttttttgaaagaggcagtcatacatggtcaattttgaaattttttgggaagacaaatcaacactagtgggaatgaaggaagaagaaccggagtggaggaataaattaggaaagcctaaccacctagaggtgcagtaataaagtggcagcggaaggtagcagatggaggtgaggagttttgtattgacagaaatagtaacagggacccttgtgggaagagtggtaaaaagacttttaatcatggcaagtctgagtggaatcaaaggattatgagaccttaaagggtaagagaccaagagaggtgggatttggatttggagggatttctgagatagaacaaggcttgctggttgattggctatgggcggttgttcattctgaggcctctaggttgggagcctgggagatggtggtgccattatccaagtaaaggaatactgttagagcagatttgtcagggggaaatagttctggtttgaacttaagtttgtaatgcctgtaggccattcaggctatatccagaaaccatcttaaaatttgtaagaggggagcaggagctggagatgaaaatttgtgtaaatggtagttaaaatcttgagtggatgagcacagattcttatctgggtcattggttaggtgaaattgcaatcatggccaggcgcggtggctcacgcctataatcccagcactttgggaggcccaggtgggcggatcacgaggttaggagatcgagaccatcctggctaacatggtgaaaccctatctctactaaaaatacaaaaaaaaaaagtagccggccgtggcggtgtgcgcctgtagtctcagctgctggggaggctgaggcaggagaatggtgtgaacccgggaggcagagcttgcagtgagccaagatcgcgccactgtactccagcctgggtgacagagcaagactgggtctcaaaaaaaaaaaaaaaagaaattgtaattatatgttttctatatttatctttttggttaaaaaatacatagcatttgatagattttcaaatgagtccattatcctggaaacattaagaaccactgaagtagaacagaggaccaaccaggtaactctggcaaagaagaggaaactgatgactggtcagatgtataagggaacagtgtagacggggaggagggagaggaggagagattgaaacactcttagtatgcttggtcatcttagactaagatagcaagtgtctattttggtttaattgagtttgaaatgctgtttctgaatgcgacaagagagctcatggggtcatcttcatagagatattaattgaagccttaagagtggataagacatctgagaactaagccaaaggagtgcctgcctttactgtgtcaataaaggtcaagttatggaagaggacagaggaaatgtggccagagagaccaaagaactgggagtgcacgttatcaaaggagccggtactcattaagggattggtattgagtactataggagggaaacagaatgcagctgacaagccattatatttgttgactttcagctctttttttttttgagacagagtcttgttctgtcgcccaggctggagtgcagttgcacaatctcggctcactgcaacctccgcctcctgggttcaagtgattctcttgcctcagcctcccgagtagctaggattacaggtgtgtgccaccacacccggctaatttttttatttttagtagagacggggtattgccatgttggccaggctggtctcaaactcctgacctcaggtgatccccctgcttcagcctcccaaagtgctaggattacagtgtgaaccactgtgcctggcctctttttttttttttttaaagcggggatgttcaacttgggaaagctgaatgaataaaagaaaaaagagggggatggtttcaactaaaatttcattgtgatcacattcctgatggtacaatgtcctcctgtcttgttaaggttattgtgattatagcagactagtagaactaccactttttcagcactcttgttttgtattttacatacattaatgctaagccatataactgtacagcaaaagtggtaacttctgtttgttttttaccccacaagtgaagaaacttgaggcacacagaggttagttaacttgcccaatgacacacagctaggaagtgatgaagcaaccccagtttttctggttcctaagtagtgctccaccaaagatcagagttgagaaaatagattatttcagtaacaagaaatatctgttgtctgcttttgcttgtatcactttttagcctttaaaacctttcatgtagagttatttactcagaaaatgtttattgaactcttcatccaaataatgggatggaattggggaataatacagagaagataccagtgttacccaggagtttgtgaagtgctgagaggaagagaagagctgagtgacttggggctgtctttctttggcttcccagacttctgagctaggtgttgatgtgtgagtaggagtttgccttgagaaatgccttctaggcaaagcgaagtgtgcatgtaaaggcacagaccgtgaacacagtgcatcaggtcaggaaaaccacaaattacttgggaaggctggagtgtagggtgccttagtaagaaggtgggagttgagacagctgggggtaggcagggccaaatcctgaagggcattatttggtaaggactttggacttgatcttgtgggtgacggagtcattaaaggatggccctgtttctgtctgccagttccactcccactttatctcttatgctttctgcccattttgcctacttacttactttttttttgagacagagttttgcttggaggctcactgcaaccttgcctcctgggttcaagcaattctgcctcagcctcctgagtggctgggattacaggtgtgtgctaccatgcctggctaatttttgtatttttagtagagacaggatttcgccatgttgtccaggctggtctcaaactcctgacctcaggtgatccacctgcctcggcctcccaaagtgctgggattacaggcgtgagccattgcacctggccgcattgtgcctactttatctcgtggtactcagtgggggtgattttacctccctgctacagaggcatttggaaatgtataggggggcggctttttgttgtgttgtcacgttgattagggggtgttattggccgtcagtaggcatgtcaagggcagacatgctaaatggtctggattgcacggtacactccctccactggagaatcatcctgccaagatgcccatagtacagcaccccagcctgccccaagaaacatcaggctctatttaagtcccgcttttctctaaagctcatctctatgaactttgccctattgcttcctgttaatgcactctcttcatggatctctgctgggtgtttgtaccacctgtttgaaaggcaggaacagcaataacatatatcatatataaaaactctagacctggagacagagatattgagattcttaattttgcttgctcattgtttacttaacttttttaatcaagaagtctcctctacacttttggagctcaaagatgcaaggacagcagcttacatgagtaacagaagaatctagtgtttctgagcagagtttagagtaaaaggataagtcaaaacaaaattaatttttatattaatagcatccctaatgatgtattcctggtagttagctataaccattacaccattcccataatttgatttgtgtaaattcaagttgacttttccccaaaactgtatgtaatttattcctcaccttgctcacaatttatatacctattaattgaaaaacacctcattccccaacaaacatctagagctccttgcctccggcctactccacccaccctcttgcctaatcctgagatgctattttgctcccctttagatttgctttttttctttcacttcttgaggctcccacactgaaaggtgcctaggagctcatccagtagctgcgctgtctctgctccctctaggaaaggccacctgcctgagctttgaaatggcccacaccgtaccagaaggaagaagagagattccaggaggattcagacgttacccaggctttctggaaactgagcagaaccacaggaggagaaagctataggcagctgaacaaaatttatgtgtttctatttcccctgctataacatgaaaggactgggctctgtctgtggttttcaaatctcctcctctcttaggggcttcaggcctcaccccaaatagggaaacttcacatacagcattctctcccctaatccctgttttttctattctttgctcttctcttatctacctccttcccctcccgtttcccttcttcctctgcccttagtcttttttctttttcttaatttccttttagtcattatcatcttcagttcacataggtagtaactattagggttagcagggcaagatcccatttggaaaaaggatttgattgctttgaaaatgatgttgggcaacccacaggatagatggtctccaaggtccctcccagattctcagactcaaggcaggccctggggtttgaacctatggccagtaggagctggatagcaggtgtctgcatggataatatgccatgatcaactgactaatgttagttgcaagcctgccttgctggtttaagcttcattctcattcttgtctttttttttttttttttttttgagacagagtctcactctgttgcccaggctggagtgcagtggcgcgatcttggctcactgcaacctctgcccccaggttcaagcagttctcctgtctcagcctcctgagtagctaggattacaggtgcctgccactgtacctggctaagtttttttttttttttgtagtttttagtagagatgggctttcaccctgttgcccaggctggtcttgaactcctgacctcgtgatccattcgcctcagcctcccagagtgctgggattacaggtgtgagccaccgcgcctgaccgtcatccttgtctttgaggtattatattttgcactttacacataagggaactgggtgtcaggtaactcgttcagggttcacagccagtaagtatattgcagaactgagatgtaaattgagatttatgcagaccccaaatcctgtgaccttttttcttttaactactataggcttttctctgttataccgagttacctagaaacgtacttcctacagcctgggttcctgaatggattagccctaaagtataaaatgattatgccattgcagacagacctgaagaagaggctagaaaggattagagttaaagtaactttgttttttgtttttgttttttctttatctccaaaggatctgtcatctagcaacttaatttttatcaggaagcagtattgatttcttcccattccttctagttacctctaccagtttcttgattttcattcatttaatattattaaacacgtaccggattatgtgctaggcagtaggaacaaagtcgtgaacaaaagttgttcttactctttggtgtttacagtccaacagggcagtaataacatttactgagtatggtgaggtgtggagtgccactggatgatataagatattctgagtagtcatgaagggtttccgggaggaagtggtgtttaagctgggacctgaaggaagacttagagctagctgggtaaaaggtagggtagagtgctggaatgttttaggcactactttgtagagactgcattatagaaaatgaaaagtttatgattaagatctgggggcctttgtcatattactgcaaggatagaaagtgcagttaaagctttaggtatagttggaaccaggaactggaaaatagaccaacgtagctacctccctccctctttacagttacaaaagcttcttgtaccctacatctctcagcagctggattttcccccctcttttctcttttgtcacttccccatgcactcagcagaggagagctgaccctagctccctgaaggtatgtgtcttcaggttttttgatgaccagaggctgagaacactctgaatccaattccaagtggaacagaatgtgtaaaaacactgttagggagatcattctgcacagaacagctcactccacctggcctttccagcctgggagagtgtctgcctctggtctagtcagctgaggcccaaggtggggtcatttattaaataaagctgcatatctcggaatgtctaaagggcaaggtgggaattgtcaaaaggggtctcattgatttctgacttgttaggttaaagttcttggtactgttttccctgtcattctccagggagtgtgtatcactctccggtttttacagatgaggaaaatgaaacaaaagttgggtaacttgccagtcacaagtaaggggtcaaaggattgtcatgagtattaaataaaacagtatacttgaagtcctgagcacttggtacctagttaatgctctgttattcctttgaagtaaacagggttgacaagatgtgaatccccctttgtctcggtctctatgtaaagcagcatgtgcagaagtacaaatatttggcttggtggtcagatgactttacaatggtatggaagtgatacacatgcagtagaaaccttacttccgagtacccacgcaactgttctgtttttcattttcagtatagtatttcatacatcatatgagttactcaacacttttattataaaatgggctttgcgttagatgattttgcccaactgtaggctaatgtaagtgctctgaacatgtttaaggtaggctaagctaagctgtgatgtttggtaagttaggtgtattaaatgtattttcagctaggctgggtgcaggactcatgcctataatcccaggactttgggagaccgaggcatgaggattccttgagcttaggagtttgagaccaatctaggcaacatagtgaggccttttctgtactaaaggtactaaaaattaaaaaaaaaaaaaattagccaggtgtggtggtacgtgcctatagtcccagctacttgggagcctggggctgaggatcgcttgaacctgagtggtcaaggctacagtgagccgtcgtcgtgtcaccgcattcccgcctggcaacagagcaagaaactttcccaaaaaaaacaagcatttcaccttatgaggttttccatttatgaagggtttattgggatgtaagtccatagtaagtcaaggagcatctttatatagttagaatagggacagtcaagtgtttcatgcataatccaaatcttcaggaggcaacatcaaggtaacccgagtttagggatattctgcaaaataactggcctgtaaacctcaaaattaagtcaagatcatggaaccaagaaaacactgaggaattgttccacactaaagaagtgtgcagaaacatggcaactccatgtggttcatgattctgaatcggcatgattggcaaaactagaatgtctgaaaattagattgtagtcgtgtatctgtgttaatgattttatttttatcttcttttttttttaactcttcttttttttggtattttcttttttgttttggtttgtccttcctttttttttttgttttttgttttttgttacaaacccttgtgtcgatagctgactgctctgctgtatacgaaaccctgacccagaaacaggttgtctgtgaatggtttagcacaggtcccccgtgaatgtgcattgtgtgacgggcaaaagtgtggccgcctttctactgtgccaagttttccagcatgagaggctttccatatctggtcctcagatatgtggtgtgaatgaaggggggaccagctatccgaggccaaccgaggctccacagttggctgccatgtcattttgcctgggcgggattctgacttagaggcctttggtcataatctgacaggtgagcgttgacgattttgatggtagcattttgtttgtatgggagaatagtctagttttgtttgttggaaatagtcactaaagtattgggggataatgagaaagaaatactggcaaacttactctcacatgcttcagagactaaaagtttgataagctagatatagaacttttcctatggtttgagatatagttccttttctctaaagagttgtcggtgagtccctttcagaaacgtacttgagtgaggatgtgttgaaatttgtgggaagctgtgaaaggcagcttttagcctaccaaaagaggactggcctggaaggcaagagacctgagtcttggtccctgcttctgatgacatgtcacatgggcatgtgctcgtcactctgcttctgcaagtttttgtgtttctcatctgtggagttaagggattgggatggtctctagggtctcgtacagctctaatattgtcaccgccctcaggaacattacatgaaattagcatatatgcaatatattaagattcatgtgtggattgtttcccagttactagcgctgtctttaatgtaatttacctcagaaatctctggataatcattattgagatataatgaaatagggaaaaacttgaggttaaaaactagtaaattgatttacttcaacattaaaagcccacaattaaacccttgaggaaaatgactatttttattttttattttttgctctgcaagtaaggttggaacttcgtaatactgtatgacagtagtcgtttacctcacgaattagattattcatgtgtgtttgactgaagagagtttttacctagtgactggaatgaatgttaatgctgctattttggcattggaaaaaaaaggtgtaatgaaaaatgtcaagtttgagagagagagaaatacttaaatagaactgatttaaaagcaattctgaaaaagaaagaacttggcacaatctttctatgaaagcaaagactttactgcacagctaaagaaaatgaagcaaaaacaatacattgccccaattaatgtttgaattcactgaacacaaggtaggctagcaaagtagagagtaatatctttgcctcaccttggccacaaggatttattttgtcagtaaccaagtttagtgtactgctatttagctttttcactacagatgtgaaaatgtttctttttggggtttgtttgaaattttctttcccttttcaatttagcagtgctgaacctatcctcaaataaatttacatttttcccattaaatcaactttgtttctgttccatggttgaagcaaatactttataaagaaaaaaatcagtgtagacctttcacaagttaattattactgcagggctatataggcaaataaaaatattagatgttatgttttagaccagtgaaaaaacagttggtagtgatgctagattaagacttgccagaatgttcatccccttagtgagccattctgcttatgataacattttgtaatgttttcaggcattcttttgggacagccctgatcacttatcattcaaagggatgataaaagtgacaatctttagacgtgttgtaaattctttctttctttcgtccaaagggagctagaaagaaaagacatttgtgattatctgtccacttgaacacaactgctagaaagagctatttaattattgccaacaaggcagtgtgagagtttatagtaacattaggagtgtttccagttatcccagcaggattcagcattcaagaactggtaaattttggccagacgcggtggctcacacctgtaatcccagcactttgggaggccgaggcaggcggatcacctgaggtcaggagttcgagaccagcctgaccaacatggagaaaccccgtctctacaaaaaatacaaaattagctgggtgtggtggcacatgcctgtaatcccagctactcgggaggccgaggcaggagagtcgcttgaacctgggaggcggagcttgtggcgagccgagattgtgcgccattacactccagcctgagcaacaagagtgaaactctatctcaaaaaaaaaaatctggtaaatgtttgtctggcatcatagaatttaatgcttacctctaaaaatgtaaattggaaaatattttagccttatgtggtgtgtgatgttagcagggaagtctctaatgttttcacatgaagtcagatgctggctttggaccgaggtgtattttgtttacttaaggcagtatccatcatttcctattttagttttttgtttctttttgtttgtttgttttttgagatggagtcttgctctgtctctcaggctggagtgcagtggtgccatctcagctcactgcaacctccacctcctggtttcaagcaattctcctgcctcagcctcccaagtagctgggactacaagcgcgtattgccacccccaggtaattttttgtattttagtagagacagggtttcaccctgttgcccatgctggtcgtgaactcctgagctcaggcaatccacccgccttggcctcccaaagtgctgggattacaggcatgagccaccgcacccagctgtcagatgtctttactgcctccgtgaagatgatatgatttcatcacatttaacattgttaatgtgaagatcatgtcaatagatttccttatatggaatctctcatacctggaataaactgtgcttgtttatttgtattcctttttataatgtgccattggattctgtttgctaatattcagagattttgtgttgatattcgtaagtagtattcaactgtagtatcttttgtgcagtctttgtcaggttggggttaccattacacttgcttcataaaatgagtgtggaagttttctttccttttctgtgttctgaaatagcattaagactactttgtctttttttttttttttttgacacagagtcttgctctgtcacccaggctggaatgcagtggcatgatctcggctgactgcaacctcttcctcccaggttcaagtgattctcctgcctcagcctcccaagaagttgggactacaggtgcacaccaccacgtgtaactaatttttatatttttagtagagatggggtttcactatgttggccagactggtctcaaactcctgacctcaggtgatctacccacctcggcctcccaaagtgctgggattacaggcgccagccaccagtctaccttatcttaaaatggtataattttcctttgaaactatttgcctggtatttttttggttttcttagactggtttctgcttggtttctaccaccactcttaatcccctccagttgttctctgcaaccaccaccatgactgccatttccttgagcacttattatccattaagcacctttatgtgtggtaattaatgactgttatgtgttttgttgttttgatacaaagtctcactgtcgcccaggctggactgcagtggcgctgtcacttgaatccaacctccacctcccgggttcaagcagttctccagcctcagcctcccaagtagctgggattacaggtgtgcgctaccacatctggctaatttttgtatttttagtagagacagggtttcatcaccttggccagggtggtctctaactcctgacctcaagtgatccacccacctctacctcccaaaatcctgggattataggtgtgagccactgagcccagcctgttatgtatttttgtcttttgttttctttgagacagggtgtcactctctcactcaggcttgagtgcagtggcatgatcacggctcgatgtgtttattcttgtttttttcttgtttttctgttgtttttttttttgtttttttgagatgaagttttgctcttgttgcccaggctggagtgcaatggtgcaatcttgactcactgcaacctccacctcccagattcaagcgattctcctgcctcagcctcccaagtagctggaattacaggcatgtgccactacgcccaggtagttttgtatttttagtagagatggggtttctccatgttggtcaggctggtctcgaactcctgacctcaggtgatccgcccgcctcagcctcccaaagtgctgggattacaggcttgagccgccgcacccgggctggactattatctttctattaaacaatacagtacttagtatttcctggttttgaatttcatataagtgaaatcatactgtgtgtattcttcaactagcttttttcattcatcattatgtttttgagtatagtatagttacttgttttcactgctttatataccattgtataaatataccacaatttatccattctagtattaatggacattaggtttgttgttattacagtgttcctgcaagtaaccttgcacatttctcctgatacacaagagtttcacagatctttagacagattccccagtagtggaattgctggatggtagggcatatgtacattcaccgggtattccacattgttttcctaagttgttttcccagtaaagttttgtgttattattattgcacatcatgtgtttaattgattccttgatactttatgtttgttgttgctattctaagtgatatcttttttttttttttttttttttgagacagagtctcgctctgtggcccaggctggagtgcagtggcgatctcagctcattgcaagctccgcctcctgggttcacgccattctcctgcctcagcctccctagtagctgggattacaggcgcccaccaccatgcccggctatattctaagagatatctgtagatggtttatagaaatgcatttgacttttgtaaactgatgaattactggaataaaaagattgtccaacaaactcttattccagtaatccctctttaaattttttaaggacaaacatatcatctgaaaatcatgatattttgtttcttttcatgacttagatatattttatcttgtcttaactgtgctggccggactctccattacaaagttgaagagcagtggtgatacagagggcatccctgacttgttctgatgttaaaaggaaagcttttattgagtgataggggctactggtttttcataaggcttacttcccacccaccccctccccggaaacagggtcttgctatgttgctcagactggtctcaaactcctgggctcaagtgatcatcccactttaccctcctgaatagctgggattacaggcacatgccacagcacctggcttcataaagctttctttgtcaagtttttttaaacttaaagaaaaaaagaatcctgaatgattgaatttctacagatgctttttaattgcatgtatagaaattttcttgttttttttctttaagtttcatgttaccctaatagattttctaatattgaatcaattttgcattcctgggattaaacccaacttggtcatgatgtattattattatatattgctggatttggcttgttaataaataatagggtttttctcatgtggtttggtatgaaaattagactacccttacaaaatgaattggcaagtgtttcttttcctattcttctgtttttatttctgtaaaattagaatgattccttcaaagtttggtagaacttgcctgtacaagtctggacctgggtggttttttggttttggtatgtgtttggttttttgttgaaaacatgttaagctgattcaaaattattttaaaaatggttatacgactgttcctactttgaatttcttcttggtaattatatttttcttggcatttattcttctcacttatttttacatttactagagtattgtattttcttacctcttttaatcttattttgaatatccatttaaacataggtaagatataagtactgtttgtggctgggcacagtggctcatgcctgtaatcctagcactttggaaggccaaggcgggcagatcacttgaggtcaggagttcaagaccagcctggccaacatggcaaaatcttgtctctactaaaaatacaaaaattagctgggcgtggtggcgcctgcctgtaatcctagctactccagaggctgaggcatgagaatcacgtcaccccaggaggcagaggctgccgtgagctgagatcgcgccactgtgctctatcctgggcgacagagcaagactctgtctcaaaaaaaaaaaaaaaaaaggtactgtttacagaataagttaaatacttgtcatcactgtgcagattgcaaaatggaacattgctagtaccttagaaacgccttctcaaatctttaagagttgagtacgttccttaattttgtgataattgttcttttcagactcttctccctttttattctttacttttattgatgtataatatacataaagaaaagtggccagatgtggtggctcatgcctgtaatcccaacactttaggaagccaaggtgagaggatcactttgagctcaggagttcaagaccagcctgggctgattatagacgtgagccacattgtcctgctgggtatatatttagtagcagaatgactgtgtcagtctgtgcatagattccattttagtagatgtgccaaactgttttccaaagtggtaaaatatttccattagcagtgtattagagttcagaccagtgcatattctcaacaacacttggtatcatttttagcctctctagtgggtatgaagtggtatgcattgtgggttttgtttgcatttctctgatattttagctcttttttggtggttaactcttttttgtatgtttatgacattcggctatctcgtgaagtatttaagggttattttgcaaatttttctgtggagatttttgtttcattaaattataggagttctttgtagattttgatgagtctttttttagattcatgtgctgcagatattttctcctttccaagagttacctcttttttttttttttttttgatacagtcgcaatttgtcgcccaggctggagtgcaatggtgcaatctctgcttcctaggttcaagtgattctcctgcctcagcctcccaagtagctgggattacaggcacgccccaccacaccctaggctcactgcaacctctgcttcctaggttcaagtgattctcctgcctcagcctcccaagtagctgggattacaggcacgccccaccacgcccagctaatttttgtatttttagagacgggatttcaccatgttggctaggctggtctcgaactcctgacctcagcctcggcctcccaaagtgctgggattacaggcgtgagccactgcgcccggccgaattacagctattttaaagatcatcttcagtaactagtaactgggtcactgtggatatgtggatatgttgtctcttttttctcgtttctgtttccttgtatgcttggtaacgttcaagtgaatgctggatactgtgtatgaaaattgttgatgctctaggtgacatttttctccagagagagctctccctaatcactgataggcagatacagtggtgacagataaccataattcagtgagagattgagctgattcgagggttggttgcagttttttttttttttttgtattacacaccttttaatttgaattaattaggcatgatcattattgaaaattggtaaagtgtagattgataacaaccaaaacaggggaaaacattcatttaaaactttcccaaataaatgctccatgtataggcctctattaaaataataacaataaacattttttgaaccactttatatattttaagatttgtttagggctttttcatttgcacgtgaaaatattcctttttttttttttttttttttagtatttattgatcattcttgggtgtttctcggagagggggatttggcagggtcataggacaatagtggagggaaggtcagtagataaacatgtgaacaaaggtctctggttttcctaggcagaggaggaccctgcggccttcctcagtgttcgtgtccctgggtacttgagattagggagtggtgatgactcttaactagcatgctgccttcaagcatctgtttaacaaagcacatcttgtactgcccttaatccatttaaccctgagtggacacagcacatgtttcagagagcacggggttgggggtaaggtcatagatcaacagcatcccaaggcggaagaatttttcccagtacagaacaaaatggagtctcccatgtccacctccctccacacagacacagtaacaatctgatctctctcctctccccacatttcccccctctattcgacaaaaccgccattgtcatcatggcccgctctcaatgagctgccgggcacacctcccagacggggtggcggcccggcagaggggctcctcacttcccagacggggcggccgggcggaggcgccccccaccgacggggcagctgccgggcggggggtgccccccacctcctggacggggcggctggccgggcgggggctgccccccacctcccagacgggctggctgccgggcggagacgctcctcacttcccagacggggcggctgccgggcggaggggctccttacttctcagacggggcggctgggcagagacgctcctcacctcccagatggggtggcggccgggcagagacgctcctcagttcccagacggggtcgcggccgggtagaggcgctcctcacatcccagacggggcggcggggcagaggcgctccccacatcccagacgatgggcggctgggcagagacgctcctcacttcccagactgggcggccaggcagaggggctcttcacatcccagacaatgggcggccaggcagagacgctcctcacttcccagacggggtggcagccaggcagaggctgcaatctcggcactttaggaggccaaggcaggtggctgggaggtggaggttgtagcgagccaagatcacgccactgcactccagcctgggcaacattgagcactgagtgagcgagactccgtctgcaatcccggcacctcgggaagccgaggcaggcagatcactcgcggttaggagctggagaccagccgatccaacatggcgaaaccccgtctccaaaaaatacaaaaaccagtcaggcgtggcggcgcgcgcctgcaatcccaggcactcggcaggctgaggcaggagaaacaggcaggaaggttgcagcgagcggagatcacggcggtacggtccagcttcggcaacagagggagaccgtggaaagcgggagaaggagagagggagagggagaaggagagggagagggagtggtgtgtttggcgggggtggggggactctttgtgtggaaggtgacagacttgcacgtttgcttacatatactagagttagaactgtgcttgggtaggtactttgagatcattggaataaagatagcatgtgaaaacagaataattatgaaaacgtcttcttttatacagcactttgtactttttaaattgctttcactgctgtcacatcaaacctcttcacacttctgtaggacagataaagcacaattatttctctgttacgcagatggggaaacagacctaggcagggatatagtgacctgcccacaggtctaacagcatttgagtgataattagaactaaagtggaggaatttttatttgagaagttgagcagtgagagtcaaaatcttcttaggagctgtaggtttttgtaccaatggagagatctctttttctgttggatatgattgacaatgttagaagagatattcactggaggaaggccccgcagaaggaatgaggaacagacctctggcctgtattgtgcctccattgtctctggtgtagttgtgcatattgtgagattacagatgggaaagaaagagatcttcaccctcagctcaagagaagaaagtaagggtgctgtaggaacagatgtcacagtaaaagcatgccaatctaagtgtgctcaagggattttatgctagttggccttaggttctggtaagagataaggtggggcatctgccaagagtacataagggatcaggggcttggaaagtgtgaagaaagtttgagatagctgttgtgtgcttaaaattaactaaagatgaataaaaagactggcccctttcattgagagtggggactttgttctctgctgtatccccagcacctagtatacacattgcacatagtaggtactcagtaaatatttgttgaatcaggcagattcctgcctaggtctgtttccccatctgcataacacaaataaggctggctaaccctgtgccatctccgtaatagtcttcatcttctcttcactttcccattcatttctctatattagttgaatacatgaatgaagacaggaataagttcctcactgaagttacaagcctttttaagaacagcaaggtaacatatctcatttatcaaattagtaactgcatttgaaaattcagctctgacacttatggctgggtgacttagagcatgtcctgtaacttctcagagtctcattttactctggtgaaacaaggatcatgtcttttgagtgttgaaatgactgtattaactaaatcactatgtaatcctaagagcaatctttatgcatcccagaatggggtagagaataaagtattggagtgaatgactgtgggatataggctagatacctatgtacatagataatttcatggagcctttttaaaaaattatggtaatatacacataacaaaatttaccatcttggccaggtgctcacgcctgtaatcccagcactttgggaggccgaggcgggcggatcacctgaggtcgggagttcgagaccagcctgaccaacatggagaaaccctgtccctactgaaaatacaaaattagccgggcgtggtggtgcatgcctgtaatcccagctactcaggaggctgagccaggagaatcacttgaacctggctggcagaggttgcggtgagccaagattgcaccattgcactccagcctgggtaacaagagcaaaactccatctcaaaaaaaaaaaaaaaattaccatcttaactatttttaggtgtactgttctgtagcattaagtagattcacattgtgcaaccaatttccagagctcttttttttttttttttttttgagacggagtcttgctctgtcgcccaggctggagtgccgtggtgcaatctcagcctcccaggtgcacgccattctcctgcctcagcctcctgagtagcggggactacaggcgcccgccaccacgcctggctaattttttgtgtttttagtagagacgggatttcaccctgttagctaggatggtctccatctgctggcctcgtgatccacccgccttggcctcccaaagtgctgggattacaggcgtgagccaccgtgcctggcctccagggctgtttacatcatgcaatgctgaaactctatagcaattaaataactctccatttttccttcttccaagcccctggcagccaccattctactttctgtctctatgaagtctgactgctctaggtacctcatgtaagtggaatcatacagtgtttgtctttttatgattggcttattttacttactataatggccttaaggctcatccatgttgtagcatgtgtcacaatttcctttttaaggtggaacaatatactccattgtaaatacacacaccactcatctgttgatgaacacttgggttgcttttgcctcttgtgaataaggctgctatgaatataagtgtacaactatctctttgggaccctgctttcgattcttttgggtaggaacccagaagggcactactggatcatatggtaattctgtgtttaattttgaggaaccacaaactcctgagttcaagtgatcctcacaactcagcctcccatactgtttccaaagtggctgcaccttttcacattcccaccaacagggcaaaaggattccagtttctccacaaccttgccaacacactgcccaggaggcagaggttgcagtgagctgagatcgcgccactgcactccagcctgggtgacagagtgagactccatctgagaaaaaaagaaaaaaaaaaaaaagacctgatttggctatgggggttctgccctcatgaatggatttaggtcattatcacagagtgggttggtctaaaagtgagttgggccctctctgtctcttacgctcctgcctttgcttgcccttctgccatggggtgatacagcaagaaggcctctgccagatgcaggcctcttgaccttggacttcccagcttacggaactataagaaatacatttcttttcctataaattacccagtctgtggtattctgttatggcaacacaaaacagacgaagggattttaatgggatggttggaaactgaatgtggactacctagagtggacaccaccttgttggttgtagcaaagccatgttaaaaggtaagcctattgctacaatgtaagggtaggtaatattttatttacatactgtatcataagtatcaacattataaaggggataagtacactggagcttaatgttgtgttcctgtcttctataaccatttgatcactatgtctattcctaataaatctcacctgttctttaaaaatatcctagtaattctttgggttttgaatctttactctccattataagtatgtatacatctaaattttaaaaatatgcatgcaggcattctgactagatctccaaggcttggccgacctgttaaatgacataactcaagtaaattatcagacatatcagaagtacaaacttgatgggcttggttgagatatagtgatcctcagagtgctgtctggtgacccctgcactctcctctctgacaggagagctcagccttaccctttgctgaagaagtgagttctctttaccccttcttctgcctctgatgtcttctcatctctaaatatggtctgtacccctcacaccacaaataaaagtgttcttacttcagcaaaactatagggaggggctcgtcgccactggaattggttctaacggttgaaactcattcctcattcaggatccttccacaggtccacagtgctttatttgcagctcagggtttcagacctttctgggtatcttttgtaagctcatttggggcaaaacctgacgtggactgccacgagactattcatagtctgtatttttcccatctagtgtgattatttgtatgtttgctgcagaaatatcagtgctggattccttggtacacaccagacctcgccagggatgtatgcacatatgtatgcactgtattacctttctaaaatctgaaaaatactgaattctgaaacagctttgttccaagggctaatgaatctgtgcttctcctgaacttgctacaatttgtaatccccaaataatatagtttgataatcatctcagttttttttctttagagaaaatttggaaaacacagaaaggcacatttatgcaaaaagcattcacctgtaatgctgctacccagggatatctgctgtcaacatcctggcacatttttttcctagtaaaattgggattacattttatatacatcatatcatttggtattctgaatctttgatccaacacagtagtataatcattttccagaccactaatcagtctttgaaaacagtaaaaattttattttatttttttgagacagggtcttactctgtcacccaggctggagtacagtggcgcgatcttggctcactgcaacctctgcctcacaggttcaagtgattctcccacctcagcctccttagtagctgggactacagacgtgtgccacagccagctaatttttgtaatttttgtagagacgaggtttcaccatgttgcccaggctgctctgatactcctggactcaagcgatccacccacctcggtctcccaaagtgctgggattataggcatgagccaccacacctggccaacagtcaaaattttaaaaccggctgggcgcagtggctcacgcctatcattctagcactttgggaggccgaggcaggtggatcacgaggtcaagagattgagaccatcctggccaacatggtgaaaccccatctctactaaaaatacaaaaattagctgggcgtggcggcacatgcctgtagtcccagctactcaggaggctgagggaggagaattgcttgaaccctggaggcggaggttgcagtgagctgagatcgcaccattgcacgccagcctgggcaacagagcaagactccatctcaaaaaaaaaaattttaaaccatatcattattcatgcatttttttttacttgttagcaatatatttaaatactaaaaagggcttaacttttttaaaataaattttttattttatttaaaaattttattttagagacagggtgttactctgtcgcccagggtggagtatagtggcataatcatagctcactgcagcctcaagctcctatgttcaagtgatcttcttgcctcagtctcccaagtagcagggattacaggcacagtccaccatgcccagctttgcttaatgttcttcgcatgattaaagtggggttgtgggtttggaggggaggaagaccacaaagatagtgccattctcatcacatcacatcaagggcatatactgtcaacagaacactcttgttgttgaccttgatcacctggctaaagtgtttgccaggtgtctcactgttttctcctttttgcgtaatatactcaatggaagcaagtcattaagtgtatcccacactgaaggagtagggagttatcttccacctccttgatggtgtagtatcaacataaattatttggtattcttctatttgggagattgtctcttctccccatttgtatatatcactatggacttgtgaatattaattttacattttgggttacaatcccaatggcacttcgattttggtgcttatgtttttccagctttgggcattgggagctctttcagttggcttctgtgtccctttgacataccttaattatttacatgtaaaaaaatgtttagctccatacttcctggcactacaatatgttctaagttcatctagtatatttcttgccccagggacttaacttcaaaagaaccaaggctttattgagatataatttatggctgggcacggtggctcaagcctgtaatcccagcactttgggaggctgaggcaggcggatcacgaggtcaagagttcaagaccagtctggccaacatagtgaaaccccgtctctactgaaaatacaaaaaaaaaattagccgggcatggtggtgtgtgcctgtaatcccagctactcgggaggctgaggcaggagaattgcgtgaacccaggaggcagaggctgcagtgagccaagatcgcgccactgcactccagcctgggtgacagaaagagactctgtctcaaaaaaaaaaaaaagagagagagagataatttacaaacatttcacccgtttaaagtgtacaattcagcgtgtttttttgttttgttttgttttttcttgagatggagtctcactttttcgccaggctggagtgcagtggcgtgatctcagctcaccacagcctcagcctcccgggttcaagcaattctcctgcctcagcctcctgagtagctgggatcacagactcccgccaccacacccagctaattcttgtgtttttagtagagacagggtctcaccatgttggccaggatggtctcgatcttgacctcgtgatctgcccaccttggcctcccagggtagctttttaaaatatatacacagatatgtttaataaccatcaaagtcaatttttagaataatcacctcaacaagaaacccttgactggatacagtggctcacacctgtaatttcagcactttggtaggtataggcaggagtatcacttgagcctaggagtttgagaccagcctgggtaaaatagtgaaaccttgtttctacaaaaaatttaaaagttagccaggaattgtggcatggccctgaggttccagctacttgggagggtgaggcaggagaattgcttgagcctaggtcaaggctatagtaacctgtgaccacgcgactgcactctatcctggccaacaaagcgagaccctgtgtcaaaaaagaaagaaagaaaccaatcctgtatcctttagctatttactctctctctctctctccccttctttttcagtgtaaagtaactaccaatctaatttctatctgtatagatttgcctatctggacattttgtataaatggcatcacatgtgtggcttctttcacttagcatgtttcaaggttcatccatgttgtagcatttatcagtacttcattccatttttatggctgaataatattccattgtgtggatacaccaccttttgcttgtctatcagttgatggagctttggtttgtttccaccttttgattattatgaataatgctgctacgaacatttgtgtacaagtttctatgtggtcatggttttcatttgccaggtcatatggtaattctgtgtttaaccacttgaacataaattgaagtattgatcttttaattatgttttgttagagacagggtctcactctgtcatccaggctgcagtgcagtggtgtgatcacggctcgttgcagccttgaactcctgggctcaagcagtcctcctgcattagcctcccaagtagctgggatcacaggcatgcaccaccatatctggctaatttttaattttttgtagagacagggacttgccatgttgcccacactggtctcaaattcctgggctcaagcagtcctcccatctcagtctctcaaagtgctaggattacaggcatgagccaccatgcctggcctattattgagtttttttgtttgtttgttttgtttttgtttttgagacacactctcactctgttgcccaggctggagtgcagtggtgcgatctcagctcaccgcaacctctgcttcccaggttcaggcgattatcctgcctcagcctcgcgagtagccgtgattacaggcacccaccaccacgcccagctaatttttgtatttttagtagagatgaggtttcaccacgttggccaggctggtctcaaactcctgacttcaggtgatcctcccacttcagcctcacaaagtgctgagattacaggcatgagccaccacacccagctcctgtgattgagttttaaaagttctttatacattctagatacagattccttatcaaatacatgatatgcaaatatttttctctcattctgtgagttgtcttttcattttctttctagtgtcctttgaagcacaaagttgttaaattttggtcaagtccaatttatctatttttttcttttgttgtttatgcctgtcatgtcatatatgtaagaatccattgccagattttcagggtttaccctgaagatttatccctatgtttctttgtagagttttattgttctagctcttacatttaagtgtttgagccattgtatattgtgaagtgtaaggatccagctttattcatttgcacatggctgtctagttgtaccagcatcatttgttgaagggaaaggatagtcttttcctttccccactgagtggtgttggcacccttgtcaaaaatcagttgaccatagatgggtttatttctagattttcatttctgtcccatcaatctatatcttttttctttgtgccagcaccacccttttgattatttaccttgcaataagttttggaatttgagatgatatgggcttaacttttaaatgacttcccaagtaactaagggcttatacaggatttgcttttttagtttagttattatttttatttaaaatcatattctaagttttctgaagttacactagcattttaaaaaattaattattttatttttttgagaccgagtcttgctctgtcgcccgggctggagtgcagtggtgcgatctcagctcactgcaacctccgcctcccgggttcaagcaattctgtctccgcctcccaagtagctggaattacaggcatgaaccaccacggcctggctaatttttgtatttttagtagagacggggtttcacgatgttggccaggctggtcttgaactcctcacctcaggtgatccaccccgcctcagcctcccaaagtgctgggattacaggtgtgagtcaccactcctggccgtactagctagttttatagtgaaagattttattttaatgctgtatttttttttaccagcatctctccaatctcccatgaaagatttttaaaatcaacaaaaacaagccttctgctgtacaacacttactgaaaacatcactttcgttactctatccagtacttttaaattgatatatagtcctaaatttaatttcctgggcactgccccagagtctgtgagacaagtgccatttgttctctccccttcatagtcaggctctctcgggaatggttcgtgctgcttgctctgctttctgtgcccacctcttctgcccacgagagccagactttagccccctacccccactcttgcactctgaactgatggtgtgcacactctatgtacagtctttcttgattttgatctttctggactggttgctttttcctgaaggccttcctcaccaaagattctttttcccctttttttgccattctccctggaaaatcaaaagattttgattttttctggagcacttgatgttataagccatttcctttttaaaaagttacatctactactttgctgagacacctctggttttcccaagtctttgactctttgttcttagttcttgggccctctgtgtcccatacacactctctggatgatctcatccaaattcctaggggctgatcactcttctgtcctaaaaataaaacaaagccaaaacttctgcttccctttgaagcactaccatccttctttcctccagagccctgcccactgttttactttctccctcccacttcaggctaaagctcactttgctctgccagacctgttctcagcaaggattcttttgtttttttaaacctacgtaatgattatcccatactattgtgtcctattttttcctttttctatgtatctgactccaacatgtaacatcaacataatgttaaattttattaaaaacaggttatttatataactgttgcccccatttgttgggcatttatattgcttcattttttcagtttttaaaaatttttaaattttttattttattttcaagagacagggtctcactatgttgccaaggctggtctcgaactcctggactcaagcgatcctcccaccttggcctcccagagtgctgggattgcaggcgtgagctaccacacctggccctcattttagttttaatttatttttaactttttagagacagcctcactttgttgcccaggctagagtgcaatggcatgatcatggctcactgcagcctcgatctcctgggctcaggtgattctaccacctcagccccccaagtggctgggaccacaggcgcacaccatcaccccagataatttttttttttgagacggagtctcgctctgtcgtccaggcaggagtgcagtggcgcgatctcggcgcactgcaacctcttgcctcctggattcaagcgattctcctgcctcagcctcctgagtagctgggattacggacgcgtgccaccacacccggctacagataatttttttgtattttttgtagacactgggtttctccatattgcccagggctgatctcgaacttctgggctcaagggatccacagcgtcagcttcccaaagtgctgggattacaggcatgagccaccacgtccacccctacattttttttctccccccagatgtatacttttaagttctgtttttgtttttgtttgtttgtttgtttgagtctcactctgtcgcccaggctggagtgtggtggcacaatcttggctcactgcaacctccgcctcctgggttcaagtgattatcctgcctcagcctcccaggtagctgggactacaggcatgtaccaccacacctggctaatttttgtatttttagtagagactgggtttttctgtgttggccagcctggtctcgaactcctgacctcaagtgatctgcctgcctcagcctcccaaagtgctgggattacaggtacaaattgctacacccggcctgtatacttttaaattctttagtgtagggcctctgtcttgagtgcttatcagcttttcgctggtgaagtgggttggccaggataaaaagtatcatcaagatgccatttctctcttcttccccatcccaactcccagagctgatctgtctccctgctccaggctttcatgccctgttttgattactgtcagctttccagagtgaagggatctctcttttaagtgttagctcctgaaataatgatctgagaaaagggatttttgtttgaagggaccatgctttttttttttttttttttggacataatttacctaccagagaaaagaaaaacttcacctttaaaaagaatataatttagttgttttcagtatatattcacaaagttttggaaccaccaccactgtctaatcccagaacattttattacctcaaaaagcaaccccattcccatgagcagtcactctccatttcttccctcccccagcgtgtagcagccagcctctgtgtcctttaacaatgtagaaccagccctacttgactctgagtgtgcaggtattcttttgcactcttgtttgcttacatttctgcatgcattttactattttgtatcaggatttatttatttatgtattactgtttggcattgatttcataacatcaatttcgagagtaatcattgttgatttttatttttttggctgggtccgggtatgtgtcttctcattctcttcctgcatcctagatctttctttttacttcttcctgctatttatttctttagttagttttagagacagggtctctgttgcacaggctagactgcagtgatcatagctgggtgattctgggtcccttcctccctcagttcagcctctcgagtagctgggactacaggcaggagccatcacacccagctaatttttaaaatgtttcgtgttgatggagactgctttctgtgttgcccaggctggtctgaaactggtaggggcaagccatccatctgcgtcagcttccccaaatgctgggattacaggtgcgagccatcatgcctgacttcttgtgggtttttgattctgtgaagccatctccttttctcttgagccttgatggtttgtacttaacactctcagctccttcctgggctgccctttaaaatttgcttgctgtgttccttgcagttgagtcttatctttgttctttgtttataatgtgtttattttcttgggttttgaaggcagcattctgtaccatttctcagcttagctcttcccagagttctgttgtgtaggattttctgggcacattcttgtataatggaaagaacatagaattcagaagaatgaataagggttaatcctagctctgtttttgggtgactggctaagtcacctcgactctatggtaggacttttaactattttaaagtcctatgtagttatcatgttctaaaaattagcatgcagatagatagatagatagatagatagatagatagatagatagagttttttgttttttgtttttgttgttgttttgttttgagacagagtctcgctctgtcgcccaggctggagtgcagtagcgcgatcttggctcactgcagcctctgcctccctggttcaagtgattctcctgcctcagcctcccaagtaactgggattaaaggcatgcagcaccatgcctggctaattttgtatttttagtagaggtggggttttgccatgttggtcaggcgggtctcgaactcctgacctcaggtgatccacccgcctcggcctcccaaagtgctgggattacaggtgtgagccaccgcacccagcttcataatttttatgcctaatgaaatataaggaaaactgggcaggcctggtggctcacgcctgtaatcccagcattttgggaggccaaagcaggtggatcacctgaggacaggggttcgagaccagcctgaccactctgtcgctactgaaaaatataaaaattagctgagtgtggtggcgggcacctgtaatcccagctactcaggaggctgaggggggaaaatcacttgaacccgggaggcagaggttgcagttagccaagattgcaccactgcactctagccaaggcgagattctgtctccaaaaaaaaaaaggaaaagaaatataaggaaaactaatgcagagtttacagttatcaacaaaaagaataagaatgataatgattattaaatttaattatttaagggccaggtgcggtggctcacacctgtaatcccagcactttgggtggccaaggcaggcagatcacttgaggcgaggagttccagaccagcctgcccaacatggtgaaaccctgtctctactaaaaatacaaaaaaattgcggggtgcctgtaatcccagctacttgggtggctgagacaggagaattgcttgaacctgggaggcggaggttgcagtgacccgaggttgcgccactgcattccagcctgggtgacagagcaggactccatctcaaaaaaaaaggtaattatttaaaattatattaaaataatgaaaaaagtgagattggagatgaaagtgataaaaatctagatggcagtgacactgtttgtattgaatttatgaaacaagttcacgtacctgttcatccaagtaaccttatatgtgagataagtattctttacattttacagaggaagatactgaggttcagtgaggttaagataattgcccgaggttacaagcacagagctgtgatacaatacaagaacttgaattcaggtttcaggacttccaagaccaaggctttgtatcttgacccaaaataaaagttgaatagtttgaaggttatttcttcaaatatactctatcacttaagtaggttttcgggagtgagcgaagacggcacaagtttgaacattcgtcctggagatcatctgttactctgaatgtatcgtgggttagtgttgtgggcatggctgctatctgggggcaggttgaaaagctgccacattgccactgtcatcctacggaatactagttaagcagaattatgagttcttgtgaaattactcaaattttttatttctcaagttacagtggaaatcttatttctgaaatttcttttcttttcttcccatattgtctcctcatttgcactcttgagcagtaaatacatctgttccaaacacaagcaaagacctagacagagaaataactgccagagtcagtggcagtgttgcagcttttcaacctgcccccagataacagccacgcccacaacactcacccactgcatattcagagtaacagatgatctgcaggacgactgctgaaactcctgctgccttcactcactccagaaaacctactgaagacctgaggaatggaggactagattgaagaattgggaagtcactgagaaccaaggcagtgcctctgtcattctctgtggagcagcaggccttgtttctgcagtccagatctgtctactacttggctcctctctgcagaatgaagtctgggtgcatgtggcccatcccagcattcccagttatgcaaccagatactcttctgccagccagcctggccccttggagtctctgtgctccagctccaggctgtctgagaagaggagctagttggcccagctctaccttagaatggattcttgtctgggctgggtagtacctcatcagctgtggccaggagcaatactctcaacagcacagacaaaaggggacagatccctattgggtaaaggtgatgtgggctggggtaagtaccctgagaggtgtctgtcacagaaaactgcctgagagaactttgtcaaagttctgggctccactctccaggggttttgttcagtcaataggtataaaatagaaactaagtgtccacgtgtttaaaaagctccctggatgagtctgatgcctctgcagatttagaaatcactttactctaatacgtgtaaataaattaatatgtatttgtgtttgcatgaggaaataatggaaagataagcaactaataaaaatgggtaatgggtggagattgatgaggctgttgaggatgagggagcaggttctttcacacacacacacacacacacacacacacacacattttaaccaacttaaaaatttaaagaaacacttcagcttaacaattagaaatcagattcaaaacaatgattttaaaattgaagatactgaggtccagaaggtgcactgtatctgggaccaggtttctcatctgtgaagtaattccagtttttggtatcagtcacttaaatgtaatttattttttctcatcagcataatcccatagaagttcatactggtaggcaggagaagaagggaatagatcccaaagggaattggaagaatttgggttctattgctttgtctttgttctgtagagaaggtacttccacagtagacccaaaaccatgagatatgggcccaggacaaagtgagctgagaagaaaagggttgatgcagtgactctccatcttagttgaactttagaatcacctggggtcctttacaaaataaaatcccaattcatacacacatatacacacagtctaggacagttattcttagggttttttttgttgtttcgagacagggtcttcctcaaactcctgggctaaagcagtcctcctgccttagcctcccaaatagctgggattacaggtgtgagccactgcatttggctcgtctgatttttttgtttttgtttgtttgtttgtttgcttgagatggagttttgcccctgttgcccatgctggagtgcagtggcgcaatcttggctcactgcaacctctgtctcccaggttcaagcgattctcctgcctcagcctcccaaataactgggattacaggcgcttgccatcgtgcccagctagttttttgtatttttaatagagatggggtttcatcatgttggccaggctggtctcctgacctcaggtgatccatccgcctcagcctcccaaagcactgggattacaggcgtgagccgctgcacctggacttgtctgagttttttcatgattagaatgagattatgcatttttaagtgtgttgtgctcttctcagcacatcatatctgagaattcatgatgttgctgtgtcttagatgttaatcatttggttaaggtggtggtatctgcctgtttatccttttacgactattatcgtagacatcttaggggatgtactctgagactgtgatcaattttactcactgattttagcatccatccatgggtcttgtctgaaacttattattgtggtttttgcctaattctgatttttttccccaatttccttcattccttctgtattaattggagtgcatctgtaaggaagaactatcctccctctcatttattcacttatttatataggtgtggatgcatggatatgtgttttattctatggatttagtctaatactgtgatttattttgttgctcagattgttacaatttcaactttagtttgctctttcaggttggcctctaggccctttcaatatgcttttgtattttttttttttttttttgaaatggagtttcgctcttgttgcccaggctggagtgcaatggtgcaatcttggctcactggaacctccacctcccgggttcaagtgattcttgaacctcagcctcctgagtagctaggattacagatgcccgccaccacgcctggctaatttttttatttagtaaaggaatttatttagtaaaagaggagtttcaccatgttggccaggctgttctcaaactcctgacctcaaatgatccacccacctcggcctcccaaagtgggattacagcctggctgtcaatatgcttttaagtgtgctcattgctactgggtgtcactgcttctaagtcttctcagcagacagaactaggaaaataggcttatgtatactcagctacatattacacatgtatctatgtttatttctgtgtatgtctgtgtatatgttagaaattatgagttcatactgatatctcattctaatccaacactgtgtggtttattttagccttccctcttatttgtaattattttgccaacctggctgtcattatccttcatttttttaaacttactttttcagtcagtaccactgtctacatgaattagtgtcagaattgctaactcacatctttgtgagaaacaaatttacttactaggtagcagcatttgtgttacagttctttatgcctttagctttacaatatccagtcaaaataggttttcaaagtttcttcctcatgcccttcagtgtggttatgttattcctttgtaacgcagttagattcacttgttactgtttgtattctgggttctttaatttttttggtatgcgctacattactctggttttgagtcatctatacacaaagatatactcagagaaatatcactccttccttatccctaccatccattcccatttcgttttatccctttcccacctatcccctgtaggtagctgatctctttagtttctggtttatccttcctgtatttcttttgtacaaataagcagatatatgtatatgttcttattgcccatttcttatatgaaggatagcatagtctaaatcttgtactttggttttttcacttaacaatatatcttggaattcattctgtgtctgttcttagacatcttagaatgattttcattcatttttactgctgcatagtactccatgtggatataacatagtgtcttcagtctcctccaatgtgtgggcatttagattgtttccagtattttgcaattacaaatagtgctactgtggataatcttgtacatatgttttttcatatcattggaggtgtaccttcagagtagattcttagaagtaggattgctgggttaaaagatgtacacatatataattttgttaggtattgcccagttcccctccagaagagttgtacagtttgcattcccaccagccatatatgaaaactacctgcatatgttttaaaacacatacagatgaatgattatcagttttgtttagggtcttcctttccttctgcaattcctcttctatcatgacaggttgcaaaagaaactaactgcaactttttcatgaaaagaagtaaaattagttttccagagctgactgaagattttcttactggcattttaaagttataattatgtattacatttttccactttacctagtttagcatctgttatgtaacatctcaccacctgcttagttgtgcaggcagttcttttcagtttagataataatactggatactgcaagtttaaacattttccccatcttagtcattttccagatttctgagacaggtgtttaatatttccaaaagtgaggcagttcagaaaatatttgcatttcttcactcttacatttcagtgacggaggtggtcatctgagcctctcttcctttgacttgactcgttggggtacagcttacaaaagcatgccagggtcaccatgacaaagtagatcatcctcttttctagaccatggctccctatcctgccctctctccctgacgacccctggcttgagaccctcacctttgtgttttcccggtgtgctggtcctctctggcctcgctctggattctgtctgctgacctccccactctgaccagattctcagttctcctgatctctccactcccactctataggaaccctactgtttattttgtctgatcttgctcagactgctgatacatactggagaaagtcacttaattgtcatgattggcagcactaaacatctctggattctttctgctgagtcttcaatgttttcttttaacttgtccccgttcgggtccctttctcaccttccctgtgcctggtttgccttcacatcttctgccttccagcctgctctcccatactcccacacctcatttacagcacatactcaccttatttcaggaaagacaggttttgacttatcctgaggaaatagatctaaatagccagaaccttccaaatggataggctactttgggaagcagtacattttctatatcatgatcattatgattatttttcttgtccttactgcctgccttcttcagcttcttttcagttgacctgtctgaatctggctcaatgatgaacctgaacttggttgatcaccacaagagcctgtggccaaggactgttggcctatataaagtgtcatggttcagaacatgggttttgggggtcagcacacctggatttgaatctcagttctgttaactactaggtatgtaatcatggacacgttagttgaccctccactctgcctcagtttcttcatctataaagtaggggttatgtttcatagggttgtggtgaagataatatataaggatttttcttaagttcttagcactgtgctagtgactatgatcattatgattaaatgtagtccttccttattttctcactctacctcaggggtcacttaatgctcttggtttgtgttgatactacttctagctgttgtcataactcactgccagctagcctcacccagaccattgtaaagttcttttccagtgaaagtgggaggaaataaatgaggagaaaggaaatgtagggaaatgatcaagaagtggatactccatctatttcatcagggtctccctttctttctcatggcaagttcagaacacttctaagcagtaactgctttgcattagatagtatctgttaccaagtctcactttgggctaccctagcatgctttaagtaaaacagagctgcttggttatggatttttaagatgatggatagtcgcagtactaaatcctggtagtatatcttagatcaagtaaaatagacatttttcccattcatgaagagagaaatgtttttcatactttaataatttgggtaccacagttcaccaaaaatttgtggaaacttttctgaatataagtcactacaagtcttcatctatgtcagtgtctgcgcatacacctgtataactgagtgtgtctctttatccatattttttattttgtgctgcttatgtttggatgtagcctgaacatgaaataatggaatcttctttttgtaacttggccagcattatcaaagcatatatgtagggcatagctgagttaggactaaaactcagacctcctgatttgaagcccagtgttcttttctgatgttacttcctttttagggtatcacatgataaatgtaatgaataataataagtaaaataattttttttttttttgagacggagtctcgctctgtcgcccaggctggagttcagtagcgtaatctcagctcactgcaacctccacctcccgggttcatgccattctcctgcctcagcctcccaaatagctgggaccacaggcgcctgccaccatgcccagctaattttttgtatttttagtagagacggggcttcaccgtgtcagccaggatggtctcgatctcctgacctcgtgatcctcctgcctcggcctcctaaagtgctggtattacaggcgtgagccaccgcgcccggccaagtaaaataatttttaaaagaccatacaacttttttttgaaggcctactatcttttaggctgcatctgctttttctaatcttcacaatccccgggctttcctcattttctagccaagcaagtgattactcagagatactaagtaattcagccagtgtctctcagctagtgagggataggaccagaattgaaaccttttctgggtcttttagtctgttttattactgaagaaattgacaaatgcatatgtaaccaacaaaacttgttcaagctctgggctctccagagcaccttttctagagaagttgcatacttgttaatgactagattttaagccatggtacctatagtacattggaacattggctcttaaaataataaaaaattatgaataaatgctaagcatttgctattactggttttattgcttaaataaccttaggctagcttttaatagttcacttaatggtttgcagcatctgaaaaaaaaaaacctttgcactgtttttcttggttagtgaattgtcagagaaccaagctaaagtaaggaatacattttcttttaaagcaatcattagtattatctacctatttatttttggaacatgagtttggctcagtctaacttacttagcatctgaagacaagataatttttatctgtgaaacagagtgctgtagtttcgtgttcagataattaaagttcaccaaaatgggtggcttagagaacagcttaatagctttccctaaaaataacccattcacagttgttaggtagcattttagttgctacagtatatggtgcttgtgcatgataataacgtttgtctaaataaggtggatatattatccacaaatattgagcctctgctatgagacatgactataatgacaggggatgaagaggatgggaagaaaacctaaaaatattagaaattttatgtcaaagcctttgaaatgattgtggaaggctgggcatttattctaatgatactgtcattacttaaaacctgtttggaacatttcccttggaatttccttgaatatgagcttatgaaccatgaaagagaatcaaccccttaattttgtagcacagctaaatttttaaaaaatcaccttttgagatataatttatatgcaataaaatgtatctttttatgtgtactgttcagtgaaatcttgacaaatgtatgtagttgtgtaactgccaccacaataaagatacagaatatttacatcacttcaaaaagctttcttgggtacctttgcagtcagtttgtgcctcaggcaagcacggctttctttccttttgtttttgagacagagtccagctctgtcacccaggctggagtgcaatggcgcgatctcggctcattgcaacctcctgtctctcaggttcaaccgattctcctgcctcagcctcctgactagctgggattacaggtgcacaccaccacgcccagctaatttttgtatttttactagagatggggtttcaccttgttggccaagctggtctcaaactcctgacctcgtcatccacccacctcagcctcccaaagtcataggattacaggtgtgagccactgcacccagccacggcttcctatcactatagattagcttcagcttttctagaatctcatataaatgggatttaaaagtttgttctctttgtgtttggcttctttcatttagcatagtgtttttcagatttgtccttgttgcatggattagtagtaattccttttattgctgagtactgtcctgttgtatggatgtaccacagtttgtttaccctttgcttgttaattaacatttgggtcgtacacagtttagggctgttaggaataaagctcctacagacatctgtatatgagagtttcaactttgctgcatcctcaccaacacttggtattggtcagttattttagctattctaatgggtatttggttttaatttacatttcctttatgactcatcagtcatattttcatatttgttgtcacaaaggaagtgtttattcttttgcctatttgtaatattgggttgtttgtagtcttgttttgaagttttaagagttctttatgtatgctaaatacaagtcctacatattgcaaattttttctcctctctgcacaattcatttttgaccttgatgatcttatctggcctgctctgctcaccatctcattcgtggatcccactcagcagcctttccctttcagtcttggctgtctctttccatttccactgtcactgctcttacgcattccaaggactttactactcccttcagagatgtggtgggtgttttttttttttttttaaattattattttactgacttgagagtgctgctggattgatagtgaccttgggtctgggttgctagatgtcctgcagtgggtggtatggtttcacactgaacactgaactgacctgcttaacatgccaattacatccttgttgcttagtccacgccactgtcagtcacctcttgctggtattatggcagtgcttggaacggtttcctttttttttttttttaactttttcctttttttatttttattttctttttttaaaatagagacaggatctcactatgttacccaacctgatctcgaacttctgggttcaagcagtccacctgccttggcctcctaaagcactgggattacaggcatgagccactgcccccagccactttttcctttttacagttcagtttttctcttatttggtaagatcatttacaaaatataagttggatacttttattccccagtttaaagtgaaaggacacttaaaagataaatccttagcataactgctgggtcactgcgcatttcttctgcctcatcgtgagccacgctctctctggtacactgtagccacagtggtcttcttagggcttctggtctacttctggtctacttctggtctaccctctccctgcttgtagaatacttgctgcctttgccacccagcaacctggctaattccggcttatccttcagttctctgtttaaatgccttccctaatttctttagagaagaagagtcttccgtaagcttctaatttaaactaagttttctagttatccttaataacattaattatataacttgcattttccttagcaattatcataatttataatgtagtcatgtttatgacaaatatgtttattaatacctatgtctctctctcttattttttttttgtgatggagtctccctctgtcacccaggctggagtgcagtggcgcgatctcagctcactgcaacctctgcctcccgggttcaagcgattctcctgtctcagcctcccgagtagctgggactacagatggcacggcaccacgcccaactaatttttgtattttcagtagagatggagtttcaccatattgatcaggcaggtctcaaactcctgacctcaggtgatccacccgccgcagcctcccaaagtgctgggattacaggcatgagccactgcacccagcctctatgtctatctcctctcatagtttatgagggcagagagctttatatttttactgctttatccacagtgcttaacataatgtaggtgattatttgataaataaaattaactttaacattcaaatgtttttaaagttatttgatgcacatcctttacgatcccaaactgacgttttttttctcttgaatacaaacttctgtactagtttcctgtctctgccatttccactgaatctataaattgcccttataacaagagttctcatcttttttttttttttttaatgacgtgaatcctttaggcagttggtgaaacttgtggctccttttcagattaatattttaaatgaataaaataaaatgtgagattacaaagggaatcagttatgctgaaataccacttttgaaaaattaagaagtctttatatgtgcttctttactaatgccgtaaatagcaagatcaggcagcaggtctaacaagcactgtaatttcaaagtgttgatgggtatagatatttcaagaattataactggtctccctatgtctagttttagcctctttagtcagttttttttttctttttttttcctttttgaaatggagttttgctctgtcgcccaggctggagtgcagtggcacgatctcggttcactgcaccctccacctcctgggttcaagcagttcttctgcctcagcctcccaggtagctagaattacaggagcctgccactacgtgcctggctaatttttgtatttttggtagagacagggtttcaccatgttggtcatgctggtcttaaactcctgactccaggtgatccacctgccttagcctcccaaagtgcttgggattacaggcgtgagccaccacgcctggccttcagtcagttctatacctgtgtttctgattcccttcccctcccctcccctcccctgccttccctgagacagagtctcactctgtcacccaggctggagtgcaatggcatgatcttggctcactgcagccaccgccttctgggttcaagtgatgctcctgcctcagcctcccaagtagctgggattacaggcacgcacaaccatgcctaatttttgtgtttttagtagatacagggtttcaccatgttggccaggctggtcttgaactcctgacctcaggtggtccacctgcctcagcctcccaaagtgctgggattacaggcatgagccaccacatccagactcttcatcttctgttattgaagtaaagtacagatttctcagctttttagtaacatcaccttttgttcttcccctggacaggtgtaaactccagccatattgaactatccagcacctggtacccagccttccgtgcttcagcttctgtagctccttcttccttaagtgctttttcgtgtgctgcctattaaaatcctacctgcttttcaaggcaccattaaataccaccttcttagagagaggtccacagatactaacatagagcagagcctgacagataataaacactcaataaattgtaggtattattaagtgagaattgttcataacttcttttcaataccatcattacctggttcccaataaatgaactgtaaatattttgagtaatatacatctataaactaagacaaagcagtattatcagtaagtgtaagcaagtttaaagtgaatgcgtaaatgattaatgtgtagaatttatttttaatctcagtttaaatgtttgtcagttttaatcagagcatagtgagaaaatgatttcatgggcagacatggacatttcttattcttcatacttaatcacaaaccccaccaatctataataagattgatttcgagtactgtcagtctttttttgtgaaacagaatcctcaagctcctaagaattctgttttttggccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccactgcactccaaccttgggagacacagcgagactccgtctcaaaaaaaaaaaaaaaaaagaattctgttttttaatacctttaatgtacttaaattgctaatgagtgtatatgtctgcctcatataaaatacaccaaaaacggaagtcttcacataggaagaaacaagactttaaagtactgtgtattgcattaaccatattaacatttgttgcttttcacacggtagtaaatatggtgttgaaaggaggagacgggcgggcgcagtggctcatgcctgtaatcccagcactttgggaggctgaggcgggcgaatcacaaggtcaggagttcaagaccagcctgacgaacatggtgaaaccccgtctctactaaaaatacaaaaattagccgggcatggtggcacacgcctgctactcaggaggctgaggcaggagggtcgcttgaacctgggaggcggaggtcgcagtgagccaagatggcgccactgtactccagcctggacaagaaagcgagactctgtctccaaaaaaaaaaagtggtagccgtattggaagtggtatagctgtgaggatcagattggttcattgctttctgaccttctgtgggcattggagaacaatagtaatgccaagtgccctatttacagggtcagggccacggacagacctaagtatttctacaagaaagcaagtaccttcaggatgtgggggtgggggggttatgagaaatgatagaacaaataaacatcagtgaaaggaactgtaccttaccacaaaaggaaagctttcaaatgaataaagtattaagaataaagaataggctgggcacagtggctcatgcctgtaatcccagcactttgggaggccgaggtgggtggatcacatgaggtctggagtttgagaccagcctggccaacatggtgaaactctgtctctacttaaaaaaaaaaaaaaaaaaattagctgggcttggtggcttgtgcctgtaggttgtcccagctacttgggaggctgaggcaggagaatcacttgaacccgggatggggagattgcagtgagccgagatcacgccagtgcactccaacctggatgacagagcaagattctgtctttaaaaaaaaaaaaaaagaaaagaaaaagacatttgaaatatccttgggtcacttgagcctggggcccactggtatttcatgtatcttggggctaggacaggtggaagctgagttgtcaagaccaaagtacttctggctaacagcctgttccttatggcatttgtggccacctgtaggatttttgttgtcatatcttcattgagaggcatcagataaggatactgtttttttcccgccctgcaaatttggttacaactgcagtaaagaagacatgagctatttagaacatacagttgtgtccttgaggaatttcatctaattggatggagactgcttgaacaggaccctgctgggacatgtgaggtttgtgaaataagcacccatttcttgtgagcctgctctttgcccatttatccagagctgtggctccccttcattctgagttggctgaaagggctccttgcctccgggtgacccagtgcaccatcctccccattccattctttcaacaaactgctacctgaggaaaagttataaaaatataaatgttgccatgcttaaagtctgtgcttagcatcctttggtggcttcccaggataaaattacgaaaatataaatatggcctggctcttgctcaccctccagcttcccctgtcatgtccctgtgtgtccgcctctctgcaggcactctgttgccccaggttcccacaggcctctgcaccactgccccacatctcctctgcctggaatttactctcccttctcttccccctggttagccattggagccttctctttcaccctacccggtcctgcagccttcagcctcccctcccccagcccccgaccatggctttcataacatcctgtgcctctcagtttttcacctggatttaagtttttttcgttatccttgccttatgatcactctttaaaaagtagtcggctgtactctttctgctcctctccccatcctctccatttccttacttgaaccaaagttaccacacatcgtctggttgcatgcagattcagtgaatgctttccagttcttacttttctcagtctctcctgtttgaaatgccttccttctttgtcttgggaaacaccacccttttctggttctgctacatggttaagcagaactacatggcctctggagttggacaacaaaggttcttttttttttgagactagtctcactctttcacccaggctggagtgcagtggcacaattttggctcactgcaagctctgcctcctgggttcaccccattctcctgcctcagcctcccaagtagcgccagccaccatgcccggctaattttttttgtatttttagtagagacagagtttcaccgtgttagccaggatggtctcgatctcctgacctcatgatccacccgcctcggcctcccagagtgctgggattacaggcatgagccacggcgcctggcctaaaggttcttactccattatcatttctttccactttctttaactgattcctcatcctcatgctgctcctgagttctgtcttccgacttcttttcttgaaattctctctctgcaggagtgctaatcactgtggcttctgttaagaattcccaacttgatctctctcctgatgctgctggaaggatggaaccgtcatctcctccatctgaatcactgacaggcattcttagatttttaaatcaggatgctgaaaactatctttgtcccttacctccaccttctttttgtacctcccagacccaggcccacctctcacgtttataaggtctaggtcaagaatacaaatggagccctacataccattaaaaaaaaaaaaaatcaacctaagaaacattaagcagactttgctctctcctcctgccatgacagatatgccttcttttccttttttttttttttgagatagggtctcactttgtcacccaggctggagtgcagtggcacaatcatggctcactgcagcctcaacctccctggctcaagtgatcctcttgcctagtcccccaaatagctgggactacaggcgagtgccaccatgcccagctaatttttgtattttttgtagagacagggtttcatcatgttgtccacactgatctcgaacacctggattcaagtgatctgccctcctcaccctcccaaagtgctgggattacaagcgtgcatcaccatgcccacaccaggcctaatataccttcttaatgacctggaaggttgggttcaaatagaaaatactcaggctccttagagttctatgtcagtagttccggcagagcagaccttcagcatagtgctcttcccttcccagccacagcactatccatgtgttgtgagcttgagcacgtgtgtggcctcctgcctgcacaatgtaggtgcaatacacgccagcaagcagctgcccctttgaccaccacctcaagtgcacctgctgggtacagacctacacttttccagatgcagggaattcccgggcacctgaggagcattttccccgaccccaataaccttctctcatgggcatgggcatgtctgggtgagggttagtggccagtgaccacagatgtctcagtctcttacctcgcctcctgtttcctctttcttttctttgcggtcttgcttttctgtcagaagcctactcatccttcaggataaggcttttgcgggcctcatcttcttttaatccttcccttagtatttgaagttaacccagctcctccttgggtttcagaagtgctttaatgtgataaaaggcaaagtatgttctctgttcctgtctccttctctcacaaaattgcaagtttcttaagagcaggatcattatttgtttttgccaccagtcctaacatgaagcctcacaaatgggaagttcttgacaagcgtggcttgaattcaccagaactctgtcttcatttcgtgttgttgtggtaaccctatcaaaacaggaaataaagctagtttagcatgacttgttcataattgactcatgctggttccctttccttccctaagcaatcataaaacatctgttaaataatctacttcagaatttcatggacttctacgtttattgatcggtacacttctagaatctgtatcccaattgccccagcactggaatgaatcatgtggccaaagaaccctggttctttttttttttttttaactgctttactaagaagtaattgatatacaaaatattgcacacatttaaagtataaagttggataagttttaatacattatacacctatgaaaccatcaacacaattaggataaggaacatactcattgcctccaaaagttacctcatttccatttgcaatcttcttcctcccattcccaggcaatcctgggggtaaatccaaagtaaacccaggattactttgtattttctatagatggaaatacatttcttttggtctggcttcactcaccataattacttgagattcatctgtgctgcatatatcaatagttcatttcctgttattatcaaataggaatctcatttccttttattatcaaatagcaggaatctatctgttttgagacttgagatgggtgtgctcacttcagaccttaatgtcctcccattctccataatttatgggtcttaggatagaattcatctgggacttgaggttgtgttcatttaagatgactagacactctcaatatcttgggttcctcaagggaagagtattattattattattattatttttttttttttttgagatggagtctagctctgtcgcccaggctggagaacagtggtgcagtctcggctcactgcagcctccgcctcccgggttcaactgattttcctgcctcagcctcccaagtagctgggactacaggcgcatgccaccatgcccagctaattttttttttatctttagtagagatggggtttcgccatgttggccaggctggtctcaaactcctgacctcatgatccgcctgccttggcctcccaaaatgctgggagtacagatgtgaaaaccacccccagcccagagtattatttataatttttgcgtcctaatgttagaatagttcttgatatatagaaggtactaacccaaagctggataaaagtttccccctttattggccaggtgtggtggttcacgcctataatcctagtactttgggaggctaaggcaagaggatcacttgagttcaggagttcgagatcagcctgggcaacattgtagaaccctgtctctacaaaaaaactttttaaaattagccaggtgtggtggtgctcacctgtggtccccactatgctacttgagaggttggggctgcagtcagccataattgtgccagtacactctagcatgggtgacagagtagcccatctcaaaagaaataaaagggccaggtgcagtggctcacgcctgtaatcccagcactttgggaggccgaggccgaggatcatgaggtcaggagatcgagaccatcctagccaacatggtgaaaccctatctctactaaaatacaaaaaattagctgtgcgtggtgacgggcaccagtagtcccagctactcaggaggctgaggcaggagaatcgcttgaacccaggaggcggaggttgcagtgagcccagatggcaccactgcactccaacctgggcaacagagcgagactccatcaaaaaaaaattaatacttaatttttttccctctttaacatgtttctttcccccttaaaaaaattttttttaagctaggtgccatggcatgtgcgtatagtcccaactactctgaagcctgaggaagtgatctcaggagttcaggaccggcctgggcagcatagtgagacttcattctctctctctctctctctctctctctctctctctctctctctctctctctctctctctgtctctctcgctttttttccccctgagatggagtcttgcagtgtcgcccagagctggagtacagtggcgtgatctcagctcactcaacctttgcttcccggattcaagcaattctcctgcctcagcctcctgagtagctgggattacaggcgcgtgccaccacgccctgctaattcttgtatttttagtagagacagtgtttcaccatgttagccaggctggtctcgatctcctgacctcgtgatccacccacctcagcttcccagagtgctgggattacaggcgtgagccaccgtgcccagccgagacttcatctctttacaaagtaaaattgttttggttaattatatgttttggtaaaaagcatacaatttgccatcttaatcatttttaagtacacagttcagtagagttaagtatattcacattgttgcacaatagatctagaactttttcatcttggaaaattgaaaacctgtactcttgaacacatctccccatttctccctctcctcagccatttttaaccaccattctcctttctgattctatgagtttgttaattttggatacctcatataagtgaaattatgcagtatttgtcttttgtgacttatttctgttgatataatgtcctcaagcttcatccatgttatagcatgtgatagaatgacctttttggtttttcccccacctttattggggcataattgacaaataaaagttgtatatatttactgtgttaaatgtgatgttttgatatgtgtataccttgcgaaatgatccccacagtaaagctaattaagatacccatcaactcacatagttaacgtttgtgtgtggtgggggcaagaacatttttttttttcttctttggagacagtttcactcttgttgtccaggctggagtgcagtggtgccatcttggctcactgcaacctccgcctcttgggttcaagtgattctcctgactcagcctcccaagaaactgggactacagacgcgtaccaccacgcctggctaactttggtatttttagtagagacagggtttcaccatgttggccaggctggtgtcaaactcctgacctcaggtgatccgcctgccttggcctcccaaagtgctgggattacagacgtgagccaccgtaggtggctgataatagccattctaatagctgtgaggtgatatctcattgtggttttgattggcatttttctgattagtgatgttgagccttttttcatatacctgttggccatttgtatgtcttactttgagtaatgtctattcgggttctttgcccccactccctaccacccgcacctgcttttttccatttttgagacagggtctctctatgttgcccaggctggtcttgaactcctggtctcaagcagtctgcctacctcagccccctgaatagctaggactacaagcaggtgccactgcacctggcctttgcccatttttaaatattttgtttgtttcctgctgttgaattgtgtgaatttcttatatatttaaatattagccccttatcagatatgtggtttgtaaatattttctcccattcattgggttgtctcttcactctgttgattgttgcttgtgctgtgcagaagctttttagtttgattcaattccatttgtctgtttttgcttttgttgcctgtgctttgggagtcacaaccaaaaaataattgcccagaccaatgtcaagaagctttccccctgtattttcttctagtagtttttgtttgtttgtctgttgtttatttgtttgcttttgcttttttttttttttttttttttgagacggaatctctctctgtcatccaggctggagtgcagtggcacgatctcagctcactgcaagctctgcctcccaggttcacgccattctcctgcctcagcctcccgagtagctaggactacaggcgcctaccaccacgcccggctaattttttttttttttttttttgtatttttagtagagacagggtttcaccgtattagccaggatggtctcgatctcctgacctcgtgatccacccgccttggcctcccaaagtgctgggattacagggtgagccattgcgcccagccttttctagtttttataatttcaggttttacaatttttgtctttaatctgtcttgatttgatttttgtatagggtgtgaaataagtatccattttattctttagcaagtagatatccaattttcccagcaccatttattgaagagactatcctttatgtttggactctttattctgttccatttgtctatttgtctgtttttatgccagtaccatgctgattccctgccccccacccagctttattaaggtataattgacaaatacaaattagtatatgaaactgaggtggaagtgctggaaaaataattagtatatattcatgatatacaacatgatgttttgatatatgtgtatattgtgaaatgattaaagcaaggtaattaacatatctgtcatctcacatactttttgtggtgagaatgtttaagatctaatcttttagtaatttgcaagtatataatacattattattaactgtagtcaccatgctgtaggatagagctctagaacttattcatcctggttaactgaaactttatactctaacaaattatctgcacatttcaccctatccccgcagtgttgtgctgttttggttactatagctttgtagtgtattttgaaatcaagtgatgtgaagccaccactttgttcttgctcaggattgctttggctatatgggatcttttgtggttccatatatgaatttaaagattacattttctgtttctgtgaaaaatgccattggaactttgatagggattacattgactctgcagaccacactgagtagtgtagacactttaagaatattaagtcagaccaggcacaatggctcatgcctgtaatcccagcactttgggaggctgaggtgggaggatcacttatgaccaggagttcaagaccagcctggataacatagtgagaccccatatctaccaaaaagtttttaaattaaaaacaattggccgggtgcggtggctcacacctgtaatcccagcactttgagaggccaaggcgggcagatcacgaggtcaggagatcgagaccatcctggctaacatggtgaaaccccatctctaccaaaaatacaaaaaaaaaggaaattagccgggcgtggtggtgggcccctgtagtcccagctactcgggaggctgaggcgggagaatggcgagaacccaggaggcggagcttgcagtgagccaagatgcgatactgcactccagcctgggcgacagagcgagactctgtctcaaataaataaataaataataaaaacaattaggcatggtttttggatgctgaattgaatttctttgtgtgtgtgtgtggttttttttttttttttaaagactgaataatattccactctatgtatatgctacattttctttatccattcatccatagtggacatttcggttgcttccacatcttgggtattgtgcgtaatgctgcacaatgaacctgccagtagctcttagagattctactttgaattgttttggatatatgctcagaagtgggattgctggaccatatgggaattctatttttaattttttgaggaatttccaagtggttacaccattttgcacactcaacaatagagtatgaaggttcaaatttatccacatcacacttacggttttctgtttgtttgtttgtttgtttttaaatagtggcagtcctggctggtcgtggtgggtggctcacgcctgtaattccagcactttgggaggccaaggcaggcgggtcaccaggtcaggagatcctgtaattccagctactcaggagactgaggcaggagaattgcataaacccaggaggcagacgttgcagtaagccgagattgagccactgcaccccagcctggcgacatagcgagactccgtctcaaaaaaaaaaaaggcataacgttgaatacacgtttcaaaagaagacataagaaaagatggtcatcatcatgaatcagagaaatgcaaatcaaaaccacaatgagctatcaccacacacccattaggactgacccccactttttttttttttgttttttgagactgagtctcactctgtcaccaggctggagtgcagtggcgcgatcttggctcactgcagcctccatcacctgggttcaagccattcttctgcatcagcctcccaagtagctgggactatgggcgcgcaccaccccacccagctaatttttgtatttttggtagagatggggtttcaccattttggacaggatggtgtcaatctcgtgacctcatgatccgcctgccgtgacctcatgatccgcctgccttggcctcccaaagtgctgggattacagacatgagccaccgcacccggccttcttttttaatgtttctttttaatgaaccatctttggattcctgtgataagagacacacttatagcaaaaacctgtagtgtggtggtagttagggacaaaaggggttgagcaaaacaagacacagttggtaatgtcaaagtgattttaaagcataaatgtttatagacacctgaaagttcatggtatgccttatttaccaagtatcaacaataaaatatgtaaaacaaaaccgagaaatccaaggagaaactagcaagtatggaatcattatggaagagtgtaaccctctttgtcatcagttctatgaaagatagattgcataaaccaaaaaggcagcagaatggttaagcggagcagacaggaacagacaaaactcctttttttcaagtgggaccagatgaggatgatctcatattttcttacttaaaaggaggcagttggccgggcatggtggctcaccctgtaatcccagccctttgcaaggccgaggcggggcctatcacgaggtcaggagattgaaaccatcctggctaacacggtgaaacaccgtctctactaaagatacaaaaaattagccaggcgtggtggcggggcctgtagtcccagctactcgggaggctgaggcaggagaatggcctgaacccaggagggggagcttgcagtgagccaagatcgcaccactgcactccagcctgggcgacagagcgagactgcttccacaaaaaaattttaaagaggccgggggggagggcagttatttcgtcactgagtgttgatacagtagaggggcacactgaccataaactcctctctccaaaaattttgttggattataattttgcagaacaaattatgaccacttgtgactgttaacactagaaatttataatattaacactagaaaattgtaatgttgagtttaaaccagcattttataactaatccgtgctgttgttgaactcttgttctatgatttgaattaccaaaatagaatttttttctaaaaatattcccaatattgaataagcttgcttattatatatgctttttaatattatgttaaattattactattatatatgctgttgcctaactgaaaatcactggcttagggcctcatgtaccaaaccaaagcaaaataagatttgagtagtggttattttacttaagaaaatatacttcatttcaaagcatttggggccacctgtgtactatatgttaatggtgttgtaggataattggatcctagtaagacaaagttcccctccagagcattatcttgtcatagaatcagacaaatgtatcaataattcttaggattagtagactgataaatattatagaagcataaactttatttaatttagagacggagtctcactctgtcgcccaggctggagtgcagtggtacaatcttggctcactgccacgtgcatctcccgggttcaagtgattcttgtgcctcagcctcccaagtagctgggattgtaggcacttgccaccatgcctggctaatttttttgtatttttagtagaggcggggtttcaccatgttgtccaggctggtctcaaaactcctgtcctcaagtgatccagccgccccagcttcccaaagtgctgggattgcaggtgtgagccactgcacccggccctagaagcataaattttagaataaagttattttactgctttctattctagcacttaccccaaggaaacaagaaatgttgtcttactgcctgtcaatgttatttgattgctttggtcagtgggccagatgttgacatttattaatatgaaaatttcttatacacaagattgtaatagaatgtttatcataaagatagtagtaatactcaagattcaaattcataaaattgaaggtataatttttattattgcttttgcttataattctggtttatcagacattaaggacaactaggaaagaactgggccccatgttattgccacaaatatgttttttgaagaatacttttctaggttttgttataaaactacccaaacatcttgattcagtttcttgggggaagaaatggtcatgttgttttgcaagtgagagaaacaaagttaatagaagtaatcaaggtgttctcttgggtccatttttgttagggataaagatgtacagttgtaggttatttgaatgtttcttctgtgtcagaggaatttgatacaacagtaagaaggtgtttcagagacagaagtgattactctcaccagaatgcagttgctgtttaagacaatgggagaatgcttgtttgtgtatttctgggtttataaaggcaagactttcacccagttaacagggctaggttctctgttagttttgagagtcactgtgtgctctctcatgtcagttgcatccatcctccctagcttgaggcctttttgtggataatatacatgctgccttcacgggtatgaaacaggtgtttacacagtgttaaaaatataatactttaccaacttgccttcttcaaatattctgagggctgtttttaatgccatctctctctctcttttttaagctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtgtatcctttttaggcaactggccaattccactgcttggtaaccttgttgagtaaatagaacttgaaatttcctgaacttaaaggaaaagtgcattaaacatgctaaagggaaaatcgtaatctgtttgctatttactccctaagtctagtcatggaaaatcttggttaactctgtttgcagtcatgtttcttctgtccaagggatggtttgttgtgatgatgaaaaggtaaagggaagatcagtagtagactaagaaagagggtgccctggctatctacctggtgaaatcaggactgtcctgatcttaagagtcaggttaccactttaggtctcagtttccccacctttaaaatgaaggaactggtcgtcatgatctttaaggtcaactgaggtctgaaattatgtgattaactctgaccaacatttagaaatctggactgaacagatctagaggatgctgcctgggtaaaggctccatttgaaagatagagaggttaagtatactgaagaggatctgccagaagggaaagggttatacagcactcctaccagtttacccaatttgtattccgcccctccagggtgcgggagctcgctgtttctaggcagccctttccatttttaaacagctctgttaataagttgtagtgatatttgaagtgaaatgcctcctgccactaccacctgttggtcctgctttactttttgccatgaaaataagcctctctcagatgacagatttttaaatcatgtttcctttgaatcccatgctgcgcctcctatagcataaatctgtaagaaacagagactagtgtttacacagaagtgagtaaaagaaatgtagaaatactgctaatgaaataatactatgatgaagttaaaggctaaatgctttaataatttaatttctgtgagaaagaaagtagccatagctaaacttttaggtagttaagtacgtgaccaggcaagaaagcatgaggaggaaaactagcacaaaccccttcttagaacgacttgcccatagtcttacttatttaagatcttaacagtaatggaagagtcaagaaaatagacttagggttggatttactagtaagagtatgtttctagacctgtatttctggaagttttatgtttggcttttgaggagcttgggagaggaggggagcggcaacaagaagtaaaaagaatagtgacattacaggttactggaccaaacagaggagggagtatctgctacttacaggctaacagtgtttccagcaaaccttggagggggttcgttgatggtggacaatttagagagcaaagaggttgagacttcaagattgaccagaatttccctaacagcctgtttcagatctcagtctaggcccatagccgcatcagtcagatgtaatgctggaatgcctgccatctcacaggacctaaaaggagttaacgacttcagattctttccatgaaggaaaccaagttttcctcagtttcttctttcctttaagggcttcatggtgtaatgatggactgtttgggaagagagtcaagagaggatgcatttttgttttcaatgctttgctaaatgtgaccagctaattggtgttttaccttaacctgtgcaaacagatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaaggtcagccaggttatttactattaaggtgatatatattgaaaaaccctttcactgaagcatagttatatttgtcattattcatattttaaattacaccagaaatacccaaaaacatgtttatggcaaaaatgctaataaagtgtggtagtcctcttcttcttccttatcccattgctcctttctccccagagatacctttttttttttttttcttaaagacagagtcttagtatgttgcccaggccggtctggaactcctgggctcaagcagtcctcctttcttggcctcccaaagtgctgggattatgtatgtgggccacagcaccaggccgtgataactaactactataacaaattggtggccagttgcggtggctcacgcctgtaatcctagcaccttgggaggccaaggtgggccttatcacctgaggtcaggagttcaagaccagcctggccaacatggcgaaaccccatctctactaaaaatacaaaaatcagccgggcgtggtggcatgcgcctgtaatcccagctacatgggagctgaggtaggagaaccgcttgaacctgggaggcggaggttgcagtgagccgagatcacaccactgcacgccagcctgggtgacaaagcaaaactctgtcctaaaaaacaaagtgtattttctcccaaagtattttctatgctcttgcatacatgtgtatttttatactttatatagataaacaggatcacgtacattatgtgttagtttttttgttcgtttgtttgttttttgagatggagtctcgctctgtcacccaggctggagtgcagtggcgcgatctcagctcactgcaagctctgcttcccaggttcccgccattctcctgcctcagcctcccgagtagctgggactacaggcacctgccaccacgcctggctaatttttctttgtttttgtatttttgtagagatggggtttcaccgtgttagccaggatggtctcaatctcctgaccttgtgatccgcccaccttggcctcccaaagtgctggtattacaggcgtgagccaccgcgcctggccttatgtgttagttttaaaatcatgttttgttggtgacatttttcttcaataaattttattcaaaagatagcagcagaaaacttaacgtcactgactttaatacctaataaggcattccaactaaataagaaaaccccaaattctttacagtcctcagagttctgaaaatatgcagcatttacatatttctgttttaatgggtgttacaggtaaacgagggaaatttatggatatcttagatgtgacggagcgatgtcgattcagtctaaaaaaatgcacaggaattcaagaagacctaaataaatgggaaggcatcccatgtctgtggatcataagacttaatactgttaagatggcagtattctccaaattgatttgcagatttagtgcaatccctatcaaagcccccagttgtttttttctgtagaaattgacaggctgatcccaaaattcatatggaaattcatatggagaactgatacacttcctgatttcaaaacttactgcaaaacacagtaatcaagacagtgtgctactggcataagaatagacatataggtcagtggaatagaagtgagagtcagtaaataaacccgtgtatctatggtcaactgatttttggcaaggatgccaggaccattcactggggaaagaatagtcttttcagcaaatgaatctgggacaactgaatagccacatacaaaaagatgaaaaaattaactcaaaatggctgggtgcagtggttcgcgcctgtaatcccagcactttgggaggccaaggcctgtggattgcctgagctccggagcaagaccagcctgggcaacatggcaaaaccccatctctaccgaaaatacaaaaaaattaatctgggcgtggtggcatgtgcctgtggtcccagctactcaggaggctgagtgggaggactgcttgagcctgggaggtggaaattgcagtgagcagagattgcaccactgcactccatctggggtgacagagtgagaccttgtctcaaaaggaaaaaaaaattcaaaatggattgaagaactcaattaaaagctaaaactttaatactcttagaaaacatagaagtaaatctttgcaatcttatgttaggcaaagcttcttagacatgacaccaaaagcacaagcaacaaaagaaaaaagtaagtggattccatcaagattagaaacttgtgctacaaagcaaaccatcaaaaaagtgaaaaggcaagccacagaatgagagaaggtatttgcaaatcatacatctgataagggacttaaaactagaatatatgaagaactcttataactcaataatgaaaagataaatagcctagtttaaaaaatggacaaaggatctgaatagacatttctctaaagaagatatacagatggcaataagcacatggaatgatagatgcttgacatcattagtcagtagaaaaatgcaaatcaaaattacattgaaacaacttcatgctaactaggatggctgtagttaaaaagtcagataataagtgttggtgaggattccactccttagtgaaaatgaaaacatgcatctatacaaaaacttgaacacaaatcttcatagtggtattgttcactatagccagtaagtagaaacaatccaaatgtccagctgatgatgaataaatacagtgtggtggatccacacagtagaagagaaaggagtgaagtactgataatgctacaacatggatgaatcttggaaacatgtctgtgaaggaaggcagccacagaagacacatattgtatgattctgtttacgtgaaatgtctagaataggcaaatccatagagacaaaaattagaattagtggattactgattgcctagggctagaggagttgggagaataaagaaggaaggaatactaactcactggaatttctttttgaggttataaaaatattttcaaattggatggtggtaatggttaatttccaccattataatactaaaaccattgagttatacactttaaatgagcaaattgtatggtgtgtgaattataggttaataaagctgcttaagtacatatatatgtatagcaataatcatttattggatttcagttcaacagacactcctatgagaagccctttgagatacgccagacaagagagatgagggtctgcccttgaaatctgaaaactgatagatcagaaatctggtagacagtaggtgattataatgagatgttctgtaactgagatggagaaaaagatggtgtacaaatgcaaaggagagaggtgggctagcgctggctgggactgggaggcagcaggaagaaggtggtatctgtgccggccctcgaggttgggtagcttttcttgcgggaggccagtggctctattggacatagggtatcataggcagagagtacagaaataaaataagaaggaagggactactaccgaaagcactgagtcttcctccctgtggctgcagcattggatgagtaatagggagtcatcgacactaagctaaaaaggttggttgcaagtagatcgtggggaaccttctagaactgtgtgtaaaaagcggtgggttttgtcacggtgggtgaacacggtggccaatgtccagtgagatgtaaaggacagcttccttcatcagatattgtgtggattggactctgtcccctcttaggatccttctgatacaggtttatgtcttttccacatgggatggaaccagctcctttacctggatcagtgcaaccaagagtcaggtgggcacaaaacgaataaagctatgtttaggatggctgtactacttctttggcacttaatgattgtcttgaaaatttgcagtgaatatttttatgtctcctcgtgttttttttttcttttggttatcatcatagccctgttatggcagattgcttttgtttttggagagacattctcaatcaatattttaagcatataacatttctgggaagaattggctcttatttttgcttgaaagtgttcatctttaagaataaaacaaatagaaccagactactctctctgttgtctcttcccagtttatggacttgtctttaaggccattctgttcacctactcacactcacacacacgagttgttggccgtggcataatttaggcatcgtcttgaaaacccaagttaacacaaagaatcagaagcataacaaattgactaacattttattttattttattttatttttattttatttatttttatttttattttatactttttcgagatagagtcttgctctgttgcccaggagtacagtggcatgatctcagctcactgcaaccttcacctcctgggttcaagcaattctcctgctgaagcttcctgagtagctgagattacaggtgcccaccaccatgcctggctaatttttgtattttcagtagatacggggtttcaccatattggccaggctggtctcgaacttctgatctcgtgatccgcccgccttgacctcccaaagtgctgggattctacaggcatttgccaccacacccggcctttactgatattttaaaagtatacagcagtcaggtgccatggctcacgcctgtaatcccaacacattgagtggctgaggcaggcggatcgcctgaggtcaggagttcaagtccagtctgaccaacttggtgaaaccctgtctctactgaaaatacaaacaaattagctgggtgtggtggcgcacacctgtaatcccagctacttgggaggctgaggcacgagaatcagtgggaggcagaggttgcagtgagctgagatggcaccactgcactccagcctgggcaacagggtgagactccatctcagaaaaaaaaaagtatacagcaatgtgtgtgcatcattctcatgggtataaatgcgagaagagagaatctcattcaaagatgagtatggtatgtcactgatttgttacagtgagcgtgtcaaagcagggcaagaggcagtggcagttcagtgtgcatatgacagttgagaacaccacatgaggagaggacttgtgtttgctggagctctgggatcactgcacatttatcacatcctcagtgccatgtgaccatgatgcctattcccacaggccccttggcctaggaagtttgtaacttgcagcgtcactgacctcctgttatttaggtcctttcagattttcaagaagatttcttcaaccttcatccaatgacttctatgttacagtgttttttactcttgaacccttaccaaaatatcttgaacccttatcgatatcagctattatcagtgtcttagacctttaacttttggctctgttatcagtcaaggccgacagaaataagcttgctttttggtttccataaacatgctttgcacttattttatgaagcttaagacccagcagacattgacatcttaggacccttccgggatcctctcttgtagactttattcttcaggaccacaggaactcaccagggttacagaccctatttggaggctctgctagcacatttctagtgtaactaccagggaacgtgagctatactagtctgtgcccttgtttactagactgatcccacagaaatcccagtaggagtcacaagatgctgggatcacaacatgtgaaaattctggctatgcctatgaaagaaagactctgatagatacaaatgaaacacgtctttggggcatcctttgtttttgaaaatctgaatttacacagcccaaaaggtatattttcttgtaccatatccttatttattttcctttgtatggaattatactgagtactactgcttttttattttgtagccttggcattgtattgattagtgtcatgtaaatttggttagtctttgattttatagtgttgacagaccttaaaaaaaaatcatggccaggcatggtggctcacacctgtaatcccaacactttgggaggctgaggtggttgaatcacctgaggtgaggagttcgagaccagcctggccaacgtggtgaaaccccatctctactaaaaatagaaaataagccacaccatgatattggagggccagatgatgaaaggccagtagatgcttgagaccggagaaaatgagaaactatgtattttttaaaaataaaatattcttaagtatatgaaactttaaaaaaaaaaagctttgggagtaggtttgactacctagaagaaggaagtgggaagaatctttggaaatacttatatttatagactaagtagaagactagcagaaagtagagtctgagaatagaaggccagtgcagatcttcacagcagtcctgagagctccagcaggacaggctgagaaaagggtactggttggttttggtgactactcagaacagtttttgtcaattcacctattgagattgctttgtgctaagcagataatgaaaggtagggatgcttcttaaagtgtgctctgtaaagacttcttcagcctgcatcctggtctctaacatgttgattgcttttcaggttgttgggaaaattaaataatgattttctagaatgcccagaaagtatctgccacttagtagcattattattcctattgccttttttatttttgtgatgttttgatatgaaaggttagaatttctaagaagttatcctgttttttttctctcttagatctgtgactttggcctggcccgtgttgcagatccagaccatgatcacacagggttcctgacagaatatgtggccacacgttggtacagggctccagaaattatgttgaattccaaggtaaggatgaagtttgcataaaaagaaatccagtaagtaagagaactttctgaatgcattgcagtaagccgtaagtctccctctgcgttgagagtttgcctgtctggccagagacaaggtgctgtcttttttgagacagggtgttactctgtcacccaggctggagtgcagtggcaccatcacggcttaccagtctcaacctcctgggctcaagtgaccctcctcacctcagtctccggagttgctgggactacagagtgcaccgctacacctggctaatttttttttttttttgagatggagtctcactctgttgcccaggcagagtgcagtagcacaatctcagctcactgcaagctccgcctcctgggttcacaccattctcctgcctcggcctcccaagtagatgggactacaggctcccgccaccatgcccggctaattttttgtattttttagtagagacggggtttcaccgtgttagccgggatggtctctatctcctgaccttatgatccgcccacctcagcctcccaaagtgctgggattacaggcgtgagccactgtgcctggccacatctggctaatttttaaattttttttgtaaaagtagggcgtcttcctatgtcgcatgttgcccaggctggtcttgaactcctgagcttaagggatccacccacctcagcaccccccacgccccccgcaaagtgctgggattacagggatgagccaccacacctggccccaaggtgctgtctaaattttgttcggcattgaacttctgggccctagggctcagcctctctacctcagctgatatagtgctgacggttgtagagtaggagggggtgtgcctctccagtcactgttaccataagtggtctgtgtttcactccttggacagctgtcctgaagtcctacctatcgctgtcactgttaggtgcaggctgggtttgttgtagaggttattcagtaatgtgtatttctgtgaacatgggccagggctattctataaaggtcaaatttatctgataatgaagaatgtctcttcggcagaattatattgtaatttgttgtacttgaagaaaacataaatgtggacagagtaggaactgccgtggattcttttgaaattacgtgatttcctgcttccaaatgaagtgctttcctctgcatctgtgagtggctatagagagtgcatccaggtctcatccacactctactagcaaggtctgtgtcttggtcataagaaatggttgaataagtttacaaaagcccagaaaagtgaagtctgacattttttgttgggtttatgagccaggaggcaaaaattgagggctgctatggagattgagattcagtatttttctgttatttgcaaataatatatgaataaggtgtgaaaattgagtagttaagtaggcctgacatactacctgtatctagtatctcaggattataagattcttaaacacagttccctctgctgtcatgtaaagatacttgaagaaaagcaataaaaatagacattggatcttgtatctagggcccaggaaccagaaatagtcctgagaggcttagtggaaatgaaagaacaggtctaattagcttatagtcttctttttcttcctccatcctttattactagtacagataagctattagattttttcataaggaaatggaatttgtttaaagcatttagtttttcttgatatcctacatttgttcagtttagttataaaagtaaaatctcattaacataaattccattataaagaaggatttggtgtaacagatgtttcagagaagaaaatgccatgttgattctctgtaattctatatcacaaataatcccacacaacaggttctttctctgactggccacgtgacagccattctaaacaaggagcattggcatgccagtgttcagtgccagttgtaaagggagctgttggtgtgcctttgtcctggtgtggcttggtcttgcagtctccgttctgacttagacgcccccactgtctccacttctctattaccctccagggagaagtagccagagagggtgttcttcaagatgaccagcttttccttctacttgcagggtcaccaaagtgaaaattgagtgttcatttttttcttatttgcgatacctgtagcctgagaatgttacttctagcagttgtcttcattttgtttatttttattaatgtagaaaattatcaaacccatagaaaaattgagagtagagtgaatacccatatgcccctgtccttggttctccagctattaacaccttgtcatatttcttatccctccttccctctcttactctttcctttctctctctctttcttcttctgtctcttctcttttgtcagaccatgtgacacttcaccaacatataacacttcactcctagaccctttggggcatactaatgctccttacaaggaaggtgttcttcccacagctagagtacccttaccctttcataaaatgatcagcattaattccatgacatcccatcctcccaaaaaagtctaggtaactctgttttcaacacatgatttaattgtttcatgcattattcttagtctagaacagtcttgcccttcctctcttctttaagacattcagtactttgcaatgtacagatcagttgtttcacagagtggttcacattgtggattcctccagtgagttctttctgatgagatgtagcttgcacgtttctaacacgaccactacagattcctgaagacggtgcagaagtagctgggactacaggtgcccgccaccacgcccggctaatttttttgtatttttagtagagacagggttttaccatgttagccaggatggccatccttgtttcccagcagccttcccccagtggttcagcactcacttctgtcagttatcatactggaggttataaaatggtaattttctaaatttgttctttcttttacttgtattagctagaattctcctatgaagatttttcccatttaccctttctcttcctctgtatcctacctttgtttttaaaacactattgcagacccaggattttttttttatgtgttctccattttaattttctttcttttttttttttaaactcatattgtcccagttttgagaagctagagcactctgtgtacatatttgtaacgttttatagaatttcagctttcagaaaacttgcgctgttttagcttgtttaggaaagaaaaaaaattttttaaagaaaagttgctgggtgtggtggctcacacttgtaatcccagcactttgggaggccgcggtgggtggattactcgccaggagttcgataccagcctagccaactttgtgaaaccccatctctactaaaaatacaaaaaattagccaggcatgatggtggacacctgtaatctcagctactcaggaggctgaggcatgagaatcgtttgaacccgggaggcagaggttgcagtgaggcaaggtcacaccactatactccagcctgggtggcagagtgagactctgtctaaaaacataaaagttgcaagaaaagtataaggtagccattctcaaaccttcttgtctcaggatacctttacatttctttctttcattggttcattctttcttttgttctttctgtttttttttttttgagaccgagtctcactctgtcacccaggctggagtgcagtggtatgatctcggctcactgcaacctctgcttcccaggttcaagcgattctcatgcctcagtctcccaagtagctgggattacagatgcatgccaccaagcccagctaatttttgtatttttagtagagacggggtttcaccatgttggtcaggctggtctcaaactcctgacctcaagtgatccacccccctcagcctcccaaagtgctgggattacaggtgtgagccactgcgcccagcctcttttttttttgagacagtcttgctctgtcacccagatggagtgcaacggcaccatctcggctcactgcaacctcggcctcctaggttcaagcagttctccctgccttagcctcccaagtagctgggattacaggcacctgccaccacgcctgcctaatttttgtatttttaatagagatggggtttcaccacattggctggtctcaaactcctgacctcagatgatccacccacctcagcctcccaaagtgctgggattacaggcatgagccaccgtgcctggctttttttttttttttttttttttgagacggggtttctctctgtcacccaggctggtagccaccccctcctcaagcgatcctccagccttgcctcctgtgtagctgggactacaagcgtgtaccaccatgcccggctaatttttgtatgtttttgtagggacagggttttgccatgttggccaggctggtctcaaactcctgggctcaactgatccacccacctcagcctcccaaattgctaggattgcaggcatgacccactgcgcccagccaagatccctttacatttgttaaaaattatcaaggaccagctgggcatggtggctcacacttataatcctagcactttgggaggccgaggcgggtggatcagttgagcccaggagttcgagaccagcctggccaacatggagaaaccctgtctctactaaaaatacaaaaaatgcactgggcatggtggcacacacctgtaatcccagctacttggaggctgaggcaggagaatcgcttgaacctgggaggtggaggttgcagtgagccgagatcttgccacagtactccagcctgggtgacagagtgagactctgtctcaaaaaaaaaaaaaaagtcaaggacccacacacctttttttagttacgtaggttatatctattgttatttacaatatgaaacttttttttttttaatttttggagagaagtctggcgcttgtcccccaggcttgagtgcaatggctcaatcttggctcactgcgacctctgcctcccgggttcaaatgattctccggcctcgcctcccgtgtagctgagactacaagtgtgtaccaccatgcccggctaatttttgtattttttagtacagatggggtttcaccatgttggccaggctgctcttgaacttctgacttcaggtgatccacccgcctcggcttcccaaagtgctggggttacaggcatgagccaccacacccggcctacaatatgaaactttaaaatgtattaattaatttttaaatagtaaacccactacatgttaagataaattacatgtttttcttaagaataagtttattttctacaataaaaacgttttagtgaggccaggcatgatggctctcacctataatcccaacactttggaaggccaatgcaggaggatcaccaggagtttggaaccagccctggtgacatagtgagactctgtacaaaaaagaaatttatttatttatttatttattttttgagacggagtcgtgctctgtcacccaggctggagtgcagtggtgtgatctcagctcactgcaaggtccgcctcccaggttcacgccattctcctgcctcagcctcccgagtagctgggactacaggcgtccgccaccacgcctggctaatttttttgtatttttagtagagacagggttttaaccatgttagccaggatgggctcaacctcctgaccttgtggtccacctgcctcggccttccaaagtgctgggattacaggtgtgagctgctgtgccctgccatctgtacaaaaaattttaaaatcagctgggcatggtggtgtgcacctatagttccagccactcaagaggctgagatgggagattttcttgagcccaggaaattgaggctgcggtgtaccgtgatcacgccactgcactccagcctgggcaacagggtgagaccctgtctttaaaaaaagcaaaacgaaaaacaaccttttagtgagaagagtggcattgttttcatttttgcaagtctctttaatgtctggcttaatagaagacagttggattctcatctggttctgcattcagtctgtcaaatatgttgttttggtttaagttcatgaggaaaactcttttttttttttttttcaggctttaatcaatttaataatcaatataatattacatgcatagttcttcaaaaatgtcaaggaaaactctttcccatggattttaactgcttgaattcagagcatagaaaacagaagaaaacttgagtgcaatattaataaagaccctttaaaaaagatgttatataaaaagaaaaatcgcaagccagtgaaaaatacatgcaaaattctaaataacattttagcaaacaaaatctatgcttaaaagcataacacacaaaaaagtgagatttttccctagtatgtaacagtaatcagacattttatcaagacatttacaaataagcctaaaaatagatgtctgagtgctatttatgaaattcaagatctattcctcccatccaagcactaaccaggccaaccctgcttagcttccgagatcagacaagatcgggcgtgttcagggtggtatggccagaggaaaactcttcacacaggtatgtagctggaaaaaggagggaaattttagtagtcttttcagccacttgtggctattctttgatcctacccccagtttaaacaagtggtggtttcttaaaggttaattgcagtgtggaatctgaaatcatatcagtgaattcttgatactatttcgttaaaatccattagtctaccttgcactcatactcatgcatgattttttagcgtatttggaaaatactggttcactgagttacacagatattccaagtgtcacattttcatgtacacatcatcactcatcatattgcatctggaaaaatcttcttttcactcgtgactgaaaaggatgaaaatgtcatagtagtataataaatgtactgtgacctctcagatcctctagagggaacccataggagtctctggaacactcttgtagaaccgccagatagaactcctaaataccctttaccccagattcaggctcaccgattttttatcttttgccccatttgctttatcattctttgtgtgcatgtgtgtgggcactcccacgcactctgagtcatttgagagtaaattgtagatacaccccttcaccttgtttcagtatgtctttacttcaaaccatggtcctgttgttccctggggacatgtggcagggttgtcacagtgaggggtaggggtactccctgcatcaagaggccagagatgctgctaaaaatcctacgatatacagaacagccctccaaacagaaactttctcagcccaaaatgttagtcataccgaggttgaaaaaccctgccttaagagtattctctaacatgaccacagtacagttttcaaaatcaagaaacttaatactgattcagtatctaatgcacagtttatattcacattttagatattatcccaataacctttgaactataccccacccaaaccaccccccgacctgggcacaggttcacatgttgtactgtcatgagttttgtttgtttgcttgtttgcttgcttgttttaagaccaggttcgcaggccagccacagtggctcacacctgtaatcccagcactctgggaggccaaggtgggtgaatcacatggggtcaggagttcgagatcagcctggccaacatggcaaaaccctgtctctgctaaaaatacaaaaaatttagctggacatagtggcaggcacctgtgatcccagctactcaggaggctgaggcaggagaatcgcttgaacccaggaggtggaggttgcatgagctgagatcgtgccattgcactccagcctgggtgacaaagcaagactccgtctcaaaaaaaaaggacgggttctcattctgtcacccaggctggggtaccgtggcaccatctcggctcactgcaacctccgcctcctgggctcaaggccatcctcccaccttagcctcccaagtagctgagactacaggcacgtgctactgctcgtggctgatttacttatttatttttgtgcttttcatagagacaggttgttgtgtttctttagtctcctttaagagtgcagatgagctattttgtagaatgcccctcagttttgggtcatgcatttttaacatgaataccagaaaagcacttcgttgtattagaaggcacttctggagccaggtatggtgcctcatgccgtaatcccagctctttgggaggctgaggcaggaggatcatttgagcccaggagtttgaaaccagcctgggcaaatagtgggaccccttctctacaaaaaatttaaaaatcaaccaggtgtggtggtgtatgcctgtggcccacctactgtgtgccagctactcagtagtgccagctactcaggacctggctgaggtgagaggatcacctgagacaaggaagttgaatttgcagtgaggcatgattacaccattgcacttcagcctgagtgacagagtgatgacaccatctcttaattttaaaagagtcagcttatattccttggagaaacatcttttttgcaccattgttatgattcagacagaatccttccatgattttttttttttttttttaatttttagagaaagggtctcactctgtcacccaggctggaatgcattggctcggtcacagctcactgcagcctccaatccctgggcttaagtgatcctcccacctcagcctcccgagtagctgggactgcaggtgtgagccaccatgtgtggcaaaataataataataatgataataataataataattagttaatacccagtgttgttgaggacatgaggaaatgcattttctttcacatgctgctattaggagtgtaacagtgcaactgcagtcatagttcactgcagcctcaaactcctggcctcaagcagtactcccacctcagcctcccaaagtatcctcccatgacttctaacaggattcctttaaaagaaaacatattcctgaaaaatgaataggaaaagaagatgagaattcttttattttattttatttgttatgttatgttatatgttatgttatgttttatgttatgtttatgttatgtttatgttatgttatgttatgttatgttatgttatgttatgttatgttatgttatatgttatgttatgttatttttggagatggagtctccctgtgttgcccaggctggagtgcagtggtgcaatctcggctcactgcaacctctgcctcctaggttcaagcaattctcctgcctctgcctcccaagtagctggaactatgggtgcccaccaccacgcccggctaatttttgtagttttagtagagacagggtttcactatgttggccaggctgatcttgaacttctgacatcaggtgattcgcccgtctcggcatcccaaagtgctgggattacagacgtgagccaccatgcccagctgagaatattttagaagagattggtaaaatatgatggagctagcacacactcccccaaacccagaaaaggtttttagaccttttttctttttccagctccaatttatgacaattctaaatctgtctctcaaattgtttcaaaaaaggacggatgtatactttggaaattctaatttaataagttaatcaactttgtgggtttgttgttgttttgagacagagtctcgctctgtcacccaggctggagtgcagtggcacgatcttggctcactgcaacctctgcctcctgggttcaagcaattctcctgcctcagcctcccacgtagctgggattacgggcacccactaccatgcccggctaatttttttgtatttttagtagagatggggtttcaccatgttggccaggctagtctcaaactcctggcctcaagtgatccgcccgcctcggcctcccaaagtgctgggattacaggcattagccactgtgcccagcccaagttaatcaactatgaagagaaaaataaaatcacataatcttggttgttcagcctctcataagaaagccaaattgttttttgcttttccatgttgtttacttgtatttctgaattgtagagtcaaaggagaagttcagagtcccatcagcaatgcacctgtcatacaggaagatctcatcatgtcctgtaacaccagataccattttcagtcttttctctctttctcctgcagggctacaccaagtccattgatatttggtctgtaggctgcattctggcagaaatgctttctaacaggcccatctttccagggaagcattatcttgaccagctgaaccacattttgggtaaggttcccgagcccttcaggagctagatttactcaagtttgtacagcttacatcaaagtcacttcattaaattaagaagagttctaatatactctttaacctgtggtaggtgtgaatttttaaccttctctgatttaaaatgttaaggacttttgtgtaaaaacataagaaaggtaaacatcaggagtggtgataagcaacggctcatatcaattatcagggttcattccgactcagagttgatggtgtgtagtcatttaccttggtcctgataactaatagctaatttttttatctgataggtattcttggatccccatcacaagaagacctgaattgtataataaatttaaaagctaggaactatttgctttctcttccacacaaaaataaggtgccatggaacaggctgttcccaaatgctgactccaaaggtaaatgttatttcgttgattagttttttcttaggcttagcttcgcgtttatttgttaaattgttaggtcactagcctgaaaaatgagcctatggctattggataatgctttctttagtgctcactctgaattgttgtcttccccctttttttttttggaaacagtggcagtgcagtaagggaacctggtaatgacggtctagttctccaccttttggtttctttgctaattttaatttgcattaaggtcactttttttttgtttttgtttgagacagtgtctcactctgtcgcccaggctggagtgtagtggcccgatctcggctcactgcaacctcctcctcccgggttcaagcgattcttctgcctcagcctcccaagtaactgggactacagacgcgtaccaccacgcctggctcatttttgtatttttagtagagacagggtttcaccatgctggccaggctggtctcgaactcctgaccttttgatctgcccaccttggcctcccaaaactgggattacaggcgtgagccacagcgttcagcctaaggtcacatttttaggtctcaggaagtctaggaccctgcaaacaaattacaccttttcatcttgtcacttgataatttttaaaatcaggtttattgaagaataatttacacagaataaaattcacactttttagttgtgtgggcctctgagttttaacaaacataaactgtcatgtaacaaccaccgcaattgagatgtggaatattcccatcatccccaaaagttgccttgtgccgtttgtagtcagtcatccctctgcaaccccaagctctggcaatcattgatctgatttatatccctatagttttgccttttccggcatgtcatgttaatggaatcatgtagtatgtagcctttttatgtctagattctcccattcagcataatgcatttgagatttataaaaatccatgtcattgtttgtgtcagtctcttcagcaaatggtgctggaacaattagacacccatatgcaaaatttacaaaactcaaaatggagcataaacctaaatataaggcctaaagttattaaccttcaagaagaaaacaggagagaatcttcatgaccttatgttaagcaaagattttttagagtacccatgaaaaaaaaaagtgatacatttgatttttttatccttttttttttttaggttagcttcgtttaataattgtattattctttattcccatttaacgtgtacctgttaaatatattaggcagctagtttttaaaacttcatgctgttataaaaccatgataggccgaataatgaccccccacccacccccatggctgtattctaatttctagagcctataactatgttaggttacctggcaaacaggaattatggttgcagatacaatcaagattgtttatcagctgaccttattttttttttaactgctccttacagagcagggctaatccacgggcagtgtggtatgccccgaataggcccatcagctgactttaaagataggaaggttatcctggattgtcttgtctaggtaggtggattatctaggtgggcccatttataaaaacagggttccttaaaagttgaggagggaatctgaatagggtgcttgtccttccatatctttatctacatacatgtgcatattttctctataatttattttttaaaaataattattataaaggttaacttttttaaaaattcagaaattatagaaatatttaagaaggtaaaattcttttataattattccctaaatgtcatggttaatagaattgtgtcttgaatatcttttccacatcagtgcatagatctaggttatcgttaatgattttatagcatttttatccagtgttctgttagaaatttagctatttctaacttcctattttatctgtatgtgtttatctatacatgcatatgaatatatgtgtatatgtatatttaacaactgtctacttaaatgttgaattggttttatgtattgacctgagtgaaggttgagaaatacttggttgtttagaaatgaatttcttttgaaaatgggagaaattttcttttaatctttcatataaaggtagaagaatttcatcattgtagacagttaagaagtatgggaggaatggtaagggagtaagatattgatcaccaggatcccacagtaacctttcactttttttgcactaatgtgtgcaagcttctgtgtggttgtaattatataatgtattttggttttggggtgttttgtggtttttttttgttttttttgttttttgtggtttttttttttgagacagagtctcgctctgtcgcccaggctggagtacagtggcgtgatctcggctcactgcaagctccgcctcccgggttcacactgttctcctgcctcagcctcccaagtagctgggactacaggcgctcgccaccacccctggctaattttttgtatttttagtagagacggggtttcaccatgatagccaggatggtctcgatctcctgaccttgtgatctgcccaccttggcctcccaaagtgttgggattacaggcgtgagccaccgtgcctgaccggtttttgggggttgggttttttttttttttttggagacgggtttggctctatcacccaggctggagcacagtggcacaatctgggctcactgcggcctccacctcccaggctcaagccatcctcccacctcagccacctgagtagctgggactacaggtaggtagtcccacctcagccatctgagtagctgggactacctgtgccaccatgcccagctaatttttgtattctttgtagagacagggtttcgccgtgttgcccaggatgatcccaaagtcttgagctcaagctatctgctcaccctgggcttctgaagagttaggattacaggtgtgagcaaccacacccggcctgtaatgtattttgatggtaggatatttttagctagaatgtcacatgcataatacatgttactgattagatttgcttgtatattataccacctaagcatgttatctaaatgttactaaatgttatttcctgagtcacttttttaaagagctgcataagcaacaaagctgcatcattaggcctggtaatgtggctcatgcctgtgatcctagcccattgggaggtcaacgcaggaggatcgcttgaggccaggaatttgagacctgcctggacaacatagtaagaccccatctctacaagattaaaaacttaaaattcagccgagtgtagtagtacctgcctgtagtctgaactacctggggaactgaggagggaggattgcatgagcccaaggaggtcaaagctgctgttagctgtgattgcatcattgcactccacgctgacggtgacactcttatctcttaaaaaaaaaaaaaaacaacaaaactgtaataaataggcctactcccaaacgttcctctcctgtttgtttccttactcttgtctgtaatcatgagttgcatcaaactatttctgattctttttttatgcttattttcattttcatttttttttctttcttttttttctgagacggcgtctcactctggctggcgcccaggctagagtgcagtggtgtgaacttggctcactgcaacctctgcctcccaggttcaagcaattttctgcctcagcctcccgagtagctgggattacaggcgcccgccaccacgcctggctaatttttgtatttttagtagaggcagggtttcaccatcttggccaggctggtcttgaactcctgacctcatgatccacccgtctcagcctgagccactgtgcctggctgcttattttcattttcttttttctcccctcccttctcctcctttctttcttcctttctttctttcaagtttcacttctatcgcccagcaggctggagtgcaatggcgtgatctgggctcactgcaacctctgcctcccgagttcaagtgattctcctgcctcagcctcccaagtagctgggattacaggcatgcgccaccacgcccagctaattttgtatttttaatagagatggggttttaccatgttggtcaggctggtctcaaactcctgatctcaggtgatgcacctgcctcagcctctcgaagtgctcggattacaggcgtgagccacagtgcccggccttcattttgttttttgtttttattttacttttttttgagacagaatttcactcttgttgcccaagctggagtgcagtggtgcgatcttgtctcactgcaacctccacctcccaggttcaagcgattctcctgcctcaacctcccaagtagctgggattataggcatatgccaccatgcctggctaattttttgtatttttagtagggatggggtttcgtcacagtggccaggccgttctcaatctcctgacctcaggtgatctgcctcctcggcctcccaaagtgctgggattaacaggcatgagccaccgcacctggccttactttgtttcttttgagatggggtcttactctgttgcccaggctggagtacaatggcgtgatcacgactcacttcagcctcgacctccctgggctcaagcgatctgcccacctcagcctcctgagtagctgggaccacaggcgcatgtcaccacgcccagctaattttttgtatttttcttagagacagtattgcatcacattgccagactggtcttgaattcctgggctcaagcaatctaccctccttggcctcccaaaatgttggaattacaggctgggcatggtggctcacgcctataatcccagcactttcagaggccgaggcgggcagatcatgaggtcaggagatcgagaccatggtgaaaccccgtctctactaaaaatacaaaataattagacgggcgtggtggtgggagcctgtagtcccagctactcaggaggctgaggcaggagaatggcatgaacccgggagggagagcttgcagtaagccgagatggtgtcactgcactccagcctggccgacagagcgagactccgtctctaaataaataaataaataaaaattttaaaaaattagctgggtgtggtggcaggtgcctgtaatcccagctacgcaggaggctgaagtgggagaatcgcttgaacccgggaggtggaggttgccgtgaggcgagattgcaccattgcactccagcctgggcaacagagcaagatatggaaagatgttagacctacaaatgccagtggtatgaacattcacacaatcctgtgacgcaggtactatcgacaatcgtctataaaagaaaactgactgggtgcagtggcgcatgcctataatccgagcactttgggaggctgaggcgggaggactgcttgagcctaggagttcaagaccagcctgggcaccatagtgagaacccatctctacaaaaaatacaaaaattagccagatgtggtggtgcatgcctatagtcccagctacttaggaggctgaagtgggaggactgcttgagcccgggagtttgaggttgcagtgagctatgatcatgccactgcactccagcctgggtgacagagcaagactccatctcaaaacaaaaccaaacaaaaacacaatctaaaagtagagacggggtttcaccatgttagccaggatggtctcgatctcctgacctcctgatctgcccgcctcggcctcccaaagtgctaggattacaggcgtaagccactgagcccggcctaatttttttttatttttagtagagacggggtttcatcatgttggtcaagctggtcacgaactcctgacctcagttgatccacctgccttggcctcccaaagtgctgggattacaggtgtgagccactgcacccggcctctagttgttaaagagtgactacatggtgttcccttgtagggatgtgacccataagtgtccttcagccagactcacattggacattaaagtttacatcagttacctattgctgcattaaaaaaacactccaaaactcaggcttgaaataacagccatgcatttgttcatgagtccattgggctggcacagctgggtagttctgctgagcccacctgggttcagccatgcactgcagtcatctgctggctcccttcaccatccctcaattgtggtggtttaacgtcttaacagttggtccttcctacagttgcctctttatcctaaagtagactagactcagtggcttctcatgatggcagaaatattccaaaagagcaagagcctatgctgcaaggtctcttggaaccaaatctcagaacatcacttcaacagttctaccatgtttttttgttgttgttttgagacaaggtcttactctgccactcaggctggagtgcggtggcacagtcttggctcactgcaacctccgccacctgggctcaagcaatcctccgcctcagtctcttgaatagctgagaccacaagtatgtgccgccatgcgtggctaatttttttttttttttttgagacagcgtcttgctctgtctcccaggctggagtgcagtggcacgatgttggctcactgcaacctctgcctcccaggttcaagcgattctcccacctcagcctcctgaatagctgggattacaggtgcgtgccaccacacctggctaatttttgctttttatgtatgtatgtatttatttatttatttattttcgagacagagtcttactctgtcacacaggctggagtgcagtggcgcgatctcggctcactgcaacctctgcttcccaggttcaagcaattctcctgcttcagcctcccgagtagctgggattataggcacatgtcaccatgcccagctaatttttgtattcttaatagagacggggtttcaccatgttggccaggctggtctcgaactcttgacctcgtgatctgcccaccttggcctcccaaggtgctgggattacaggcgtgagcaccgcacccagcactgttatttttcttttcttttttttctttttttttttttgagagggagtctcactctgtcacccaggctggaatgcagtggtgcaatctcggctcactgcagcctctgcctcccaggttcaagcaattctcctgcctcagcctccctagtagctggggctacaggcgcgcaccgccacacctggctaattttttgtatttttagccaagatattggccatgttggccaggatggtcttgatcccgtgacctcgggatccacccgccttggcctccaaaagtgctgggattacaggcatgagccaccacatctagccagttgtttttatatttttaagaaaacatacataaattcattcattcagtggatagatttgagtgtctgtttggtgccatcaaggcttctaaggccctggacatacatagtaccagcaataagagggattaagaacctgtttggagatgggaagtctgaggactcattaaaaaaaaaagagagagagagctttcttacagaactgatagtctagatttgtcaggaaatgaatggaagacctcagggaactcaagagattaaaaaacttacaagctagaatttttaatgagagttcacagaaaaggaagatgaaacagctcttaaatatataaaaggtactcatgtttactcattatacaagatacaaacattgaaaagtcagtaattcttttttttttttaacgccctcctcaacagagtagcagacatcaaagtttgacaccctactgtgtggtcaaggctgtggggaaaagggtgttttcggagagagctggtggagtgtaaactggttgagtctctgtagaggacagtctggcaattctgtcacatgtcttttgttccagcaattctgggtattgaacttttaggtctgccaaccaaatgggggagtggcatttaatttgtttttctgtaattaagagtgagattgaaattttttcatgtttgttggaaatttttgattgctgtatcccttaaaccgacactattgtagatttttctttaaaggagtcttagcttacgattctctcaaatgacttcagtgagggagaagaaattattattcagcagatggtactgggctagttgaatagctatttggaggaaaatcaatttaaatcattacacatcaaaatgaattctaaaagaattgatacttatttaaaatttatatcatgagaaactaacaatagagtattcagtatttttctgatctctgcatggagaaagacttcctatgttttaaaacaaacatcaaggaaagagagacatataaaagtttaaaagctaaataaaattagattaggtgtggacaataggtctaaaatgttctaaattgagtaacactggaccttctcctaactgttctgtagaaggcagcaaagtacagtggttatacccggtgctctggagtccgcctcctgagttcaaactagggttctgctacttggatttttgactttggacaagttatttaagctgtttcatgatttcctcaaccctaaattgagacaattgtagttcccacctcataggataattaaaagagttaaggaattattgttaactttagattcattattaatattattagtatctaaagagcagagacaaatctaagaccacagtgtataaataaatgagcaaaggacaagaacacacagtctacaggaaatactgagatgaggaaaactataggaggagcagtttgggtgacagcagttgggtttagtctgtgtttaatttaaggcacctgttaggcattagaaacaacctaagtgccaaatgttaatcaaatggctgagtaaattatgagacatctacttaaaggaatattttaaggccgctaaaagtgattttttttacaaagttttgatagtgggggaaaatgctaatgaacagtatttactaagggaaaataaaacagcatttgtcatacataatatgatttcagccttctacaagaaaatgcatagaaaagaattcaacaacatatgtgaaaagataagcagtggttaccattgaatgatggtgcttggggagcaagggaatgtgggtgagtcattcacacagaccagaaggccgggtttggtgggtcaaccgtctgaggtcttttcagttccacagttccacataacaagaacttactggcccaagaaagagctttattggctctgataactgaaaagttcagtcacatgtggattgatgggcacagacactgtgtctagaatctggacttctttatcatccagttttgccttgctctgggctgtctgtcagtcagcctctcttttcatgatgagagtaagacacttgacctgatcactgcagccaggacttaggctgactctcatcacctctttgtgctcagcttggatgccatgcctatccctgagcagtcactgtggccaaggggactcaggtgaatatggcccagtgagtgtcaccattcccacagcacagcccaggagcgtgggcaagcctgagcgctcccctatagcaaacactgttggatggattagaggggcagtggatgctggtgggcacaaccagcaggtgatcccgagagtgagggaagataaggaattctattttctcccccccacccccccccttttttttttcctgaagagacagggttctccctctgttgcccaggctggaaggctggagtgcagtggcacaatcacagctcactgcagcctcgaactcctgggctcgggcaagcaccgtgcctggctaatttaaataaattttgtagagatggggtctcgctatgtttcccagtcctgtcttgaactcctggactcaagggatcctcctgccactaccacacccggaccccccccgccccccgttttttttttttttgttttttgtttttttttttgagatggaatctcactctgtcgcccaggctggagtgcagtggcgagatctcggctcactgcaagctctacctcccaggttcacgccattctcctgcctcagcttctggagtagctgggactacaggcacccaccgctatgcccagctaattttttgtattttttagtagagacggggtttcaccgtgttagccaggatggtcttgatctcctgacctcgtgatctgcctgcctcagcctcccaaagtgctgggattacaggcgtgagccaccactcctggcccccactttttttttttaaattaaaaaacgcaatttctataagaagtctgtctccatttctcagataacctaatgtttgaaaaccttgcagactttattacacatatagatacatacattgattgtaaatggaatcataggctatatattttattacctacacaaacttggatttattgatctacagcttggtcaccctcagctcaatatagctttgggaggtatttaacctgtggtcttttaaatcttgcaagagattgaaaagatagaagaatgagattgtggccgggtgcggtcactcatgcctgtaatcccagcactttgggaggccgaggcaggtggatcacttgagcccaggagttcgacaccagcctgagcatcatggcaaaaccccgtctctgccaaaaatacaaaaataagcctgatgtggtgacacacacctgtaatcccagctactcgggaggctgaagtaggaggatcgcttgaacccaggaggtagagattgcagtgatctgagatcaggccactggattccatcctgggcaacaaagtgagaccctgtctcaaaaaaaaaaaaaagaagaagaagaagaagagtgagattgtgagaagttggagaacacaaaccttcagccagtgatggaatagggacaaagaaaagaaactagtgccatgtgatatcacagaagcagaagatggcattttgagaaagtaggcatgcacaacagtgtccatgcagcagagaggtctagcaagatatagattggaaaatgtgggttgattttccaatgaggggcttgttggtgaccatgcaagaggagttgaaacagtgaatggaagtgagaaatttgaaatggaaagtggagacagaaacgactggtccacatgaggggaaggggttgtggaccaggccacaagttggggagaattgactttgagtagagagaggatatctttcttggcagtgtcagtaagggtgtgtgtgaatctggctaggagggaattccgcgaagatcactcttgggtgcctcagttttctctgtagcaccctcaagaagatatgctgagagtaatgagggtcagttagcaagaaggtcatgattcaagccgtgcaagttgggtgaaatctgagagtagaggaggggactgaccaaagctttccagaagctgttgagggccttgatgaggctgaaaatcttgagtttttgtagaacggtagttactgatagtgtgctccttaaacacctgagatccccaggatcctttcagggtgtccacaaggttaaagctgttttaataatcttcttaaagagttactcacactgctctctatgttgccatcagcacttgtggcacaggagcaatgatgagcagagtccccagcaccacaggcaggtcaaggcagtggaactagagaggttactgagctctgcactgccacacccccactgctcaaaaccagtgccagtaaaaagtactcaccatattaaatccatccttaatacatgtcttcacgatgtctgtgtgacaaacacgtatagcatttctgctgcatactgaatgcagtggttttctcagggaaaagcacttatgtaactatttgagctatgagcagaattaactggtttttaaatcgtccctcagttttgatgagtataaagagttctgagatcagaaagtttgagaagcactgtcgcactggcacactttgcacagttcagtcttttctctggccccgcacagaaacatgagttgaggatggaagtgacaggttgcagcattgattcagggtcagagtttcacgaggcaggcaagatagacatgaagaggcactgtggagagccagtcaatggctttccccaggtccaggacagggcaagaaggaaaaaaggatgatggattagaagaaagggttggaatcaggttgttacatactatttgaagttaaagagaagggccaggctggccaggcgcggtgggtcacacctgtaatcccagcactttgggaggccaaggcgggtggatcacgaggccaggagtttgagaacacgctggccaacatggtgaaacccccgtctctactaaaaatacaaaaaattagcctggcgtggtggcaggcacctgtaatcccagctactcgggaggctgaggcaggagaatcgcttgaacccaggaggtggaggttgcagtgagccgagacagcgccactgcactccagcctgggcaacagagtgagactcccgtttcaaaaaaaaaaagacaagggccaggcacagtggctcacacctgtaatctcagcactttgggaggcttaggcaggaggatcacttgagcccaggagttcaagaccagcctgggcaacatagtgactccccatctctacagaaaaattaatttaaaaaaattagctgggtgtggtaacatgtgcctgtagtaccagctactcgagaggctgaggcaggaggattgcttgagcccaggagttcaaggctgcagtaagctatgatcatgccactgcactccagcctgggccatagaacaaaatccaaactctgttttaaaaaacacagaaagagaaaatgtagtattctggaaggcactagggaaagtcaggatttgtggtcaggagtaatactagcctcaaagggacttccagtcttttaggggaaataaaacctgtatccaagtaagcatccacacaggcagccatgattcacaccatctgagtgttaccaatgaatgcccatgtggcgtgggaggagggagtccggacattcttgactgtgggatccgcacctgccagctgcttcccggttctctccttttctccttctgtagctatgaataatgtagaaatagcacttgcagtaacagaaggctggagatctagctacttttcaagtagcaaatctttttttaaaaagctgtcttctttgaaatttatgcctggaggtttaagggcctagaatttatttaactttaaggaactaatggatctgttttagaaatgcttaagctgcaaaacatccagttggcttggagtgcctgtctacttaatacgaacaagtttgagtaggacccttctgcccccagtggtttagaagtaatactgttagaatcttattgtggtccaggccttctggacttttcttagcacagacagtatctaattgggtgaaaagccaaatgacttaatctagtttcaagaaagtccttgagaaaatgtctgtgagttctatgtggggagggctggttgggagcaggaagcaaagtgggatttattacctatattatagaccacaggaatctttttttttttttttttttttttttgagacggagtctcgctctgtcgcccaggctggagtgcagtggcgcaatctcggctcactgcaagctccgcctctcgggttcacgccattctcctgcctcagcctccgaagtagctgggactacaggcgcccaccaccatgcccggctaattttttttgcatttttagtagagacggggtttcaccgttttagccaggatggtctcgatctcctgaccttgtgatccgcccgccttggcctcccaaagtgctgggattacaggcgtgagcccccgtcgcccagccaaccacaggaatcttaagattcggcaagggttgtgtgtcttgtacacatatctacaagtgttccttggaagtaggatttgaaccagagattcctgggttcttgaccatcatgcgtctttgtcctgacccttgagagggccacttcctaaacctagccagtttgtgtgcccacagacccagggtcacagctgcaggcatgaccacctcttctactgcgcagacactccttcagtcacagcaaaacctgtctggattctctactctgaaaagttatctaggctataaaacaaaatatcattattccgtaatttcctaaagtgcacttgtatgtattgaaaagattatagatagaaacatacataacttttaaatgttttctatgcggaatttctcattatgtccagcatgtggtttaccatgtttatcatctcctgttgtcttaaggtcaggggttgcaacaagggaggtcaaaattggccggggctgagcacaaatacacacccacagcccttcagtgacctcaggcagcaagatgcctcccacctccccccagcacccaagcaatcccttcggaaggtctactgattgttcttaagggttaggaaacattttcttagtaaatagtgaaaacttactttttgaaagtagtggctagaagtgattccttaaactgatcatgagtattaaattgtaccaaattttacgtgattgtttatcattttaggaatggtgagaagggacatacaattaaattttaaaatgttttaagaagaaataatgatattttatcattctactttgagggcttaatagtatgtgctaatttgcagatggatgaagttgacctttacctacaaataacctaataagaaatgatcattgctggccgggcgcgatggctcacgcctgtaatcccagcactttgggaggctgaggcaggcggatcacgaggtcaggaaatcgagaccatcctggctaacacggtgaaaccccatctctactaaaaatacaaaaaattagccgggtgtggtggcgggcgcctgtagtcccagctactcaggaggctgaggcaggagaatggcatgaacccgggaggcggagcttgcagtgagccgagattgcaccactgcactccagcctgggcgacagagcgagactccgtctcaaaaaaaaaaaaaaaaaaaaaaaaaagaaatgatcattgtcagaaaagacgcttcattaagtagtgccagtgtttttgtttgcggtctgcaattgtcagatggtcggtccctatgttcacagtctcgggaggcttggagatatagtcagcaccctttgtgctggctgctctctctgtagtcatgcttagctcagttgttttgtgggtaagttacttaaacaggaaattgaagtatttctgtgactacttctgctctcactactgcaaaacctttctctttatagctctggacttattggacaaaatgttgacattcaacccacacaagaggattgaagtagaacaggctctggcccacccatatctggagcagtattacgacccgagtgacgaggtaagagctcatgttcctggctgctgcttcagggacatagatcagccagcagtggaccaaccatatcttgcttagattttcctgagatatacctgctgccatacccggttcttccaacaagcccacctttgccttgaggacgagtgctgtggggcacagcttgaaatccctccccccgtaactctgtctatctcagaagacttcctccaggccacctgcaacaggtaggggcggggtaaacgcatgtataaaggggacagctgcaccagtatggagcacagagggcatgggtctgagactggaggccattgtcatggtgtgacaggaagagacacctgaagtgaagtgctggccctgaggatggccggggtggagaggaggtgggcagcctgctgacagggacagcacacagagtggggagggaagtcaacttggacagtttccactgtggcttggcgactccatgtcgggtgtgctattccctagagacaaggacacgagagcctgttgtaagaagtgatgaggccagagtggatatggcagctcttcagagcaggcagggcattcaggtagaagatgctgcatgtcatgttctccccaagacagtcctagtgccttggctctctggtgtctctggggttcaattttaactttattctctggaggataacaaagaaaaatgcaatatgaaccaaaagtttggattgttgtagttgaggctcatatgcacagagaatagtctttaccctcctatttttgaaagaatcagctttcccttccacatccatctctctgcctccagcaacaagttaggcagcttgtgaaatacctacaacatagccagtaacacagaataggagagaatacaggtttggggctcttacaagcttagtgggctggagatttcccaagcttccgagtccaaatcagctggctggggtggtgggtgatgcgtgtaggacacctcctgtgatcccagatgcatagccctccttcgggctgagctatttattcttctggacatgagtccttctcccctttcagatggccaaagcttagtgcagagtttggggtctgtgcttcctccccctaaaggccccatgtgaggattacatgggtgagaggtgagattctaggcattcactgattgacagctggtattatcatcagcttagttctgtaacattgcattagttcacgggcatttaaaaatcaaaatgtggccaggcatggtggctcacacctgtagtcccagctattcagaaggctgaggtggaaagatctcttgagcccaggagatcgaggtttcagtgagctgtgatcacaccactgcactccagcttcggtgacagagcaaaactctttctctaaaaaataataatcagtttgtcactgagtgtgtatggggttctttgatctaaatagacagtttatattttacttaaatagctttctggagtatggttaaaaattaaaatgggggctgggcgcagtggctcacgcctgtaatcccagcactttgggaggccgaggcaggaggatcacttgaggtcaggagttcaagcccagcctggccaacatggggaaaccccgtctctactaaaaatacaaaaatagctgggcgtggtagtacatgtttgtaatcccagctactctggaggctgaggcataagaattgcttgaccccgggaagcagaggttgcagcgagccaagatcatgccagtacacaccagcctaggcaatagaatgagactcagtctcaaaaaaaaaaatggggccaggtatggtggctcacacttgtaatcacagcactttgggaggccaaggttggtggatcacctgaggttaggagttcgagaccagcctggccaacatagtgaaaccctgtctctactaaaaatacaaaaattagccaagtgtggtgccaggcgcctataatcccaggtactccggaggctgaggcaggagaatcgcttgaacccaggaggcagaggttgcagtaagccgggatcgtaccactgcactccagcctgggcaacaaagcgaggttttgtatagaaaaaaaaagagaaaagcaaacttgtaagaaaatacaggagagatttttttcatactacaaatatgtagctttataatcttgttacagttactaacattttggagtatttccttctcagtcttgtatttctgtatctaaattttaaaaataaaatagttttcattctcttgacacaacataggcattttcctattaatcttccttgcagcttaattttgttttcttttttgagatggagtcttgctctgtcaccaggccaggctggagtaccgtggtgtgatctcggctcacttcaacctccacctcccaggttcaagcaattctcctgcctcagcctcccgagtagctgggactacaggcacgcaccaccacacccagctaatttttgtatttttagtagagacggagtttcactgtgttggccaggatggtctcaatatcttgacctcatgatccacctgcctcggtctcccaaagtgctgggattacaggtgtgagccaccgtgcctggccagttttttttatttttctttgagatggaatcttgctctgttgcctcggccagagtgccgtggcgcaatctcggctcactgcaacctccgcctcctggattcaagcaattctccttcctcagcctcccgagtagctgggacgacgggggcctgccaccatgcctagctaatttttgtgtatttttagtagagatggagtttcactatgttggtcaggctggtctcatgatcctcccaccttggcctcccaacgtgctgggattacagatgtgagccactgcgcctggccttgcagcttaatttttaacagctctaagatgttttttcatacaaagataccatgatttatttaatgaaatgcatgtattttagtattatgggtgttgattggataaacgtaccaccaccccaacagcagcacatttctcttatttcgacattcactgccttaaaacatttaaaaattattctgggatttgtggtaagttcagaaaaacacttgaaacagattcagttgctcccaggctaagtgtttatgagaacttgaggagtgtgggcacaactctcagtctctctctgtcacccagactggagtgcagtggcacgatctcagctcactgcaacctctgcctcctgggttcaagcgattctcctgcctcagcctcctgagtagctgagattataggcgtgcaccaccacactcggctaattttttgtatttttggtagagatggggtttcaccatgttgggccaggctggtctcgaactcctgacctcaagtgatccgcctgcctcagcctcccaaaatgctgggattacaggtgtgagccaccgcgcccggccatcaactcttaagtttttatgagacatcagtcctgttgtaaattcagaatctgagcagtggtcattttatgaatcagtaaattactgccttacccataacaactttgactgttaaatgttttgttttcttttaaagcccatcgccgaagcaccattcaagttcgacatggaattggatgacttgcctaaggaaaagctcaaagaactaatttttgaagagactgctagattccagccaggatacagatcttaaatttgtcaggtacctggagtttaatacagtgagctctagcaagggaggcgctgccttttgtttctagaatattatgttcctcaaggtccattattttgtattcttttccaagctccttattggaaggtatttttttaaatttagaattaaaaattatttagaaagttacatatattctcctaggaatctctctctcgtttattagaaactccaagtacctcctttactctcaagggtagtgaatgtgattatttggaaacaactttttcatattccagattgttcatctttgggttctcatcctttccttgctgcctgtccagagcagtttcacagttacatgagcatctctctggaaagggttcgcctcaggactccctcccatggaaagcagagccaccagttaaataaatttagtattagagtcctctgtgcctgccccttcagaaactcctagctgggacctggttctacagttgatgtcacatgcaaggggcccagaccctgttaccagttcagactagcagtgtaggctggagagctggagaaacttcatccaggagatggaggctgggctggccagtcagggggatttacatgggcctgcacagaagctacatgtgcttagatcataagggaaggtgaacaatgtgacaatattggtagattttaaaaattgagcaggcccaacacaatggctcatgcctataatcccagcactttgagaggctgaggggagaggatcgcttgaatctcagagtccaaggctgcaatgagctatgattgtatcactgcactccatcctgggtgaaccctgtgtcagaaaagaaaagtatacaggaaaagaatgcaaatcttgattttagagagtatgtgacaagaggagagagaactggacttgtgtttagaactctatagaaagaagcagtgaataaagaattgtgggccaggtgcggtggctcacacctgtaatcccagcactttgggaggccgaggcaggtggatcacgaggtcaggagatcgagaccacggtgaaaccccgtctctactaaaaatacaaaaaattagctgggcacagtggcaggcgcctgtagtcccagctactcgggaggctgaggcaggagaatggcgtgaacccgggaggcggagcttgcagcaagccgagattgcgccactgcactccagcctgggcgacagagcaagactccgtctcaaaaaaaaaaaaaaaaaaaagaattgtgagccaaggtagaagcagttgctggggagatgctttggacagaaccgtgttgcagttagaggcgtccattccccgtcagtaagaacaaagaaccaagtagacatgagctgaggactgacatgaccaactcagcctccaagcagatagccctgaaagccaggcagggcaacagaacgaggaattggtagggaatagacactagtagtttgggggccggaaaatggtgttttcaaaagtctgacatcaaagcaggaggggttgaaatgagggaatactgggtaggagatcagctaagaacaaatgcctggtcttccataccaaaggggccgtagccttggactagaaatgaagtggtgagaagcggcaaattcaagaggaggaggaaaggcaaagtcttaaagactccaagttttctaaacctaccaacttgggggaggcagggctgctggcactgttaagccctcacttagcctgctgttaacaccagacgcaccccaaaagacgatctctcaaacccaagggaagtgttgtggagtcacgcgaacaggacgtgcagtggactgctagccataagccttgcggagtgactgagaaagaagcctgttatcagcaggggctgagctggttcatgtcttctgttgccccatacacatgtggctctctagtggaggaggtgttagccacagtgatttgcacaatcactcactgacagaaagctgggccccaggatccaaccattttcacacctgcagtccccacagaacttccttcctggctcctctgtgaggtgctcacagtggagcaattgtctctgtttctcaagagtccgtccctctccctccgtgaggctccaggacacactcccagtgtctgtacaaggtcaggttaactagaccttggtcagcccgctgcctttcctctacagcagcggcgtggggtagtcataacagacctggatggcctgtgaggcctgcccttctgtgaagagcactctcttgccgtttacagaacctagaatattgagctgagcaacttctgttgcttttcttccttcacagttcctttcacagtcattttccctcagccaggtggtggcttgtgagcatctcatctctgtcgcttcaggtcaggcggcagtgctgcctgcttagtctgcattagacactaacagcaaacgcggcaagcaggacctaaacacagcctcagaggggcccatgtagtaggggagaaagacacacacacacacaactgtgcacatttttagtataaaagagcttctggggttgacgtgataatttgtttttcatcatttaatcagcattgagcacttcctttcgccagttaggaaaggaacaaagatgaataaaacccaggttttgctttccagcagcctcatagcaggaaatgtaaacaacaaggagtatacagagtcccagagatggacacaggcatggtgggtcccagagagtaaggcagacattaaagcctcacagagtgtggccgactcgcggcagttgtgctgcagctgaaacctgacagttgggttctttgctggttggggaggggcacagctgtgtggaccctggaaggcgggcatgccagacagctgggcaagaggggggctgcagagaaagaggccagcccaggctgtggcccttgcttccccaggaggccagctctccctcacaggtagctgcctgacctgaagcagtggctcaggtgactctggtggcagtaaggatgcaggaggacctctgagagcagggacttgggggaaaactggtcaggccactgaagagacaggcagcaccgcaggcacaaggatggcaagacagaggcagggttgctcctgaggccacagggcgcagttgctggcagaacgcctcctgaagccagctttgcaaggcgggggaccagtatccctctcaggtccaccaccactctgagagtcccggcgtggcaaggacagtcacctctgtgcgttgttcatttgctccagacacagaagacacacagatgctccctatgtgcttatagcatgattttttttcccaacattcttttagtgacagttttcaactattctgaaaagttgaaggaatttaaagtagacacccatattcccaccacctagattatacagttaacattaacatcttacttgttttctcatagatctgtccatctgttcctctatccacccatcaacccatcgcattttatccattcattgcaaaggacgttgccaacgtctagactgacttacaatttagtcatctagaatatcacatgaatccaggggaagctggggctgggttggctgattaaactatgggataggttctttcataaacatttcattttggtgatcacaacagaattttgggaagtcagcatgcatccatgtttataattgaggaaactgaagacaggagcctttgagcacttcgctcaaaattgtacatcaagtggcaaaactaggcagagaatccaggtattttggacccagaatgtcattttcttgaaatgtttgccagcatgaaacagtggcaggctgcacactgcctgtgattagccttgctccttgggaaagttctcaggactcattcacaatactaaggagcattgtctctgagttcccagcccacacactggagatcaggagctctgaattggagagctcaggaggtaaaggtgtaataaaacatgggaacactgggagggcacggttgaccgtttggctgcagcaagaaaggcttagaaacatacaccccaggaccacagagcacagctgtggggcccctttggtagaggaagcaatgaagtgatatttgtagtggtggccgaaaggtcttaaaaaagggtcaaattatattcattgtattttgcttaagggggtcagttttagaaatgtttccatgggcaagtttaaaagctgatcatgcctactacctgtgacaagcctcattcctacccagcccatgtcctcagtctcctaccctgtgaggcgggtgaaggtagaggtcagtgctcaacttccttcttcatctgcctgattgtgaattttctcaggtggattgatcactaggggcatgaaccgcatttccctttggtttattgaagatgaaagcattttagggcagctttaatttcctgccaacccgtaggtttggctgcagttcacctctacataaaagagaccacttctccctcttagcccatctccaagtccacagtttggctatagttagcccattcttcttgccccacctcctgagtggcagatggaaaccacagctctgaaagtgctctgtgaaatagtaagtgatactctgctagattttcatgcactagtgttggatatcttacggtaaataaaggacatcttaggaacactgcagtcagcgtaggctgggggagtggcgtctttcctatgagtgttgtggaaaccacctcagaactgtctgagaggaggtgcctgtggagtgagggctgaccctggccccttcagaactgccatgtgttatccttgcccaaatgtgtccaaagaaatggccattttgcaggagtcttttttcccttttctgttttcataatgctattgctgctgctgctgttttaatgtggttcactgttgtcacttttgtgttttgtgatgctgatgatgatgctgttttcacatggctcactcttaactcagtggtctgtttgtgtttctataggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttggagtcctcttctaaatagaaaaccatatccttggctactaacatctggagactgtgagctccttcccattccccttcctggta

SEQ ID NO: 15791 - DNA, 60305 bp, Human
gggtgacagagtgaaactgtgtctcaaaaaaaaaaaaaaaaaaaaaaaaaaaaaagagaaaaactccttaagaaggtctgagtatattctgaagctatgttcttctctctgcattgctacctgaggtccaaaccactgtcacctctttgcctgaatgattgcaaccggtttccaagtggcccctgctccccttcttatcctcttacccacctccattccccattttccaatcagagtactcctttttttttttttttttttaagatggagtctcactctgtcgcccaggctggagtgcagtggcgcggacttggctcactgcaacctctgcctcccaggttcaagcgattctcctgcctcagcatccagagtagctgggattacgttcgcccaccaccacacctggctaatttttgtatttttagtagagacggagtttcaccatgttggtcagggtggtctcaaactcctgacctcaagtgatccacccccctcagcctcccaaagtgctgggattacaggcatcagccactgtgccaagccccaaagtactctttaaaacatgcgtctcagcccaggtgtggtggctcatgcctgtaatcccaccactttgggaggttgcggcgggaggactgcttgagctcaggagtttgagaccagcctgggcaagacagtgagacttcatttctacaaaaaataaaaaaaaacttaggagggtgtggtggaacgtgcctgtagtcccagttaattgggaggcgaagcaggaggatcccttgagcctaggaggtcgaggcggcagtgagctgttatcgtgccactgtactccagcctgggtgacagatcaagactctgtctcaaaaaaaaaaaaaatcatctgaccatggagtcaatactcatatctatcaaagacctctcacagcacatggaatagaaaccaactcctcccctttctacaagaccctccatggtctgtcccctgcctccctcccaccctataatccttttactccattctggacactgagacagcctcatggtcttcgccagtgctgcttcctctgcttgaaacattctcctccagtcctcccagctgttccttcccattttccaggtcccagcattggctttggagccagcagcccacctgtgacaggagcctggctctgctcctagctggccgtgtgaccttgggcaagtcactggcttcttctgtgcttctgtttattgtgaaatgaggatgttaatgctaacgtatcccagaggatggtttcaagggttaaagaaaataaagcactagagagaggtctggcacttagtagggccatttcctcaatttggcttccttgacctctcaaagtatgtccccacagtcactttcctatcacccagttttcttcacagagcttggcagtgtgaagtaaccttggttattcaactttttttttttcccccaagacggagtcttcctctgtcacccaggctggagtgtagtggcaagatctcggctcactgcaacctctgcctcccgggttcaagcgattctcctgcctcagcctcctgagtagcagagattacaggcgcccgccaccacgcctggctaattttttgtatttttagtagagaccgagtttcaccacgttggccaggctggtctcgaactcgtgaccgcgtgatccacccgcctcggtctcccaaagtgctgggattacaggcgtgagcccccgcgcctggtcaactattttatgcaatcagtatttattatgctcctactatgtgccaggcactggttgtaactgccatctgattggacgatccgtaaacgctgaggcccagtctgtgcggttcacttgcgttcctccacgcgccccccagcacagtgggaagcacacagtaggtgctccgctctgctcctgtgccccgccccgcggcccctcccccgctccaggaagtgcgggggctccagccgcccggccggccgcgatgcattctggggaaggagcagcaccaaatccaagatggcggccagcaggaggctgatgaaggtaaaagccattctctggcagcggccgggcgtggggcggcgtcctaggctccggatccccgaggcaggcggcggcttctcagggcgctgccgtctggcttcctgccctacacggcctcgtcggttccctgggccgcgcgcaggctcaaggtgctaacggggctggcctaggccgcagcctgggcgggagcgcaaggccgcgctgggagccgctgtcggcccctcagcccggcccggggcgttcacgccactctccgcccggagcttggccgcgtccccctgtcgcggaggccgcggtccgatctgagggcgtcgttaatgtgagagcccggttgggaggctccaaaccgggcgccttcggggaaggcccgagcgccggagcccctgcccggagcccgcgccgcggaaccgccccgccctgggccgcagcgcgccgggcttgcagctccgcttggcccggccgcagctcgggagtctgggaggttcgggctaggaaagagagaaggaggccaggcggccaaagttaggtcagtttgttggtgggtcgtttggaattgcgctgggtcctagcaaactgtcgccttgtgactgcagagtcacacagcgggtaagttccaactccaggaaggcctgaggtcggccccgatcgcggcgcggttctgcttccctctcctccactcagtcatcccgatctcccctccctgataaagtgccatttttggggggataacggttgatttcagtcgttcgaatcaaaacgggccaaagtttataataataatttggtactttggatcttgaatgcagcagggtgctttctcgctaattggcaccttttggtgaggaacacatgctaaattggcttagtacttttgccagtggatttgccaaggtcctctgtagcccaccccgccagcatctgtgagtcggcggctgggtagtgctgccggcctgcaacgggccggaaattaaaaaaaggcccaggagccagtttcctgaggggagataaagagctggggttcgttctaggcggagcagtgcttggtagagctagacattgaacttggagccacagtctctgagcattccctccgtccctgggaacgtttcctttcttttgttccctaagggctagagaggacattaactttataaaactggagtggaagtgggcacaaaagaacagtcagaggacttcagacctctcctcatctcttaagctagtgacaccaccattcaccagataaggggtcggttaatggctttctttcctaccctactcccaggtgcagtcgtccattaacccttgtggatttaaatttagaaagatttctggagtgcaggccgggcgcgatggctcacgcctgtaatcccagcactcctgggaggccgaggcgggcggatcacttgaggtcaggagttcaagaccagcctggccaacatggtgaaaccctgtctctactaaaaatataaaaattagctgggcgtggttgcatttgcctgtaatctcagctacccgggaggctgaggtggaagagtcgcttgaacccggcaggtggaggttgcagtgagccaagtttgcaccactgcactccagccagggcgacagagtgagactccatgtcaaaaaaaaaaaaaaaaaaaagatttctggagtgcatgccttgctttctaatgttactgaaattactctgaatctatatcctcatctctcaggtgccctcccaagtgctctcctccccagactacccctgacggacaccagagttcttttaaagcagataactcaattctttcactcctgttaaaaacctctatggtgttattgtcctcagcagttaatcctaacctcttacttggcatgcaggacctttctgagactggctgaaagcaatcccttgagcctcacctcctgccctttggtttcccacagttcttgcacctaatcacagtagctactatttttccagcttttacttcgtgctttatatgcatgatcatgtttaatccttcctgtgaagtagacattgtgatttccattttgtcgatgagaaaagattctttggcttgcccagggttacctagctagggagagtgagttgtgatcgaattcggttctttctccaaagcaaagtctcctgctcttacttgctgtctgatgtccctttgcacgtgttgtttgctctacccaagaaaagctgccttctcctcacttctcccttccagagaagtcccaggttcaactccagtgccaactactctgtgagcccgtgctcccacatcccccttcagaatgtgttgtttcctcctttgtgtgaccacagcgctttctttatatttctctttgagcacttgtcacaatctctttgtgttacagacttgtctttcctgtactgggttctgagatcccgaagggcagggatcttgacctaattcatcctggtagccccctagcctatcccagttgacccagtttggaatctccaggctctcaggggtctaagaggggacttattatggttttaaaattattactctgtttctaaaaaaaaacagaccttggaaaaaaattgtaacattaactgagtatttattaagtattaggttatttacgtaagtcatcttttcaacactcaaagttagtgtattgtcatttgtattttttataaatgaggacattgtgaggttaagtaggttaagggagttacctaaggtagaattgtggaacgtggtggggagagagaagacgctgactcttcctggctccaggatccaaattccatgcctcttgtcaggctgtctttcttactcaaaggctgcatggagcggtgtgttgtttcttaagttgaggatggaaaggctttcagttcactaggggaacaccagttatgtaatgctgatcattggctgtgagaatcaatgtttaagactgttttttttttcttttaaaggaagaaaaattattgatacaagttgataaacagtcttttcagtacatagggtggtaataaagtgattttcgttggtgaaaagttggggcttagtgcatggaacagtgccttaggcatagcaatctagcaaatgttgaatgatcaaattaattacatcttaaagaactttagatttctgttaaaaatgttttctaggacattccacagcaaagatttctttgtaacaatggactgtctgcagatagtgtaaaacacattattaaaagtagagtgatttacatatactacactgagaagttattttaggcaaagtgagtatgataaagtcttttatttcaaaagcacttgccaggaggcttaacctcttttagaagcctttttaggaattacagtgttaataaaacattaagtacattttaatttgcaagcagctaatttagcattgttggctacaaccagattgtaaccattgcttcaatcaggatggggaaattgctgcaaaagccaaaagtgaaacctttatgtgtggcttaggcaactgattgccatctgatcatttctttgcagcttcacactgcacacatttcccctaagggccctcctgttgagtagcttcccagaagggcttttctcagaggggaaatctgtggatttagaggggtgtgtgtgtaatgtcttattacttatcatgacataactgttgagttaaggagtttcactcttgttgcccaggcttcagcgcgatggcacgatctctgtgcactacaacctctgcctcccaggttcaagcgattctcctgcctcagcctcccaagtagctgatactataggtgtgcaccaccactccctgctaattttgtattagaaaggaggtttcaccatgtttgccatgctggtctctaactcctaacctcaggtgatctgcccgccgaggcctcccgaagtgctgggattacaggtgtgagccactgcgcccagcctaatgctatttaaaaatgttcactcagaacttcatattgttatattttctcccagttcatagtcatagtaggaggaacctctaaaagttcattccttgggtttcgttgtattaagcagtgaggtagtttgcttttgagtataggtttagattctgaggttgggtgattaaggagatagagcaatgagtatgtcacatgtttcaggaggtgaggggagttttatatgtgatgttatgccagtgtaaatgtcctgaatccactgaggctttgtgaattgagaaaaacgttgcgtctttttttctaaattcatgcattccagtaagttgggactgtttcagcctcccttaatggtattctttgtaaatgtttgggacaggtgatgggaaggagtatactcaattattgcaacatttgggaccttttaaggtatttactagaaaactctgaggcaggccaggcgtggtgactcacacctgtaatcccagctctttgggaggccgaggtgggcggatcatgaggtcaggagttcgagaccagcctggccaacatagtgaaacccccgtctctactaaaaatccaaaaaattagctgggcgtggtggtgggtgcctgtaatcccagctactcgggaggctgaggcaggagaattgcttgaacccgggaggcagaggttgcggtgagccaagattgtgtcattgcattccagtgcgagactccgtctcaaaaaaaaaaaaaaaaaaaaagaaaaccctgagacaaaaactcttgtctcagggtactggggccttttctgatcttgttaaaactctaaattaggagactgttgctttaaaattttattataagaggacacttgaaagtattctcattttattggaacatttattacgtttaagatatttctatattctttgctacagcagtaaatgtgagagccacatttctttgcagcttcacactgcacacacactgcacacactgtgcacattagagagccacagagacgttcctcctgagccagactccaaccacttccagagttttcttgggaacggcacatagatctgtaggcatctgagtcttagctcctcctgtgactctctccctctggccccatgcatctcctcctgtcccaccttagttaatggttcacttgtctactcagttgctcaaggaaaaaacgccagcggagcccttctcggctcttcctcccttgtctagtcacctggcggattctgctgaactatgccttcagtctctcttctctgcctgtcttctctccatccccactcccactcccaatgccactgccactcccactgcctcagttcaggccatccctgtttgtggtagacacctgcatcgagctccttaatggttcatctaaactccttactggtcagcgcactctctgtcccacactactcctaaccagcagtgcatcagagtagtgtatggtgtggtgtgcagtagagaagtgcacatgagcaggccctgctctcagagattggagcagaatttagtagggtgaggatgaggctgggactctggattacaagtgcacattccttagctttttccttcaaggtcttgtctcaccagccttgtctctccccacttgcccgttgagtcccctaaaaacagcatgctttgcacacacactctggatctcgtgattggcatccctgtctcttctctgtaccagggtaactttttgacctttgagactcagctcaaggggcaattcctctgcccttgaggagctcaacaaaggagaaaaatggcacgtacctggaacaaagaaatcctgggctggccactgtgtgctagatgtctgccacctgaataatggcttgcaggagagggaaagaccccctctgacactgaggaggaggtcgaacttggcctggccctttaagcacgagtagggtttcagcagttgaagaagacggactgggtggccagtgaggttgagtctctctcatccctcaggagggctgtgggcagtgcctatgggaaatgctttgaggagccccagagaccatctgcctactccccagtgctgcttgcgtctgaccttgtgccgtcccgctttgggttttagttaggccagcccctgagatgctttccagaagtgttgaggcattggcttgattttaccccagattggcatgtccagtgcacctggttcctccagagctaggagacctccctctgccaggccagccttggagggtgagctacctctctatagaggggtcactgagggcagtgctgatggatttaaggacaggtggcagagatgccatagcctttaggttgaggggccagatctacatatctcctggatgctacagctatccaggagaagtggcatgccactcactcagaaagggctttgcatgtatctcctgtggccagcttcatcatgcctgttcttgggggacataaataagcctaacctccccaagccccccacccctataagaaagggaggaaggggcttttgctcagagcaaagctgtttagaggaagactacagcatagcagttaaaagctcaggttctggagtttcaatcctgggcctgccatgtcttagctgagtgaccctgggcaagttactttacctctctgtgccttagttacttcgtccgtgtgtgaaggttaaatgagttaatatataccaactgcttagaagagtgcctggcatatagtaagtgtgagctacttgtagatattattgggaataaccaagacatgttccagggcagggaggtgaccagcctgacaggaggggaggatttggaggagtgataggagatggtattgcaaaggtgttttcgggacaggttggggccagtctgcctggacataccctcatcactgagagcccattctcttacctgtggtactctcttattctgtaggttggagaaagagttactgagacagctgtgtgaatgtttgtttaaaaatgttggctgggggccaggcgcggtggctcatgcctgtaatcctagcaccttgggaggccgaggtgggcggatcatgaggtcaggagattgagacaatcctggccaacatggtgaaaacccatctctaccaaaaatacaaaaattaaccaggcctggtggtgcgtgcctgtaatcccagctactagggagggggaggcagaagaattgcttgaacctgagaggcagaggttgcagcgagctgagatcgtgccactgcactccagcctgggtgacagagtgagactctgtctcaaaaaatgttggcttggcgcagtagctcacacctgtaatcccagcactttgggaggctaaggcaggtggatcacttgaggtcaggagttcgagaccagcctggtcaacatggtgaaaccccgtctctactagaatcacaaaaaaattagctgggtgtggtggcatgtgcctgtaatcccagctactcgggaggctgaggcaggagaattgcttgaacccaggaggcagaggttgcagtgagccaagatcatgccactgcactctggcctgggcaacagagtaagactccatctcaaaaaaaaaaaaaaaaaaagaaaaggaaaaagaaaaatgtttacttggctgggcgtggtggctcatatccgaatcccagcactttgagaggtcaaggcgggtggatcacttgaggagaccagcatgggaaacatgacgaaaccccatctctactaaaaaaaaaaaaaaaaaaatacaaaaatcagccgagtgtggtggtgcatgcctgtaatcccagctactctggaggctgaggcaggagaatcgcttgaatccgggaggcggaggttgcagtgagctgagatggtgccactgcgctccagcctgggtgatagagcgagactctcgaaagaaaaaagagaaaagtttacttttcccaacaaagttgaatagcttttttttttttttttttttttttttttggagacggagtctcactctgtcacccaggctggagtgcagtggcaccatctcagctcactgcaacctctgcctcccatgttcaagccattcctcctgcctcagcctcccgagtagctggaactacagatatgcgccaccatacccggctgatttttgtatttttagtagagacggggtttctccatttcccaggctggtctcgaactcctgccctcaggcgatccacccaccttagcctcccaaaggattacaggcgtgagccactgtgcccagcttaaaattgaatagctcttgaactcaaaatttgtctttctaatatctcagaaatttaccttgcatattgtaaacatccagtgtagtgtgacagtcactgtgtccaaagatgagcataggtgctatggaaggctcccacaggtgctgaactggggcaggggtggaggtttgaaagcaactttttttttttttttttttgaggcggagtctcgctctttcacccaggctggagtacaatggtgtgatcttggttcactgcaacctccgcctcccgggttcaagcaattcttctgcctcagcctcctgagtagctgggattacaggcgcacgccaccacgcctggctaatttttgcatttttgtttttttttgttttttttttgagatggaatcttgctctggcgcccatgctggagtgcagtggtgcgatctcggctcactgcaagctccacctcccaggttcacgccattcttctgcctcagcctcccgagtagccaggactacaagtgcccgccaccatgcccagctaatttttttgtatttttagtagagacggggtttcaccatgttagtcaggatggtctcgatctcctgaccttatgatcctcctgcctcggtctcccaaagtgctgggattacaggcgtgagccaccatgcccggcccccaatttttgtatttttagtagagctggggtttcaccatgttggttaggctggtctcaaactcctgaccttgtgatccgcccacctcggcctcccaaaattctaggattacagatgtgagccactgcgcctggccgaaagcaactcttgattgagaagttgaggtctcagatgtaatattcttgcttcttgtcttctctttccttttttttttttttttttttgagacgcagtctcgctctgtcgcccaagctggagtgcagtggcacgatcttggctcactgcaaccttcacctctgggttcaagcaattctccctgcctcagcctcctgagtagctggaattacaggcgtgtgccaccatgcctggctaattttttttttttttttgagatggagtctcgctgtgttgcccaggctggagtgcagtggtacagtcttggctcactgaaagctccgcctcctgggttcacgccattctcctgcttcaccctctcgagtagctgggactacaggcgctcgccactacacccagctaatcttttgtatttttagtagaaacggggtttcaccatgttagccaggatggtctcgatctcctgacttcatgatccacccaccttggcctcccgaagtgctggtattacaggcgtgagccaccgtgcctggcctgatttttgcattttttagtagagacggggtttcatggtgttggccaggctggtcgtgaactcctaacctcaggtgatccgcctgcctcagcctcccaaatagctgggattacaggcgtgagctaccgcacccagcccttgtcttctctttcaaccttgaagcagaaagttaagaaagttgcttctggtggctgtgtagtttctccttctgacccttgctgcacacatactctagaattccagagctgtgtgagggatcttggaaagcagacaccagtggcctctgtttacagatgaggaggctgaagtcagtggtggagccaggcccaacatcaaggtcccctgctctctgggccttgctcctgctttttagatggttgcttttggtcttgaggaagggacaagatggagaagaagagggttcatttcagattcggtggctgtttgggttttgtttgttttggtttttaacacttccagggctgtgttgattatagttttctgtatttcactttcttgtcagattttgtccctactttcctagcataggtaggcagagcggggaacattctcttttgacagcccttatcccagcaggcacatctgcaaccaaagcaggtgctaatgtcaaagggctcatgggctaatgtcagggctcatgtgatgctccatctttctgagaggagaccacctgactcacggtgaggaagagggtgtaactcagaggttgaatagcctctgaacccgtctgagatggcttataaaaaagtgtttcacaccagcacgcctctcattaagaacagtcagcggccgggcacggtggctcaggcctgtaatctcagcactttgggaggctgaggtgggaggatcatgaggtcaagagatcgagaccatcctggctaacacagtgaaaccctgtctctactaaaaatacaaaaaaaaattagccgggcgtggtggtgggcgcctgtagtcccagctactcgggaggctgaggcaggagaatggtgtgaacccgggagtcggagcttgtagtgagccgggattgcgccactgcactccagcctgggtgacagagcaagactctgtctcgaaagaaaaaaaaaaaaaagaacagtcagcataagaaaacctaagcttcctgaaggattctccacgagttttacacaggcagttcccgtcgtgcccatttgtcctgtgtcaggctttgtgtggttgagtctgttgtggacagacttgaagaggtcggtgtcccagccctcaaggagctgtcagtctggtaggggggtgctggactctggagtttgtaatggaggtcaggaatgccaggcacacccatgtacagatggacacggaaacaccttccaggaatgaggcccggcagccagaagctggtgtcaaggcctgctgagttggagctttggccatgcttcccccatgcttactgtggaggttgtgggcagtgcgttcctctaagcctctgttgagtgttttctttgtcatgtcctcttagaatgaccacctgagaaggagtgtgctgtaacctctgagaagcactgtgctgtgatagagtaagagttcagatgtagatttctgcctttgactccttagtgttgtgcctttgagcctcagtgccctgatttgtccagcagatgatgagatgacttcataaagttatgatcatagctaagtgtattatttatttatttatttatttatttatttatttatttattttttgagatggagtttcactcttgtcacccaggctggagtgcaatggtgtgatctcggctcactgcaacctctgcctaccaggttcacgcaattctcctgcctcagcctcccgagtagctgggactacaggtgcccgccaccacgcctggctaatttttgtatttttagtagagacgggggtttcaccatgttggccaggatggtctcgaacttctgacctcaggttatccacctgcctcggcctcccaaagtgctgggattacaggcgtgagccaccatgcccagccccaggtgtaattagttatgatgataactaaatgtaagatagctaccatactgctgacctatggaagggatgatgtcttggcatgggtcctgcccccttagctaaatgttagttgaaatgagagaattgcattagaaggccatgaggcttatgtttagattttcagtatattgaattacatttaagtcatgatttagtggccaggcacggtggctcatgcctataatcccagcacttaggaaggctgaggcaggaggatcacttgagcctaggaatttgagaccagtctgcccaacatagtgagaccctgtctctgcaaaaaataaaatgattaactgggcatattggcacatgcctgtagtcgcagcttctcagaaggctgaggtgggaggatcacttgagctctggaggttgagactgcagtgagccgtgatcatgccactgcactccagcgtcggcaacaaagcaagaccctgtctcagggggaaaaaaaaaagtcatgattttagtgtcattgctaacggttgtcttatgcaagcttggaaagtttgcatttctgttacaattatttactttgatagaccagttatactggaatttggtagatttaaggcaggtttatgtaactttcctcagatgtccagctccatctgccaggttttgttttgcctgagcagtaggagcctagaaatattccttgcacaacacaggcacataatgactagctgtgcaggactagggaaaatactgaatatgttcatgtttttgttgatgtaaatattggtcaatactattccagagcaagctaagccctcctgggatcccacagagtaaacaggaaaacctgctctgtccgtttctaatgggagcattaactcactgctttgggtggctgagatagtcaaaaaagagcaatttcagtgcaggttctagtcctgggcatgctctatacaagttctttgacttggacatctctgagccttggctttaccatctgtgaaatggggctaatatgccccacttgcccatctcaggactatgaattgtaaacagtgcagaatggccttataattgaccacttcctctcaagccatggctacccctttcccagcatctctttgttttctgttcttgttggaattactcttttcttttctttcttctttttattttctttgagatagactctcactctgttgcccaggctggagtgcagtggcgcgatctcggcttactgcagcctctgcctcctgagttaaagcagttctcctgccttagcctcccgagtagttgggactacaggcatgtgccaccatgcctggctaagttttttgtatttttagtagagacagggtttcaccatgttgttcaggctggtctcgaactcctgaccttgtgatccccccacctcagcctcccaaaatgcgggattacaggtgtgagccattgtaccggacttaatttttgtatttttagtagagatggagtttcaccatgttggccaggctggcctcgaactcctgacctcatatgatctgccggcctcagcctcccaaagtgccgggattacagacatgagccaccatgcctggcctcttttcttcaagagacaaggtcttgctccgttgcccaggctggagtgcagtggcatgatcataactcattataactcattataacctcgaattcctgggctcaaaggatcgtcctgcctcagcctcttgggtagctgggactacaggtgtgtgccaccatgcccggctaatttttttttttttttttgagatggagtctcaccctgttgcccaggctggagtgcagtggtgcaatcttggcttattgcaacctctgcctcccaggttcaaacaattctcccacctcagccccccaagtagctgaagactataggtgaacactaccatgcacagctaatttttgcattttttggtagagatggggttttgccatgttttccaggctagtctgaaacccctgggctcaagcagtccacctgccttggcttcccaaagtgctgggatttgagccaccatgcctggccattttgttatccttattatttgtagagatgggatcttgctatgttgcctaggctggtcttgaactcctggcctcaagcgatcctcctaccttgacttcccaaaatgctgggattataggtgtgagccactgtgctggccggtgttcacttaaaggaaaaaaaaaccttcaggctgggcacggtggctcacacttgtaatcccagcactttgggaggcctagatgggcagatcacctgaggtcgggagttcgagaccagcctgaccaacatgaataaacccctgactctactgaaaatacaaaattagccgggcatggtggcgggcgcctgtaatcccagctgctcgggagtctgaggcaggagaatcacttgaacctgggaggcgggggttgtggtgagccaagatcacaacattgcactccaacctgggcaacaatagtgtaactgtctcaaaaaaaaaagaaaaaaaaattcagaacaagctgtgcccagtagctcatgcctataatcccaccactttgggaggctgaggcaggtggatcacctgaggtcaggagttccagaccagcctggccaacatggcaaaaccccatgtctactgaaaaaaaaaaacaaaaataattagccaggcatggtggcacctgcctgtagtcccagctactcaggaggctgaggcaggagaatcgcttgaacctgggaggcggaggttgcagcgagccaagatcgcaccactgcactccagtctgggtgacagagtgagacttcatctcaaaaaaaaaaacaaaaaaacaaacaaaaaaaaaaacagttcagaacaacgtctgggtttcggtgcttatagacttgtagtcagagggattttttccatgtgcttagctcagtgggaggttttagtccttttaggagcttgtttctagctgtagaaatgacactgcattcatcaaggctccagttttttccttgccaagaaactgggtggtatgaatgtggtgggtttttttttgttgttgttttttttttttgcgatggagtctcgctctgtcacccaggctggagtgcagtggtgcaatctcggtctactgcaacctctgcctcccaggttcaggctgttctcctacctcagcctcccaagtagctgggattacaggcatgcatcatgactcctggctaatttttgtagttttttgttttttgagacggagtttcactattgttgcccagcctggagtgcaatggcgcgatctcggctcactgcaacctctgcctcatgggttcaagtaattctcctgcctcagccacccgagtagctgggattacaggcgcttgccaccacgcccagttaatttttgtatttttagtagagacgaggtttcaccatgttggccaggctgctgttgaactcctgacctcaggttccacctgcctcagcctcccaaagtgctgggattacaggcgtgagccaccgtgcccggccctcaatatggtgattcttaagcagagcaggggttgcacatcacagtcatctgggagcactcccctcagaaaggtacccatcttgtactggaggctgatgcaataagcaggtcctagatggcgcctaggcacagtcagctctccttccttctcccctgtacccatctaagcccttcccctgcctctctgcataggggtattaaacagcccccaggggcttggccatgcaccctggctgaaagttctggccctgatcatgagtgccctgagttggtaaacactgcagctaaactggtttcctttctgcttccctaacgcccccactgatttctgccctccatgtctctgcatacacatttcccacacatggacacctgttctctagcagttctgtcttcccccgtctttcaaggcccatctcagagcctgtcttccacaaagctgttccctccactggtgtctgctagactttcctcactgtgacctaaaggttcctagagcagcgtttctcagttcttttaacccaccctcaacagccaagaaaagtggccttaagctttactttcctttagggatactacaggccttttgccatttaacagatataaaatgacacagtggtatggaatatgcttgtttacattgtaccagtgtccttgcattgagacttgctgcccatagtactgctgtgacatctgaagcatccctgactggccccactggttattcttctgcacgtctgttcacctgctcctggcactgacttcagaggagactcaagagggtgtatagtacagtcttgcccagtgcaggtggcttctttctgacagccctggccactggcagccctgtctgccccacccatttgagtatctataatgacatgacgactgctgccccgagtcaggggggcttagaccacgtgaaggtagcattaaagagtttggcactgagtcaaaagctgcctgggatagtgaacacttactggccccaattctttcttctttactcatatagaaggttgaatcctttgcaggtgaactttttaaattttaattttttttttcttctgaggtggagtttcactcgttgcccaggccggagttcaatggagcgatcttggctcactgcaacctcctgcctcctgggttcaagcgattctcctgcctcagcctcctgagtagctgggattacaggcgtgtgccaccatgctgggctaattttgtatttttagtagagacggggtttctccatgttggtcaggctggtctcgaactcccgacctcaggtgatccgcccgccttggcctcccaaagtgctgggattacaggcatgagccaccgtgtctggcctaaatttttttttttttttttgagacagagtctcgctctgtcacccaggctggagtgcagtggggtgatctcagctcactgcaacctccacctcccgggttcaagcgattcttctgccttagcctcccgagtagctgggactacaggtgtcaccaccacgcctggctaatttttgtatttttagtagagatggggtttcaccatattggccaggctggtgttgaactcctgaccttgtgttctgcctgccttggcctcccaaagtgctggaattacaggcgtgagccaccacacccggcctcggcctaaattttaaattttaagttttattttatttttatttttttgagacaaggtctcactctgtcacccagactggagtgcagtggcatgatcatgggctcaggcaatccttccgcttcattttttaatttttttgtagagatgaggtcttactgtgtggcccaggctggtctccaactcctggcctcaagtgattttcccgcttcggcaacccaaagtgctgggattacaggagcactttgggaggccgaggcgggtggatcccttgaggttaggagttggagaccagcctggccaacatggcaaaaccccatctctactaaaaatacaaaaatgagctgggcatggtggtgcgtgcctgtagccccagctactcaggaggctgaggcataagaagcacttgagcctgggaggcggaggttggagtgagctgagatcacgcctccacactccagcctggagagcgagactccgtctcaaaacaaacaaacaaaaaacaacaaaatgtggaattactggcataagccacttcgtccaaccagcaggtgaactttttaacgtttgaagacagatgtatgtcatcttcacatttctttaggccataggttcctggaccttttgattgttcctggtaggacatggtccttgctgttcttgtcctgagcagcccttatttgatgtggtcttctaaagtatggtgtccagaactggacacagcatttggctctgaatagttcagggtggcctggacgctaaacatggcacaaacgattggtcagctaaaccagtcagtttttcatgctgctgctaaggttcatgccttgtgcttggtgaaaaattaagtgtttggaaccaagtccaggtctttactggatctctaaaatatttcattctgtgacttggggtgtggttttgctatccaggatccttagaggtttggtctttaagcctgtattcgttccttccctgatatgtggtacctaactacatctctctcagcccacttcccaccagggtgacttcaggccaccagttctaaagccattcgattctcctcagctcttcttgatccagcctctgtttatccattttgtacagaaacattgtagtggctgttgagagaaaggagcatcccttttagccagggcttggggagctccttagaggaacaggcatttgagagaggctttcaatgatgagcatgttggggatgtggggctggtgataggcaggacagttagggacatccttccagaagacatcctggggaaagacatagaggggggaagtcaccaggctgacttggtaggattctgcacactgctcatttgggttgcaccaagagctttagttggaattactgggttgcaccaaagagttttagctggaaatattggatgggaggattcctacatattttgttgggggaagggtcgtctagtgctgttggatttcttttctagtttttctttttttgagacagggtcttgctctgttgaccaggctggagtgtagtggcaccatcatggctcactgcagcctcaaccttttggactcaactggtcatcccaagtcagcctcctgagtagctgggaccacaggcatacatcaacacacctggctaattttttaatttttttatttttgtagagatagggtcttgctgtattgcccaggctggtcttgagttcctgtgcttaagtgatcctcctgccttgaccacccagtgttgggattacgggtgtgagccaccgcccctggctcctggcctagatttattttatttattttattttgttgagacggagtctcactctgggagtctgcacccaggctggagtgcactggcgtgatctcagctcactgcaacctccacttcccaggttcaagcgattctcctgcctcagcctcccgagtagctgagactatatataggtgcacgccaccatgcccagctaatttttgtatttttagtagagatgaggtttcaccttgttggccgggctggttctcaaactcctgacctcaagtgatccgcccacctcggcctcccaaagtgctgggattacaggcttgagccactgcacccagccttttttttttttttttaaacggagtcttgctctgtcacccaggctcaagtgcagtggtgtgattgcagcttaccacaacctccacctcccggattccagtgattctccaacctcaccctcccaagtagctgggaatacaggagtcaaccaccatgcccggctaatttttgtatttttagtagagacagtgttttaccatgtcggccaggctgctctcaaactcctgtcctcaagtgatccacccgcctcagcctcccagagtgttgaagcgttggaattacaggtgtgagccactgtgcccggccttttttttttttttttttttttaagataggttctcgctctgtcgcccaggctggagttggagtacaatggtgtgatcttggctcacggcaacctctgtctcacttgttcaagcaattctcatgcctcagcctcccgagtagctggaactacaggcatgcacccctatgcctggctaatttttgtatttttagtagagatggggtttcaccatgtcagccaggctggtctcaaactcctggcctcaagtgatccacctgctttggcctcccaaaatgctgggattacaggcatgaaccaccacgcctggcgctggcatagattccttttttttttgagacgaagtcttgctctgtcaccaggctggagtgcagtggcgcgatctcggctcactgcaacctccgactccctggttcaagctattctcctgcctcagcctcccgagtagccgggactacaggcaggcgccaccatgtccacctaatttttgtatttttagtagagacggggtttcaccatgtggtctcgatctcctgacctcgtgatccacccgccttggcctcccaaagtgctgggattacaggtgtgagccaccgcgcctcgcctagatttcttgattagtggctcctgaggggttctgaaacctggccttgtgtgagggttacctggggagattttgaacagttttctaggcctcattgtagaccccaaaaagaagcaaaagaggaactttgttaactgctttgccaagacgcaggtgtgtacatctgagctgtgtgactgagcactggctatatacagcagtgtcctgttctcccatctcctctcaggacttgagtccgtggccttctgctggggcccagggcccatctctcctgttagtgcttgcaaagctgttaagtaaccatccctctctgccatgcttcacactttgccctggagtgggcatcaagctctctggggttgagtttggggcatgggtgttttccattttcaggagctgggtggcacccctgggctttttcagttcccctctatacactgaagtctacttgggctccgaagtggacctcattctgagaagcattgctctctttctcctgcaccacctgccctggttgggaagcctgctgtccccatcaagagaaggaatgtgtgagctgcctggtgctttcccttgaactctctctttgtcagcactgcaccatcagccctgagcagctgacttgggttgcttcttgctctgagcagaactgaaacaaacctttgtgggagtgttatttgtaagcatctgtcattcttggctttggtcttcctaactctgttctagagctgggctgctcttgcggtttttatcaggtcctttcttctgtcatttgtaacatccttttgaattccacttcttggaatttacattggtttccttcaattccttccctaattcttcactgtcaggaccattctcagttatcggggcacagttttgcttgagggtttacaaccatcttgagggtttgagtcatctggccttttgagtctcagatattcagatggaactgatctctgaatgattccaatttttcttctttcttttttttttttttttttttttgagatagggtctcactctagttgccctggctggagtgcagtggttgtaatcttgactcactgcacagccttgactgccagggctcaggtgattcttccgctttcacctctcagcctcccaagtagctgggaccacaggcatgtaccaccatgcctggctacttttttttattttttatttttatttatttatttttgagacagagtcttgctctgtcactcaggctggagtgcagtggcgcaatcttggctcactacaacctccgcctcctgggttcaagcagttctctgcctcagcctcccaagtagctgggattataggtgcctgccaccacgcccggctaattttttgtatttttagtagagacggggtttcaccatcttggccaggctggtcttgaactcctgacctcgtgatctacctgccttggcctcttaaagtgttgggattacaggcgtgagccactgcacccgggctgtattttttttagtggagacagtgttttgccatgttggccaggctggtcttgaattcctgggctcaagcagtctgcctgccttggcctcccaaaatgctgggattacaggtgtgaaccactgcgcctggcctgaatttatcttcttgaagttgttttcctcagtggaggcatgattggaatttttttttttttttttttttgagacggagtctcgctctgtcacccaggctggagtgcagtggcgcaatcttggctgactgcaagctctgcctcctgggttcacgcctttctcctgcctcagcctcccgagtagctgggactacaggcgcccgccaccatgcccggctaattttttttgtatttttaatagagacggggtttcaccatgttagccaggatggtcttgatctcctgacctcgtgatccgcccacctcggcctcccgaaatgctgggattacaggcgtgaaccactgcgcccggcatgattggcattttgggctaaatagtttctgtccacaggaccgtcttgtgcagtgcaggtcttttagcatcctggccactcatagtgcccgtggttctcagtagaagctgtagaggatgttgggaaattggggtgggttggtcacagtgcctggcatctgtctcagggtaagggcttgggaggctcaagtgcagagtcgtatctggatgccagcaacaccctgttgagaaactttctactatggtatgctcatcattctctgaagatgtcagggcctgtttgtttgtttgcctgtttctctcacttttgccttataatcagttcttccttgttggttagaatcatgtaaaggaggttgccttttctgtctttggagagcttaacttgacggcaaggtaagttgggagtttatgtgataaccctacttaggattctctgagcttcccaaccctgctgtcattagcatcctcagggttgcccattcttctttctggccaggtgtgtggctcactcccatggcagtatttcttttatctttgtctgtggatcccctggatctccttgataccaaagcaccagtaagtgtcctttctgcacccctgcccttagtgctcctcactgactgcttcctctcctttttcttgagcaagatacagtttttcactctcatgttacagttgagttccatcttgccatatttttataattcttgtgaaatttaccttgtgtttatcatccctactttatttttttatttttttattttttcgagacagagtttcgctcttttcgcccaagctggagtgcagtggtgcgatcttagttcactgcaacctctgcctcccgggttcgagcgattctcctgcctcagcctcccgagtagctgggattacaagcgcccaccaccacacccggctgatttttgtgtttttagtagagatggggtttcgccatgttggccaggcttgtctcgaactcctgacctcaggtgatccacccaccttggcttcccaaagtgttgggattacaggcgtgagccaacgcactcagccatcacccatactttatactgttggagtgtggatttctgaaaccataaagtatatttacagatgattttaaaatttgttttgtcccataaatgttagatatcttcactgttgtttcttctttttttagttgtctagtttcaaagttctgtgtggcatatttttttcctatctgtatttggtttaaaacattttgtttgctaggactccagccttaagggacgtgcatggtataccctgtccttagccaagaatcttactctagtatcttgagccaaggtcaaaaaagccaaacacagcattggaactgtatttatagaaaatccttcccaccccagattcctttttcctcccaaagccccagcttcccatccacccaccaacctggtcattaagcacatgtttgagcaccactgtgagccaggcgctggcaggaccagggcttcctgatccctgcccttgttgagcttacattctatttggagagtggaaggaggtggcagtgtgggtgtgagatctcttcccctttctgagtctgcccaggcttcataatccccaggggagcatttcttatgagtcttgtgagcaggaggaccaggtggcagttggcaggttggagtggtccctcaggttccgtacctccttatgcagggaaagaggggcctcatgcaggtggagaggggccaggccaccccattcctcactgcaggaggttgcagcccatgccgctaacgcctcctcagggagaaatggatccatcatcgctcccagcagtgcctcttctctcaccacagctatagcctgtgagaaatccctatgttcaggctccacccacacttgctggaccagaatttctggggctgggcccaagtccaggtgattgtggtgggcagatgagggtgacaggcaggagcaccctgtggggggaaacttgtgcctgttgcctgctatgaagcaccagtgtgttccacctcttccgtgtattcattcactgcactctccctctctgctgctctgggccgggcgcccagcacatcttcctactcagaaccagtaacctgggctccggttcccccttccttgccaattgtttccttccctgcctgtgtagcctcagggtgccttttaaactaccactgtgtgatggaagtatgaggtgcaaggatcttttgggcttgatgtgggggctgatagggagcccccaagccactgtgagttgaagtaccacgtaaggaggttctggagggtgctggagctgggccagaggaagcagcctggcgaaggaggcagggctcagctggatggtgctcgggctgcagaagagaaggtgcctgacaggtgtggaggcggcttttgtgccactggatgggaggccgggctgaggcgggtagagtggcacttcatgtgtcagagtggaggaatgttggcgaggctggtgttctggcaggagggcattgctgggtggtttgggttatagcgcctgccaggcattcactgagatgttggaggcaatgggaaatgtcaggctggtgcacagttgaaaaacaggtgacagacagttctgaagacatctcaggcaggaccctgaagtcgtaaagttgtgctttctgggtgaaatggcacttgctgcattgactgtttatacaacaataaccccacatatttgcaaggggtcctgttgcccacaacatggcttccctttccttttctgcactctgggtctgttttgcagctgaggaaacaggctcagtgaaggtttcccgtccccacccccccactcccaccccagtcccagactggatggttctctttgctgtgtgcccatgttgaggtggagtccttctgaaatcacacttatagcactgggtagaaaactggatatgcgtttgtgtctggtttgttcccagtccccagttttattcatctttagcttctcagcatccggtgcataatcagtgcttaatgaatcttgattggaaggtatcaggtgtagagcacctcaggatagctcctgccacatgtctgccctatgcagggtgctgagggatttaaacagccatggtgaccaacccaaagaggaggtggtacgtctgcagaagcatggttccccctgtcctattcaggggggttcactgaggtgggggcttgtcttggtctggggcatggggagaggcaacaaccttgcagaggggaccgccatggcagctccatgcctccttaaccactccaagcacagtttagtcctcactgtccaattttgtcattagcatttttggcacttggtttaatttgagggcatcaggagggatcttaatatgtggtgctttcccctatttgacacccctttatgctttgtcaatcaacaggagcttgaagaaatccgcaaatgtgggatgaaaaacttccgtaacatccaggttgatgaagctaatttattgacttggcaagggcttattgttcctgtgagtattgaacacttccacttcctaccagattattctttaaggtgatgtgtgtgctgttgggcttgtttttctgctccttagtaggctcttagtctaggcagccagcagatgcacagaagtggctgtcgctctagggtgataaggtagggagtgtagccttgggtcctgagtagagtcacatcttggcactcgttttgtcaaattcagggagtcctgagctttgcagatctgtagacacagagaaaaggagtgtgtctgtgctcctgctctttcctgacttccctgcgcctggcctgatggatcagcaggaccttcttctctgagctcctcaggaggggacaagcattcccctctagatattttgctttctctcttggttttgcattcatgtctctaaccctttggatacctgtatttcgggctttattcctggtcccctccaacctgtgccttccatttgtctcaagtcccttttcctaattgcccacatgttcccctcaccccatgtcttttctggggcttatgcctccagtgtctgcccccacagcccagctcccccatctcacagtcttctgccttctgatgggctcaaggccctcctaacgatggctttccttagcaccctcttagtgcctactcttttctgcatcctttgatcccctccccttcaagaggcttgtcttataattaactccagtttgcaatcccccttcctctcactctcctgaaaccacgtcacacccagcccacaggctgcccccactgttgtcacacctctagctcggcagtgctggcatcatggcccttgcttgcctcctgagcttttggagcacgggcagcattccagcccccagtcctgtgaccagcctgccactcgctcctgttctgccactccttcctcctcactcttaaacatgactcttgttggtctcctgctgttctcctgttctgttttgtctcgggaccctactactttcggcatcatagatgattatgccagacatgaaggattcccacacctgtctccattcctgccttctccccggaagctgcaccatctgtccaccaggcggcctcacttggtcattgtgtagccttcagctacctcagctcacacccttgtcctgcgtgagtgccctcctttcctgttcttcctcatccactcaccttctctgttccttttcattcccactttgcacatctgagcctctggcccttgccctgtgcctgccgctgtcctgtatataatttgttctcatggatggattggctgctttgccaaagcagagcatggagcatgcttcctcctgtagatgcttcttcctgatgctggttataaggtcatgagcatggagcatgcttcctcctgtagatgcttcctcctgtagatgatttctccctgtagatgctttcttcctgatgctggttataaggtgagcatggagcatgcttcctcctgtagatgctttcttcttgatgctggttataaggtgagcatggagcatgctccctcctgtagatgctttcttcttgatgctggttataaggtcatgcttttttttttttaagtccctgaatttgatcagcagttattggatttgtagtttatttccataatcatttggataactaaggaaagatatgctttgtaatgatttagtatgctcagaatgtttaaatctgggagcttccagtctgattttgaagatgagtcctttagatttctttaggcttgatggtgttagggctcagggcaaagggtgtgggtggcagagacacctctgcatgggaggggttggcctgtgagtgcagcccttgcctactctagggacctgaagatggccgggaccatctgacctcttgtcccttttctaattgagattgtgtagtctactgagcaaagaaatgaacagttaatctgtggctctttggaaaatgataaaaatgaatggaatggttttaagtggtaaggcttgggcagtctggccctgagaatttagtggcctgagagcctgctagccagctccacgggtagattgctgctgggcatgctctgccccaactcatgcaaaggcctccctctggtttcacgctggcaggggctatggagcagtgggctaagatcttactagggcaaaggtggaggctggctggtagaatccaagtgtgcttgggctgaggctctggggagctatccaggccaaagtttcaccttggagacggtaagcaacagccagggctgctcttgtccctgtgtataccacttcttctcggtcctctcccttgctttcttccagggcccctgggtttgtatgaggaatgtttcaatgaagtcttcttccttctccagagcagttaaggcattgttgacatctgacatccccagggtccacacttgtaccccaacctgggctttaggtcttcctgcattggacgggctgggccagcatgggaatctactatacaaactcacctgaggtctgcccagttggggtaaaagtagagccaggccgatgaaggcatggcagcccagccctggtccttagtggagagtggtgctgtccttgggtagccacctagcgattgccctggtcgtagtgcacagaggagggcaggtgggagggaaggctggggaggtacttcctagagacttcattgttgccaacgcaactctggtctattccctttaaacatttgtttttctgtaattttttttcatctaagatgctaaggtaacgtctaaggaagaaaatattacccataatcacatcatcaagaaattcagttacattttgtgtactgccctttaggaactagaggtgtggtagtcacccttcttgaagcttctagcccagtgaatgtgtttactcttaaccttcagcatacttcctctcagccttttttcatgcagtttcttttttttctttttaattgagttggagtctcgctctgtcgctatgcagtggcacgatctcggctcactgcaacctccgcctcccgggttcaagcgattctcctgcctcagcctcccaagtagctgggactacaggtgcgcaccaccacaccccgctaatttttgtatttttagtaaagacggggtttcaccatgttggccaggatggtctcagtctcttgaccttgtgatccaccctcctcagtctcccaaagtgctgggattacaagcgtgagccaccacgctggccttcatgcagtttttaataaaccatttcataacttcataataatgttttggttttttgaggcagggttttgtgctgtcacccaggctagggtgcagtggtgtgatcatggcccattgcagccttgaatttctgggctcaagcaatcctcctgagtagccaggactacaggtgtgtgccaccacacccagccaatttctttttattttattccattttattttattttttgagacagtcttactctgtcacccaggctggagtgcaatggtgtgattttggttcactgcaacctcagcctcctgggttcaagtgatgcttatacatcagcctcccgagtagctgggattgcaggtgtgcaccaccatgcccagctaatttttgttcttgtttttgagacagagccttgctctgttgcccaggctggggagtgcagttatgcgatctcggctctctgcaacctccatctcccgggttcaagcaattttggctaatttttgtacttttagtagagactgggtttctccatgttggtcaggctggtctcgaactcccgacctcaggtgatccacccatctcagcctctcaaagtgctgggattataggcataagccattgcgcccatcctgtaacgtcttaaatttccactacaaaggttccagttcatccacatccttgctaacatttgttattttactttttttttgtttttacgttacagccattctagttggtatgtagtgctgtctcattgtggttttgatttctgttttcttcatactaaggatgtagaacatgtttttgcatggtgtgttttttgtttttttgtttctttttgagacagggtctcactctgttgcccaggccagaatgcagaagcacagtctcgtctcactgcaacctctgcctcccgggttcaagtgattctcccacctcagcctcccgagtagctgggactataggcgtgcaccaccacacctggctaatttttgtattttttggtagagacagggttttaccatgttggccaggctggtctcgaactcctgacctcaagtgatctgtccgcctcagcctaccaaagtgctgggattacaggcttgagccaccgtgcctggcctgatgcactaaagttttaaattttttaatttaatttttatttttagagaaggggtcttgctctgtcatccaggctggagtgcagtggctcaataatggctctctgcagccccagactcctgggctcaagcagtcttcccaagtagctggcactataggcacatgctgcaacccccagctaattttaattattttttctgtagagatggagtcttgctgtgttgcccaggctagtcttgaactcccaggctcaagtggtcctcctggcttagcctctgaaagctctgggatttacagatgtgagccatcacacctggccttaaatttttaataaagaagtccaatttatctatttttaattttgttgcctatactttggtttgatttttaagacactgttgccaaatccaaggtcatgcaaattttcctgagttttcttctaagagttttatagttttagctcttaaatttggatctttgatccatttatatgtagattttttttttttttttttttttttttttttgagacaggctctcgttctgttgcccaggctggagtacagtggcatgatcatggctcaccacagcctcaacctcccaggctcaagcgatcctcccacctcagcctccagagtagctggtactgaaggcatgagccaccacgcccagctaatttttgtatttttttttttttttttgtagagatggggttttgccatattgcacaggctggtcttgaactcctagactcaagtgatccgcctgccttagcctcccaaagtgctgggattacaccactatgccctgcctcatttcttattttaataatatgagtcttttctctttttccttttatcagtctagctaaagttttttcaattttgttgatctcttcaaggaaggtttcattaatgtgtgtgtgtgtgtttttcatttatctcctctgtgcttactatttacttctttcttgtgttattactttctttgttccttaaaatatccagttagattattgatttcagacttgctttttcaatgtaggtatttaaagctgtagattccctttgagcactacttttgctgcataacttaagttttggtatgtcatttttttttctgaggatattttctaatttcccttgtgatttcttctttgacccattgcttgttagagagtacgtttaatttccccataattgtgagttttctagttctgttattgatttctagttccctttccttctccctttccctttccttttttttttttttttttaaataaatagagatgggggctgggtgcagtggctcacacctatattcccagcatgttgggaggctggggtggaaggatcgattgagcctaggagttcaaaaccagcttgggcaatatagcaggaccccgtctctattttattaaaataataataataataaatgggttctccctgtgttgcccaggctggtctcaaactcctgggctcaagcgatcctcctgcctcagcctcccaaagtgctggaattacaagcatgagccaccatgcccccacccgcctagttccatttcttttttttttgagacagagtcactctgtctcccaggctggagtgcagtggtgtgatctcagctcactacagcctctacctcctgggttcaagcaatcttttgcctcagcctccctggcagctggggctacaggcatacaccaccacgctcggctaattcttttgtatttttagtagacacagggtttcgccatgttggccaggctggtcttgaactcctggcctctttcacctttttgcagttacatttgtagttagacctctcaccttctttctgcaagcttatttgcacagcagttgctcctaaaatccacgccctccggatgcctcattcctcctttctgcattgcccctctggcctttgatgggagctgcatcctgcctccctgggctcagcacttgcctgtaattgtcagttcttttctgcttcctgctaattgtgccactctgccttctctctcccctacttccgtctcctgtagctgtaatggttgagaccaatgagggcagccctgttttctgagggcacactggagttgttttggggagaaagagtatccccctacattgatggggctgttgagctcctatcacagccagacacaaggttctatggacagaggccacagagaagccaccctcctggaatccatggtctcttaagcactgagtgtggctccacctgcaaggcacttaagaccaaacagaagcagggcagcggtgggtgggagggtgacaatatctggactgcatagtggaaggcagtgtgagcagaaactatgaaaaaatataggcagtgtgaggacatatgtgtagtttgcatagatgtacagaaattaaggcctttgagagcaccatgtatgcacagagaacgttcttgggctgtgcagcagaggcctgacggcatcctggggaatggggtgtctggtgggattttttgtttgttttgtttttttcacttctatttttggtgtgagtgctgtattttttccattcttgggagaaaagtgaattatgtatgagaagtactcatggctatttgagcccaaaaggaaggaatggtctttgtcaaattcggttaatggagattgtgattttaattgtagatacaattcagaaggtagtttatgaacattatgaaatgaaagattggaaaaccagttctaaaatacttattcctggccgggcgcggtggctcatgccagtaatcccagcactttgggaggccgaggcaagtggatcacctgaggtcaggagtttgagaccagcctgtccaatgtggcaaaaccccgtctctactaaaaatacaaaaaattagccgggcctggtggtgggcgcctgtaatcccagcaatttgggaggctcagccaggagaatcgcttgaaccggggaggtggaggttgcggtgagctgagatcgtgccattgtgttccagcctgggcaacaagagcaaaactccatctaaaaaaacaaaacaaaacaaaacaaacaaaaaaacttattcctactatttacttccaaagggaatacgattgaactctttagtgttgaagtatttgttgccggccgggtgcagtggctcatgcctgtaatcccagcactttgggaggccaggggaggcggatcacttgaggtcgggagttcaagaccagcctggccaacatggcaaaaccccatctctactaaaaatataaaaattagccgggcgtggtggcaggcatctgtaatctcagatactagagaggctgaggcaggagaattacttgaacccaggaggcggaggccgcagtgagccaagatcgcgccactgcactccagcctgggcgacagagtgagactccatctcaaaaaaaaggaaatatttgttgccaaagaactgtattatgaaaaatccccaaaaccaagttgttgaaaacagtacaaagaagtcatcttcagaaaccaatattagaacaagatgaatctcatgtggcagattttttgattcaaataaccaaaaagcctgttttcagaagagacaataaatacttaaaggcaaggagggacgtggtggctgacacctgtaatcccagcactttgtggggctgaggagggtggatcacctgaggccaggattttgcgaccagcctggccaacatgatgaaaccctatctctactaaaaatacaaaaaattagctgggtgtggcggcaggtgcctgtagtcccagctacttgggaggcagaggcaggagaattgcttgaacccaggaggtggaggttgcagtgagctgagatcgcgtcattgcactccagcctcggtgacagagcgagactctttcaaagaaaaatcaatcaatcaatcaatcatacttaaaggcaatttacaaagttaagttcttgtgactttcgaacatggagtaaggacatattccatgttcagaagtcacaagaacttaacctcctaaacttaactcttttgggtttttttgtttttttgtttttgagacagagtctctctcgtcccccaggctggagtgcagtggtgtgatctcagctcactgcaacctctgtttcatgggttcaagtgattctcctgcctcagcctcctaagtagctgggattacaggcgtgtaccactacgcctggctaatttttttgtatttttagtagagatgggatttcaccatgttggtcaggctggtcttgaactcctgacttcaagtgatccactcacctcagcatcccaaagtgctgggattataggtatgagccactgtgcctggcctaactcagctcttgacaaggttccagagtggatcacgaaggcttgagagcatagaaaccagcctggggcagggccaggcacggtggctcactcacgcctgtaatcccagcactttgggaggctgaggcaggcgggtcacgaggtcaggagatcgagaccatcctggctaacacggtgaaaccctgtctctactaaaaatacaaaaaaattagccgggcgtggtggtgggcgcctgtagtcccagctactctggaggttgaggcaggagaatggcgtgaacccgggaggcggagcttgcagtgagccgagattgcgccactgaactccagcctcagcgacagagactccatctcaaaaaaaaaaaaaaaaaagacaaaccagcctggggcactccgagcagggcaagccgcgtccccttgttctctcttaacaggggactggactgtgtagggataggcagcccacagggctggtctcagtagacatccctgtggcagggaaagcttcagctttgttagttcactgggtgaaaaaggttagccacagggaaaggatgctgctgtggagtcgccaccaagctaggcagaagtgacaacagtgcacaggacccttcagtccatctgaagcctggcatgaagaaggagcagcatgctagttagatccaaactaggatccagctcttcaggtcagccatgagtcctgtctgtggtgtcctacagccagctaggaacacaccacaaggacgtgccatgtagcagcagtccaagtcagacaaccagaagacaccttgacttcctctgtggctgccagagagctgtatggtggtcttccctgcttcacagcagtgacatgaaacggtgacttctgtgggatgaaggactctgggtctttacttgggaagggaaaacatgaagtggaatggggttttaggattcttgaaaggttgccatgggaaaggaagattagatttgaccacagggttagagctaggacaagtgggtgaaagaccccagatagttcggtgccatatggcaaagagcttcctcttagtcttagctgccacaaaatggctttgtgccatgggaggttgatatcaagagctgtgaaggatctgagatttttaccctacttgcagcctgaaaaggtgtcctgccaatttattggatgttggtggaagactcgagaaaagggccagttcccctcgtccccgcatcccacaaaggtgatgaggatgggcccagatggatacctgcagatgtggggggttgtgttccgggacaggaaggctgagtttaggggaggtctcaggccagtcactcaatcgtacttcacttgctccatttccaaatgcaagtgatggcagcactggcttcccagggttggtgttaggggaccaggaggggcggaatatgggctggagatggcacggaaaagcacctggcatctaagtacttgagaaactttggtcaaatttttttaaattggctttcccaggttgaaatgatcaactcttatttacatgcatgcattataatgactagaagcaaatacaggaaaatgttagccatactatatataaaagaaaatccactttaaaaccggtatctttctttctttataaatagcaagtgggccgggtgcggtggctcacacctgtaatcccagcactttggaaggccgaggcaggcggatcacctgaggtcaggagttcgagaccagcctggccaacatggtgaaaccttgtctctagtaaaaatacaaaaaaattagctgagagttgtggtgcatgcctgtagtcccagctacttgggagggtgaggcaggagaatcgcttgaactcaggaggtggaggctgcagtgaaccgagatcgtgccattgcactcctgcctgggtgacagagcgagactctgtcttaaaaaaaaaaaaaaaaaaaaaaaagacaagtgggctggtcgccgtggctcacgcctgtaatcccagcactttgggaggctgaggcgggcggatcatgaggtcaggagatcgaaaccatcctggttaacacggtgaaaccccgtctctactaaaaacacaaaaaattagccgggtgtggtggtgggtgcctgtagtcctagctactcgggaggctgaggcaggagaatgatatgagaggcagagcttgcagtgagccgagattgcgccactgcactccagcctgggcgacagagccagactctgtctcaaaaaaaaaaagacaagtggataaaaagtctgtcctagaatttagacatggattgaaaaggtgttttttgattttttttttttttttttttttctgagacagggtctcactcttgccgaggctggaatgcagtggtgtaatcatagctcactgcagcctcaaactcctgggcttaagcaatcctcccacctcggccttccaaagtgctggagtttaagtttttgaactagtttagagtgtgtaaaattatcataaggaattaatttacatctcaaatgacttcctcaatacagcagtatgagcttagggagcacaagacagtcaaaggcaggcataacagaaaaacactagtcgtgttcatgtgaagataatgctgaaatcagctgggcgtagtggctcacgcctgtaatcctagcactttgggaggctgacttgggtggatttttgagctcaggagttcaagaccatcctgggcaacacggtgaaaccccgtctctactaaaatacaaaaaattagccggacgtggcagcctgcgcctgtaatcccagctacttgggaggctgagagacaggacaatcgtttgaacccgggaggcggaggttgcagtgctgagatcccaccattacactccagcctgggcaagcgtgagactctatctctaaataaatagataatgctaaaatctttggtttatttgacattgaaatgttgcagcttaagttggaggcaaattttctgcaatgttttataatatatatattttttacaacaaaaccatgttttttcattaacatcccttgttatttctgagtggccttcccaaagggcaagtttagctctaatgttgaaattcacttgtagagctgtaggcctttacccggaaggtatatcttatgttttaatttttgcatgcctctttcaccaaaaatctctgggacaggcacatagtttgtgtgacttatgcacacctgagccactcctttgaccatccacagatccccagactaggaaagaggcccagagaagttcagatgagtttggccaagttccctgggtggtgagaggcctggcctgcctcatgtagtaacagaactgcttcttttttttccttcctctttttggaagaaaaaagaggcaggatctcactgtcttgtccaggctggaaggcagtggcgtgatcatggctcactacagccttaacaactaacaacttaaaactatagcctcaagcagtcctcctacctcagcctcctgagtggctgggactacaggtgtgcaccagcagcacgcacagctaatttaaaaaaattgttagcaacaaagtgagatcctgtctttacaaaaggacttgtttttgttttgttttgtttttttgagagaacaccttgctctatcgcctaggcaggagtgcagtggtgcagtcttggctcactgcagcggtgtgatcttggctcactgcagccggtgcctcctgggttcaaccagttctcatgcctcagcctcctgagtagatgtgattacaggtgcgtgccaccacgcccagctaattttttgtatttttagtagagacagagtttcaccgtgttagccaggatggtctcgatctcctgatctcgtgatccacctgcctcggcctttttttagtatagatagggtttcttttttttctttttctttttctttttgagatggattttcacttttgttgcccaggctggagtgcaatggcacaatctcagctcaccacaacctctgtctcccaggttcaagtgattctcctgcctcagcctcccaagtagctgggattacaggcatgtgccaccacgcctggctaatttttgtatttttagtagaaacggggtttcaccatgttggccaggcttgtctcaaactcctggcctcaagtgatctgcacatttcagcctcccaaagtgttgggattacaggcatgagccactgcgcccagtctgtttttggcttttttgagacaggttctcattctgtcacccaggctagagtgtagaggtgtgatcatggctcactgcagcctcagcctcctgggctcttgtgatcctcctgccttagcctcccaaagtgttgggattacgggcatgagccactgcacccagccaaatctgcttctcttgagctttgcccatgtgtcaggcatgtaggactttatagtccttatctctcatcataaactctgggtacaggctgttgctactcccattttacagatgtacaggaacattctcagactctttaagctaggaagaggcaaagtctgaggctagacctgctaacttggggccagatggcctcattcatgcttcaccccagctcctcggacaggacctggcccacagtggggaacaggggaggttggtcagtcctggacaatcagtgaagacctttagcagatttcaccaaccaaaagtcatgcaggaaagtgcgcgcgcgcgcgtgtgtgtggtatgtgtgtgtgtgtgtggtgtgtgtgtgtgtgtcttactctgttgcccaggctggagtgcagtggcacaatcttggctcactgcaacctctgcctcccaggttcaagtgattctcctggctcagcctcccagtgtgccaccacacccagtgagggaaagctatttttacatggctcaagcagtgtaaatgacaatgatgtttacttacttccccccaccaccaccaccatttaattctcctcttgaaaactaaaagctggctgggtatggtgcatcactcctataatcccagcactccagcactttgggaggatcacttgaactcaggagtttgaggccagcctggacaacatagtgagacgccatcactataagaaataaaaaaatagctgagtgtggtggcatatgcctgtagtcccagctacttgggaggctgaggtgggaggattgctagagcccgggaagtcaaggctgcagtgaaccgtgattgcacctctgcactccagcctgggtgactccccacagatgaatatgctgacagtggtttcagctgctcggtggtgattcagacctggacgcgtggcttcagtagccctggggccacactgcctgcccgcagcctcctgtcttgctctatgctattccttccaagtccctgccatctagtctttagtcctctctgcctgggaggcctcttccactcctcagccttatgtcatcttatccatcctttaaggcccttgctccatgcctcccctcccagggcagggcttggatgtaggagaatgtggagaactggcgcacgccagccttgctccccagcagaggagctctgtttactggagtgcgtacttaggccacggcttgaagatatggggctggggtgtagggctgtcaagattgttcctggggccaggtgcagtagttcactcctgtaatcccaacactttgggaggccgaggccggcagttcacctgaggtcaggagttcaagaccaggctggccaacatggtgaaaccccatctctactaaaaatacaaaaaaaaaaaaattagtcgggcagggtagcgggtacctgtaatcccagctacttaggaggctgaggtgggagaattgcatgaaccagggaggcagaggttgcagtgagctgagatcgcgccactgcactccagcctgggcgacagagcgagactccgtcttaaaaaaaaaaaaaaaaaaaaaaagattgttcttgggctctctgtgaagcttggatttctttgggttgggtgtgccatggcaagtgccatggcagacctgggtgagggaaaagggagtacaatgggaagggcttccccagctctggagataggtagggttggggagaggccaaaagactctttgctgagtcatctctcaggctcctggggccatcagagtgtccaggccccaaaggtggttttcgggtggttctaggggcaaggggctagggcatggtgctggccctgcctggtgatcacctgttgagtgaccagctcaggtccccagggtccagccattgagctgactactgtttctaccctgggaagattgagctggccaggacttggcatcaaggcagttatttggacttctagtactcacagtgtattctggttgggttgtaacttacctctggtacaactctacttgtatcttcagaaaagatcaagagatatttgcaaaaacataatatgataaaggactgtctaaaggacaaagaacacttaaaactctataataagaaaacaacaataaataacaccgtgcatctcttagaatgaccaaaatccagaacactgccaaatgctgctgaggacgtagagcaacaggaactctcgctctttcctggtgggaatgcaaaatggtgcagccaccttggaagacaagttaggcggtttctttcatttatttattcataaaatctttttaacaaagaaattgagtctctctcttgcccaaaatggagtgcagaagcgtgatcacagctcattgcattctcaaactcctgggcctaagaagtccacccttcttagcctctgaagtagctgagactacaggcacatgccaccatgccaggccaatatatttattttgttattattttttgagatggaatcttgctctgtcacccaggctggagtgtagtggcgcaacctcagttcactgcaatctctgcctcccgggtttaagcaattctcctacctcagcctcccaagtagctggactacaggcgtgcaccactacgctctgctaatttttttgtatttttagtagagacagggttttaccacgttggccaggctggtcttgaactcctgacctcaagtgatctacccagcttagcctcccaaagtgctgggattacaggtgtgagccactgagcctggcccaggctaatatatttaatttttttttttttttttttttgtagagatggggtcttgttatgtttcacaaactggtcttgaactcccggcctcaagtgatcctccctccctggcctcccacagtgctcagattacagacatgagtcactgctcctggcccagtttggcagttttgttttgttttttttttgagactcagtctcgctctttcgtccaggccagactgcagtggcgcaatctccactcactgcaagctccgcttcccaggttcacaccattctcctgcctcagcctcctgagtagctgggactacaggcgcccaccaccacgtccagctaatttttttttgtatttttagtagagacggggtttcactgtgttagccaggatggtctcgatctcctgacctcgtgatccacctgccttggcctcccaaagtgctgggattacaggcgtgagccaccgcgcccggccggcagtttcttacaaaactaaacatatgtcttaccattggatccagcaattacattccttggtatttagccaaatgaattgaaaacttgtatccacacagatgcttataacagctttattcattaattgctaaggtttgaaagcaaccaagatgtccttcagtgggttaatggataaataaattgtggtatatctagacaaatgacattcaacactaagaagaaatgagtctgggtgcagtggctcacacctgtaatcctagtactttgggaggccgagacaggcagatctcttgagcccaggagtttgagaccaacctggacaacatagcaaaacccagtctctataaaaatacaaaaaaattagctgggggtggtggtgcctatctgtagtctcagctacttgggaggctgaggtgggaggattgcttgagcctgtgaagtcaaggttgcaatgagccaagatcacgccaccatccagtgggcaacagagcaagaccctgtcaaaaataaataagtaagtatgaagtgggggaaaaacaagtaacggctgggcacagtggctcacgcttataaaccctgcattttgggaggccgaggcaggcagatcacttgaggtcaggagttcaagaccagcctggccaacatggtgaaaccgcatgtctactaaagatacaaaaattagctgggcattgaggcgggtgcctgtaatcccagctacttgggaggctgaagcaggagaattgcttgaacccaggaggcggaggttgcggtgagccaagatcgtgccattgcattctagcctgggcaacagactctgaaaaaataataataataaaaagaacaaatagcttctaacgacaaatttatttctcacttattgaggctgggaagtctgaagatcaaggtgccaacagattcagtggcaactgagggccggcttcatggtttatagatggtgccttttcactgtgtctttatatgatggaaagggcaaggcagttctcaggggcctctttgataaggacaccaatcccatcatgacctaatcacttcccaatggtcccaactcctaataccatcacattggtgattaggtttcaacataagatttttggggagatacattcagacatagcagctacatattgcatgattccagctatcatgtctgataaccacacaaaacctatagaatgtgcaacaccaagtatgagccctaacataaactagggaagctgagtggtaatgatgtgttaaggtaaaaggttcattggtggtaacaaatttgcccctctggtgagggatgctgatagtgggaaaagctgtgtgtgttcaggggcagggggtatttaggaattctctgtcctttcctctcagttttgctgtatacctaaaggtgttctaaaaagtaaagtctattttttaaaaaagtatgaagagaccaggacatcaatctcaagccccttctcagtttagcagatagcttgctctagaaatacttttgggtggctgggttgtcctgaaggtggcagggcttcagttgatacttgaatcccttgaaataaattgatttttcagataaacaattaaaacattcctgtcttggccataggtttatgaaccatggtgtgttcattttgatctctctttccttccaggacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaaggtaagacatgtgcctgtgtcttcctcggagggggtctttgggggtgctgctctggggtgggggcttctggtaccagatcagacagaatccagagaatctttcaggtacacgaaaaatgtagctgaggtcctgtcagaccttgtgggaatggctcatctcagctgaacttttgacctgtatagggtttgaggaggcctttccagtgctcagccctgggctgccatccacagtgggaacacacatggacagacaagcccagtggcttgctgctggtgcagagaggtgcaggcactggtccctggaagggatgaaggactgtggggctgcctacaaggggaagggagagtgggatttaaggtggcctcatgcagtagttagtgcctgaactcagacttgaaggaggaaaggaggttggagagggccttccaggctataggaagggcatgggctagagcctagttgctcgggtgatgtgaggggagggacagaggcagatgtaagggcagtattcccagatgaaggcacgtagttggctttagtgggcctgggattccctggagttggatgtggctgtgcgtggtgcacatgtctgtgtgtggctgtgtgaacataaacatgctcattcttctgggaagaatatttgagtcagtattgtggttgtcctcccttttgtcccctagaagtgactagtttgttatggactgtgtctggttttcatttaattctagactttcttttgaagtcctaatctcatattttgatggcttccttttaagtacctaaaccagtataaagtctgtttagattagagtggatgaagctggcacttgagaggctgcaagtggagggtttcttttaggggtgctgctctagggtaggggctcatgggtccttcctgatgccagatcagacggagtccagagaactcctaccttaccaggtgcacgcaaagtatggctgaggtgccaccagtccctgtgggaataactcagctgaacttttgacctgcacagggattgaggaggtcccttgttttagtgattgaaaaaagccttggaaggtggagttcaaagccttgcgcaagaaaaatcaagcctcacttgttggaagtaatcaccatgaaaggtgcccattagactcccacactgagtagaagaaaggagtgggtgctaaacattcagtcagggcagaacagtctctagtgggcttggtccttgtttgtgtacaagctgatgtttataaaagcttgacacagttcttctcagtgcctggttttttcttttcttttcttttcttttttggaaacggagtctcgctctgtcaccaggctggagtgcagtggcgcgatctctgctcactgcaacctccgcctcccgagttcgcgccattctcctgcctcagccttccgagtagctgggactacaggcacccgccaccacgcccggctaattttttgtatttttagtagagacggggtttcaccatgttagccaggatggtctcgatctcctgacctcgtgatccgcccgcctcggcctcccaaagtgctgggattacaggcgtaagccaccgcacccagccgattttttcttttcttttcttttttttttttttttttttttttttttgagacggagtcacccaggctggagtgcagtgatgccatcccagatcactgtaacctccgcctcccgggttcaagcaattctcctgcctcagcctcctgagtagctgggattacagccaccacgctcggctaatttttgtatttgtagtagagacggggtttcaccacgttgaccaggctggtctcgaactcctgacattaggtgatccacctgcctcagcctcccaaagtgctgggattacaggcatgagccatcatgcccggcgagcctggtttttttctgtacagattcctagcactgtcgaaaacctatagctgcatttgatcaagagtgttcagtaattcctggagtccttgccgagtcatgtctgttaacccatcgtgcctggggagtggcagtccttccaggccaggttgcccaggaaagccctgcacctcaggttctggccacaaagagttctgaggctcctcccttacctgtagactgagagggtggggctagggccagggaggctctcaggagatggatgcacgtgctttgccacctctcatggggctgctgcatagaaggccgtggcagggttattcactttttaccttcctatccaggtgcactgccaaaatgctctgctttttcagactgtggctgcttctcccccacccccaagagccaaataacttaggggcagcttttaatttttttttgtaaaaagtactgttgacttgggatttttaaggtaaaaattttggtacaggagctattctgtgtgccatgatggacagaactggaattgctattttgtgatttgggacagttgaggattccttcctagaacattattatgtagattgtttgtggcatggccttgatccccatcctcacatacatcaagaatgttgttccttgcacttgacggccacattcccatgtttgttatctattactgcattataacccctatcaaaactttgtggcttaaagtaataccagtttattagtttttactctggaggttggctgggcttagctacatggttctacagctgactgttcattcctggggtcactcatgcagctgtattgaggtgggaactcaacttggctgggaagagctggtaggcatagtgcacatgtgcggaaatggtattagctaaggcacttcggttctctttgtgttctcttattttccacaaggctacattggaccccttcatagcatggtggtctcagggttccagggtgaaggcatagaactggtacggtgtcacttctgtggattcttttggtcaggcaagtccagatttaatgagagggaaaatagacttcagctcttgatgggaggagtatgcaggatgggagacatgatggcagaggtgggacaggcaggcaaggttgctgagtccccttgctgcctcctcaggcccacttgggcctgcttttcccaaatggcagctcctctggacatgccattccttctcccacctgcctgattcttcatatgttgggtgtccctgtttttctggtgctatttcctgactgctgttcagctgccactgtcctgcaaagcctgcctttttaaatgcctcaccattccttcatttgtttcttaaatatgggaagtgaaagtgccacctgaggccgggcacagtggctcacgcctgtaatcccagcattttgggaggctggggcaggcagattgcttgagccaaggagtttgagaccagcctgaggaacatggtgaaaccccgtctgtaccaaaaaaaaaaaaagaaagaaagaaagggaaaaagccacttgtgccaccctcctgctgtaatcttccagcgctcttcctttgtctccagagcacctgctcatgatttttgtctcctgcccttgtccttagaaacttcagcgttcccaattatggcttctctcagatccagccttgaagttctttgacctcctcaattcacaacctgtagctgactttagccacccacaagtacagaaaagtaagcataatggaagaaatagtaatatgaaaagatgctcatatgacccagcaattccactcttagctatatctacccaagagaaatgaaaacatatgcccaataaaaacttgtacacagatgttcatagcaccattattcacaatggataagaagtgaaaagagcccaaatgtccatcaattggtgagtgaataaacaaaatgtgagccaggcgtggtggctcacgcctgtaatcccagcactttgggaggctgaggcgggtggatcacctgaggtccggagttcaagaccagcctggccaacatggtgaaaccctgtctctactaaaaatacaaaaaattagctgggtgtggtggcgggcgcctgtaatcccagctacatgggaggctgaagctggagaatcacttgaacctgggaggcagaggttgcagtgagccaagattgtgccattgcactccagcctgggcaacaagagccaaactccgtctcaaaacaaaacaaaacaaacaacaaaaaatggtgtatctctacaatgaaatattatttagccataaaaagcaatgaagtactgtcttatggtacataaaccttgaaaatatgctaaatgggccgggcgcggtggctcacgcctgtagtcccagcactttgggaggccaaggcgggcagatcacaaggtcaggagattgagaccatcctggctaacatggtgaaaccctgtctttactaaaaataaaaaaaattagccgagcttggtggcaggcgcctgtagtcccagctactcgggaggctgaggcaggagaatggcgtgaacctgggaggcggagattgcagtgagccgagatcacgccactgcactccagcctgggcgacagagcaagactccgtctcaaaaaaaaaaaaaaagaaagaaaatatgctaaatgaaagaaccatccatggaaggccacatattgtatgattccatttgtagttgagcctcattgttcatagagtctgcgtttgcgaatttgcctactcactaaagttttttgtagccccaaaatcaatactctcggcactcgtctatcacagatgtgtgcgtgtgcagagcagcaaaaaatttgaagtaccccatgcacgtgttccagctgaggttgtgtggttgaacagtgcgatgccctgccttcttgtttcagctctcaactgaagcaagtgggctgtctaatgccaaacttcttggattttgtgctttttgttggtgattttgctttggccccaaacgtggtgctgaagtgctgtctagtattcctgagcacagaaggtcatgatatgccttttggagaaaatacatgtgtgagataagctttatttgggcatgagttatagtgctgctgagtcaatattacctattaaataaggtgtctttaaacacacataaaacaaagttatatattaatcagctggcaaaaatgtgagcagaggcttgtttgaacctaaacctctgtttcccttaggagcaatgattcagtatcattaattcaatgttcatggcaagtttatagaacataagcactacagataaaattcagctgtatatgggatgctcagactagggtggatccattgagacaaagtagattagtgattgtcagggtctaggaggaggagaataggaagtgactactgagagtgggttttctttttgggggatgaaaatgttccaggctgggcgtggtgggtcacgcctgtaatcccagcactttgggaggccgaggtgggcggatcacaaggtcaagagatccagaccatcctggccaacgtggtgaaaccccgtccctactaaaaatacaaaaaaaattagctgggcacggtggcgtgcacctgtagtcccagctactcaggaagctgaggcaggagaatcacttgaacccgagaggcggaggttgcagtgagctgagatcacgctactgcactccagcctgggtgacagagtgagagcgagactccatctccaaaaaaaaaaaaaaaaattagccaggcgtggtgacaggcacctgtaatcccagctacttggggggcaaaaaaacaaaacaaaacaccccccccctttttttaaagcacattccatggaaggctacaacattgcatatctttttgggttgaaggtacattgacattttattctttgacaatgaagctccctggatttttatgaaaaggaggggaaatcacaaatattgtttacatccgctattgcagagaaactgtcattaagaacaaaagggccaggcacggtggctcatgtctgtaatcccagcactttgggaggccgaggcgggcagatcacgaggtcaggagatcgagaccatcctggctaacacggtgaaaccccgtctctactaaaaacaccaaaaattagccgggcgtggttgcgggcacctgtagtcccagctgctgccactgcactccagcctgggcaacagagcgaaactctgtcttaaaaaaaaaaaaaaaaaaagaaaaggaacaaaaggaaggaaatattataggctttattctctgatgagaatatagtgagagtaaaaggtaaaattggctaatttgttgtgtgggttttttgttttttgttttttgttggggggacagagtctcactttgtcacccaggctggagtgcagtggcataatcttggctcattgcaacctccgcctcctggattcaagcatttctcctccctcagcctcccgagtagctgggactacaggcgcatgccaccacacctggctagttttttgtattttagtagagacaaggtttcaccatattgcccaggctggtcttgaactcctgagctcagacagtctgcccacttcggcttcccaaagtgctagggttacaagtgtgagctgctgcgcccggcctgttgtatgtttttaagcccctacattttgcagaaaaaaaaagtacttctgaggagcatttgggtcatggaagagaccaagaacccagggctggatgttttataaaatataattttaatatgctgtcctatatatgaaaaatgttgatagagggccacagttgtaatttgtaaagcagacaatctgtcaggtgttcttactagcaaaataagttcagctcagctgaagtttattatagtttagctaaggagccagaaatgcacccaggggaacagcgaaagaatgaaatacttatcagaactactaagtaaatttaaaaatactcagacttgaggccgggcatggtggctcatgcctgtaatcccagcactttgggaggatgagatgggtggatcatgaggtcaggagatcaagaccatcctgggtaacatggtgaaaccccatctttactaaaattacaaagaattagcaaggcgtggtggcggatgcctgtagtcccagctactggggaagttgaggcaggagaatcccttgaacccaggaggtggaggtttcagtgagctgagattgtgccactgcactccagcctgggcgacagagtgagacgccatctcaattaaaaaaaaaattcagacttgatcaaattagtgaaactataaaaaataacgaaatagacaaatggcatcttttgagaaataggtctttaaatttttattttgccaggtgcagtggctcacgcctgtaatccagcactttgggaggcggaggcaggtggatcacgaggtcaggagatcgagaccatcctggctaacacggtgaaaccccgtctctactaaaaaattacagaaaattagccgggcatggtggcaggtgcctgtaatcccactacccgggaggctgaggcaggagaatggcatgagcctgggaggcggagcttgcagtgagccgagattgtgagctgtgattgtgccactaactcagcctgggcgacagagcgagactccatctcaaaaaatatatatatatattattttttttttgcgatagggtcttgctgtgtcactcaggctgagtatagtggcacaatcacagctcactacagcctcaatattgtgggctcaagcaatcatcccacctcagcctcccaaggagctgggactacaggcatgtgccaccacaaccggctaattttattttttattttttgtagaggccaggtcttgctatgttgcccaggccagtctcagactcctggcctcaagtgatccttcctccttggcctcccaaagtgctgggaatacaggtgtgagccaccaacctctgcattagttaccaaggtgatgatagtgagaagtagagagcctaagtattcatatcagagagtgaggtgaaaactcctgagcgtgcccctaacgaagtactcagcctgtccttagcccagtgaggtttctaaaatgctaatgcggtagtaattctcctgttacagggccatttctaatcatgggaaaggaaggggagccacctatttgtgctcttaggcgactgtggctcaatttccagccctgaagtcaagaacagccaggaaaagggagcagtctcacaccgagggtggtgtgcactgaaatacactgtggccagtcagccaagggtgggcttcgtttattaaataaataaataaatgtttattaaataaaaatatacctccagggcctgctgcctctagaggtacaggtggcttgtacagggaggtgataccacctacccctgaagaggcttagagactgaattagaggccaccctggcctgcagagagctttccaggccccttgcccctgcttgctgttcacagtccaccctccttgcccatccacccccaacaaacgtggaacctgtcagcattgcatgcgcaatgccctcctcgcctctgccccactgcttcacctctacccactgtggtcacaggagccctctctttcccattctcaccaggcacagtaaaaagcagaggttaggcaggtgggttttggacaccaggccaggagtactttgtgctgtggccctcacttaatgtgtgctgttgaatgattatgcctttgcatatgactcagccagcatcagcattttgttttatttatttacttttgagacagagtctcgctctgttgcccaagctagagtgcagtggcacgatctcggctcactgcaactgccgtctcccgggttcaagcgattctcctgcctcagcctcctgagtagctgggactctaggcatgggccaccatgcctggctaatttttgtatttttagtagagacggggtttcaccatgttgcccaggctggtcttgagctcctgacctcaggtgatctgcctggctagcatttgcattttaatccatttcttgtaatgctgaatgaacaatatgagcccttaataaaggaattgaccaggtgcagtggcttcatgcctgtcatcctagcacttttgggaggatgaggcggtaggatcactcaagcccaggagtttgagaccagcctgggcaacatagtgagaccccatctctacaaaaaactaggccaggagcagtggctaacacccgtaatcccaactactctcaaggccaaggtgggaggattgtttgagcccaggagataagactgcagtgagctgtgattgcaccactgtactctagcctaggttaaaaaaaaaaattagctggacgtgatggcatgtgcttgtagtctcagctactcaggaagctgaggcaggaggatcatttacacccaggagtttgagggtaccgtgcagtaaagtatgattgagccactgcactccagtctgagtgacagcaagactgtctaaaaaaaataagaaggaatttgtggcatcagcagttcggagaagaggggcactgttttacagtgggaaggaacattctgagggtgctggtcctgacagggtcagggggcaactgtggcaaagtatgtgaggaggtgtgggtagcagctgcttctgattccccactatccttccaccctggggcacgtctgggctacggcacctagggggagtactgtggcacccatcagagccatcagcgtgacatctgcctgtggtcttgacaatgtgatgcgatggcggttgtcagcttcccattggctggccccagtgaccctttctagagggttcagaaactcctaagggtcttccagagttgggtcattgcgcattgacaagtgcagcgccatcacatacccttctctctagtgcccactcagtcaccttaaccgaaacttccctgagccgagcatggtgctgggtgctgggctgatgcagggaagttctacccggtcctgccctgaagaaagtgaccctgtgtgcatgcatgagagtgagcagtcagttcaatactaggcctcctatctccagagtacacaagaggactggattagccgggcatggtggtgcacgactgtagtcctggctacttgggggactgaggctggaggattgcttgaggtcaacccaggaggttgaggctgcagtgagccaagatggtgccactgcactgcagcctaggtgacagagtgagaccctgtccctcctccccaaccccccgccaagaaaaaagggctgggagtgactgagggctaagacctccccaggtgttaggtcaggaaggcttcctggaggcggaagcacatcactgtgaacaattatccactgtagtgttagctatttgttgtccatcagtgtcttctaatcacagaggaaagatgagttttctggcagtcagaattttggataaataggaggcagctttggcttaaaagcacattagctgtaaatcagttgtaaagccagagttttgttcccggattagctgcctcttgcctgtgccatttctgagactgtgttaaccccccatgccttgtccttctcttggcagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactggttagtcgtgtgggtttcttccttcctgggagcgggcagtgccaggggcctatgctcttggagatgggagggctggctggggcccaggtcctggggcttctgatctctctccccattcccagcctctccaaaagaggtacatagaagtgttcctgcctccctagagggaaggagatgaggtataatcagcaagaaagccggagacttcagacagtcggggcctgcagagggcgctcttgggcgtctcgttgaggggacagggactaaagtgtgggtgcatcacttacatgcgtgggtcatcctggagcctcctgggagtgttaacaatccatgtttagaagaggcaaacctgcggtcccaagaggtcacagaattgataagggtgtgcctgtgggtggagctgggccatgtccatgaatggtgccagccagaaacactctgagtccccagtacagcccactgccagggtgctgcggcagtggtgctaactcagcaagggctcagccagacccaggacttttttggctaggccttccctgcctggaatttgacaccagctgagactaggcctgcactgttcagctggatctgcaggtcttggggaaggaaacttcttggggtgtcattttactagcctttaacatacctagcactttaccctctgagtctcaggagagccctgtggcatccttatccctgcttttaaagacaaccaagacccctggcctgtttttgttcacattctgactgcagagcctgttgcattccaccatttggcatatttcttcccacagggtccctctgagcccagaaacagccagttaccaccctccccagagccagagacctttaagcccctctgtcaacttcctcttccctacagccaccagccaccatttttggccttgttcactattaattgttcagcatgaaataagcatccatttcatcactcctgtacccgctgcagcctgacttctgtcacctgctgccccttgctgcttctcctttcatttggtgccatctaacccagccctgaaagaagccagagctgctctcagcatttcccaccctgtcctgcctggctcttccttctctctctgcttcctggatatggcatgggggaaccgggcaccaacccagaacagaggggagctgagggtaccattgctcccagtgcagtgcagtgcctagcctggtccatgcctggtaagtggccatttcccagattattggaacgtgttcttgttcatagagggcccctagggaaccctggaggcctcagaggatcagagtagaaaggaccaccgtgcagaggcgataactgaggccttgggaaggaagtcacttccagagagcattccccacccggtgctggccaggttcagaaacccccctgtggctccacatgttgccgtgggtttctcctacatcttcctctgtgtgtcactggatgacactggatgactgtccctgtatgtaccagactgggagctccttgcagaccaggccatgtcagctccagccctggcctagcacagagtggaccctccagacacgaatgccgagtgggcggataacagtgaaccgcttggctaagacactgttgctgcccccacagcccctgtggcccaccagtcaccaccccaacaggtccttatcactttcacctcctcgtgagatgggcctcattataatcaggtgggcctgattatcctaccagtctatgccccctcacttcagtttttttttttttttttttttttgagtcaggctcactctgtcacccaggctagagtgcagtggcatgatcactgctccctgcagcctctacctcccaggctgagtcgatcctcctatctctgcctcctgagtagatggaactacaggcttgtgtcactacacccggctaatttttgtattttttatagagacagggttttggcatgttacacagtctggtctcaatctgctagcctcaagccttcctcccgactcagc

SEQ ID NO: 15792 - DNA, 4525 bp, Human
caaaggtcctgggtcagtgaagcctgtgaaacaaagttgggaccagagtgtctctacggttgagggctgggcttatttgctctctaagtataattgtaagagcaaatagaaacacctatcctctctgagcttaaaaggatcaaaaagctctgacagtgtcagtggtagggctagttcaggggctgcagtagtgctggtgcccacaggtggaaccttctcctgccctgattcccaaggactggtgctctcggaggggtctgggaggtatatttctctttcacaaatacgtgcacaacacatgaatgagctactggatgagggaataaatgaatgaatgagtgaaaaaagcttcctttctcctctccaggagttagcaatcactggttagttccccactgcccaccagcctgtgcagaggagggaggagcaacaggtcatagatgtggttgcagctgttactggacagagtggtcaagacatcctgtgtctgcagaggccctccccagccctcacctggacagtggagctgttggccagagaggcagtgggaagaagggtggggctcccagagtcgacccagcgggctgaaactggtgcagtctgcgcctcaccaggcagagaatggatgtggggcagcttgacaccgagcaggggctcatctgagcctcaggggtggttgctctatcaaagtgtttgcaagtaaacagtcccagtgcacacccagctgctcagtgccacctcgtgcacccagggccacttcagccttgatcacaggcctgcacaggttccaggggaggagacactccagctttttgagggagggtgagcatgtgggatcagagactttaagtccaaatttccccttaatttttttttaaatcttgcaggtagtatgcaaacatacatttaatgtattatttttattctcattttttttttgaggcagggtctccctctgttggccaggctggagggcagtggcgagatcttggcttgctgcagcctcaactcaacctcccaagctcaagtgattttcccacctcagcctcccaagtagttgggactgcaggtgcctgtccgccatgaccagctaatttttaaattttttttgtagagatggggttttgccatgttgctcaggctagactcgaactcctgagctcaagtgatcctcccaccttggcctcccaaagtgctgggattataggtgtgagacactgcatccggctcccaaatttcccctttttataaggacaccagttgtactgaccggggccccacctctatgacctcatctaaccttcattaactccttaaaggccctatctccaaatacaggcacactgggggttagggcttcaacctatggatttgggggatgcaattcagtctatcacagtgccaagctgcacctgctcggtgagccagaacaggggtggggaaggcaccaggccctggtgcttctttcccatgcctgagtcactctacttggttctaggagggagaggagcatgggctgaaggcagtgctgcaacatggaaggggcagaacatcccaacccgctctgggcccccagtgtcttctgctgtacaaagcaggtgttttcaccccccgaggatgtgtcctcccttcctggctcaccaagcatttaaatgtagacagaaaatttatttatctggggtgcggtttcctcagggggaagttgaggtcacgacccctgaggtaccttaacccaaaggcctccagggcactggccccagagtctccagcaggtgcttcctccctgaatgcttccatatggcaagatcagagccacaaatgctgccccgacgctgttccggtaaccgacgttgcagacccaagaaagtctgggatggtagtggccaggaacggggtgtgccacggccccacctctcagagcagggaggaggatgctgggccagcccttggggaccccaggcaccgtggccacaggagtcagagctctgcatgtctgcaccatgtcctgggctcctgtcctgctcatgctgtttgtctactgcacaggtgagggaacccccagatcccaaagactcctgccccttccttcatcctgccctgcccccacggcccacatgcatctgtgtcaccaggttgtggtcctcagccggtgctgcatcagccgccggccatgtcctcggcccttggaaccacaatccgcctcacctgcaccctgaggaacgaccatgacatcggtgtgtacagcgtctactggtaccagcagaggccgggccaccctcccaggttcctgctgagatatttctcacaatcagacaagagccagggcccccaggtcccccctcgcttctctggatccaaagatgtggccaggaacagggggtatttgagcatctctgagctgcagcctgaggacgaggctatgtattactgtgctatgggggcccgcagctcggagaaggaggagagggagagggagtgggaggaagaaatggaacccactgcagccaggacacgtgtcccttgaactgaagacagcaggggcacgcatccccttggagagactgtcatggaagagggtggagccgccgcccgaagcgccgaggaggctgagccactcagcatctcctggtcctgcagtgttgctgtaaatccccattggagactgcattagggaattaaagctgcttgtcactttttgctgagtttggtctgactgttgtgcgacttcgtagtaccagccttgggcaaaggcccggggccccgggagactggcagatcactgtggtgagcactcacctgagtccttacttttgtgggccatgggaggcaaggggttgaccgaagcaccctggaggggcatccatgcccaggacaggaccctctggtgtcatctgattctgcccagcggttacagggcaaacaagcttagaaagcacctggtctgggcctccagggagaacaggagccaggtaataggcctagagtgggttctccaccttggtcctatcgacgttttgggctggacagttcttggttgtggggctgtcctgcggattgttgaatggtgagtggttatctgtggcctctacccaccagatgccccttcccagttgtgacaaacaaaaatgtctccagacattgccaaatgtccccaggtggtaaactcacactgattgtgaaccactggtctagatgagcaagtaaatgcatttacttatttgtacaagagagtggcaggtgtcggcaaacatgttctttttttcctttttttagggataaagtcttgctctgtggtccaggctggagtgcagtggtgcaatcatagctcaccgcagcttcaaactcccaggctcaagtgattgtcctgtctcagcctcctgagcagctgagactacaggcgtgcatcaccatgcttggctatttatttagttttatttttggagagatgaatgtctcactatgttgctcaagctgatctcaaactcctgagctcgagtgatccccctgcttgggcctcctaaagtgctgggattagaggcgtgagccactgcacccagcccattttctataaagagccaggtggtaaatatttttggctttgtgggctatgcgatctctgtcacaactgttcaattctgtcctagtagcaagaaagcagccacagacaaacatgtcaacaaagaggcgtggctgtgttcttataaagctgtatttacagaaacagatggggctacactgggctgggtatggcgcccaggctgtagtttgctgagccctgctcgggagcactccagctcctgtctccaggttttaagcaagccatgcttggtgggataatcagagtcccccctcaacttatcttgcctgtgaccccaggcagaagcctctggacccatggagatacctagaggcatgaaggacgtggtctcactgagactgtgttggactgtctgggtgaagtagcaatggggagctccctgcagccccggcccacagcaaggccccctgagcccgtgggtggtgggtctgagtgtgccttgcagagagggactctctacactgggtgtccacacaacctgtagacatgcctcactcagagaggtgccgggcaaaccatctcccttgtaaccccaacttgcctgggaacgtgcattcaccccagctaaaaagatcctgaggcatctccccagagaggtggacacatgtcagtatcagcgttccatgtgtggtcatgagtccctctcttgttaaacagtggtctccagcactttgggaggccgaggcgggtggatcacctgaggtcaggagttagagaccagcctacccaacatggtgaaatctcatctctactaaaaatacaaaaattagctgggtgtgttggcacatgcccgtaatcccagctacttgggaggctgaggcaggagaattgcttgaacccaggaggcagaggttgcagtgagccgagatcatgccactgcactccagcctgggtgacagagcgagactccatctcacaaaaaaaaaa

SEQ ID NO: 15793 - DNA, 33712 bp, Human
taacttacatggccaagccctgctagaagtatcttgcaaagggtttgacacagaagcttggccaagctgtgaaaaatctctcaaagtagttaacacacttcttgagtattactggaaacttgataaactaagaagagaattttgaccaggtatcacaagaaatttgtactggggacttctaagaataagcgtgtactatttcacagtcaactagaagaaggcattaggacattagggctattttctcaatatcttgttgattaatagttcttccctttgcagacagagtagaaaatttcaccaagtaaagattttagccctgctttagtttaattcatctcatattcctttatttctattcttcctcccacatctttccttctcaggtctggttccctatatgcggagcttcaacccccagaggatatttaaccttgtctccccctccacactgctgcattccccaccacatctctttccctctctttccatccacctgaagagatgagagcatatacagaaagtagctcccagctgtagctcaaccattaaacaccaagagaaaggaaaatgaactctgccagacttagatcaattagaagattcctttgtaacctaaatacatttttaaaagcttatcatcaaattatgcagtcatttgcagtttgaggtaaaacaactccttcattttcatggccctctcccctattcaagatgacatcaactgcatattagttttaccttgtatgcatttctcaatagtaaaaccattagtcagtagcatctgaatgtacattgatacagtgggtgttttgtggtaattataaggtaattacttcctatccttaaataattgtcatttccacaaacaaacaaaataggataaacaacaatacagcatacataaaacaactgccatctccctaagacaccagaatagcctgttaatcaaggaaagctaaatttattaaatctactacagtaagggaggccacactttgacagaagcttggcagtctcagaaggagaaggttgggggtgatatttataggatttggggagtctgagcaaaaatggtttaaaacaggtcttttgaggcagggaactgtttgggggattgggtaaagtgtttgacctaatagtttagggtcggtgctagagtgaccaattttactgatttcctaggactttctcaattttagcactaaaaatcctccaactggagaatccttacagtcctgggcaaactgggaccattggtcaccctaattagcagacataccgtcgcaagactgctgggtaatttgaacagtagtaccagagcaactgacaaaacattgtagcccatcttcccaaggctggatacaaagttttctgaagcattcacatttacagcctctatttgacaaaatactgcatgcctatgtgcgttcaactcacataataatgaaacttaactttaaaaatgtttttattgcagtaaggtatataaaacatgaattcgacagtttaactatttctatgcatacaagtgagtggtattaattacattcacaatgttaagcgaccatcatcacttaatttttttaaaggacgtttatattcactcatctatcaacgtagtaggcactgtcctaggcgctagggattccatgcagagcaaaaaacgtcacagtccatgccttcacatggccttcatggaccaccgcgggtgttctttttcccccgagtctttatgtacttgggaaaagtggccagggttgaaaggtgcaatgagtacacggcagaggtcagagaggttcccactcagcccggcgtctggaagcagcgtggggtaggggccgctccagtaccccctcctccagtgtcgaaggtgggcaggccctcggccgggtggatgagccgcgactggagggggcggggcctgggcgggaggcgggcggtgggcgtgtccggggcggggctgtaccgggcgctgggcggaggagccttggctggggactgcctggaaacgggctgggcctgcctcggacgccgccggtgtcgcggattctctttccgcccgctccatggcggtggatgcctgactggaagcccgagtgggatgcggctgacgcggaagcggctctgctcgtttcttatcgccctgtactgcctattctccctctacgctgcctaccacgtcttcttcgggcgccgccgccaggcgccggccgggtccccgcggggcctcaggaagggggcggcccccgcgcgggagagacgcggccgaggtaggactgggtcggcggcttccttccggctctgcgctcctggctggggctgctgggcggctggggccgggtccccgcacccggctctcaagtccgggattacccgcagggcctgagaagcgctttgccccctacagcctctcgagccagcccttggctcggaattggagaatggtcctcattcttacccagatctcacacgccgtccccgctcccgatcccagggggtgacaggcgcgcacgcctttcaaacacgtgttaaaatccaagacgtcgtctcaaatgccagagatttgcgggaatgctcctggaaggcctcaaaatcgccgcaaggtttaagacatccgtttccatgttgaaacaaagccctctctaatcctgcagtgaccataaggcagactttacctccaaattctggtcccctgtcctgtgttttaacttgtgttaagatcagactcggctttctctttccctttattcagaattttgcacgatagtatctaagactggtgaacactacactctgaagtcagttttttgtgcataggttacctgtatacaatggataaaaataattgcaaaagttaagcttgtaacttgatacatattatcctgttatttttaaaggttttgtgttggggaagagaattttcctgtctcaaggtagcattttatttctaagacttttcagagtaaaaaaagttcagtaaaaaaattgctgattttcttttttgttttcattgtgtattaccagtttaaattcagttgctgtacctctcagaaattaaagttaggatgaaattagaactaacacttaatttaaatgatttgaatttacctacaactgcaataataccttactggtaaacacttactctttttaaaacagaacagtccactttggaaagtgaagaatggaatccttgggaaggagatgaaaaaaatgagcaacaacacagatttaaaactagccttcaaatattagataaatccacgaaaggaaaaacagatctcagtgtacaaatctggggcaaagctgccattggtaagttaatacgtagaaggaagacatgtaaaaagcattataaaatgtattttattgatatgaaattcattttaatataatttatttcataatttgttaattaaggcatcatgatatattttttcgctttttgtcaataattcctttctccttccaattagacaacatctgtttgtaaatgtacacacatacatattccactgttggtctttagcagagcacagcttcatttattgatacattgagtaggctgtatagtgtcattagattgcaatgcatatgtcaactgaattttcatgaatctgtgtattttttggacacttgatacacaagtataagatgtggcccctgcccttgatggccaaacacatttgggaaacactgaagagtacaaagttaaacaaggttcttcattgcaggcctttctcaagagcctttaatatgacaatgttcattgtatcagcgaaggaatatattatagtatgtagttgattaaacttgattgaccacagaagcatttttgctgtgaatatcatgagagtgtagtgttctaagatatatattatgctcaattagagaatggggccctgagggtttaaagagtcacaaagaatttagtgacttagaaagcgctttatgtggcctttgaacatgagttgggtttatgtacaataaggcatatggatagaaagtaccagatgagaggaaaatgtacagagcatagtgctctgctcatggtatttcataaattcgttcatacttacatacaagtatatatcctagaagattactaccaacctctaaatttcaagtacctgaaaccaggccttcaatcatcaagttctagccattattttttaaataaagtctctaatattgatttcttcttttaaatctcagattttcatttccagacttctctcttttcaatctgataagtgcaaagtggccaagtgaatttcatcaaatgctaccttttttttttaacacctctgctagcaggaaaaatgctactttgatcagcctattctctagacacagttataaaataccgttatagaaattcccattcaaaaggggagaaaaattgaagtaaaaaagtgtcactggtccaagcaattttgaaatctaaatttcatctaaatggccagctccattagatgatattgcaggcctaggaataatctataggttgtacagctttgccctctggcatctcagccacactcttgaagtcatcttttcctttttcataaaaagtagcacaagtttgcagcttcgtaattttatcagcctgttgacagctggtaaaattttcagagcccatcagccttctttcattgtgacctcttgctgtcttttttagtccaagctggcagcgtttctgctcataaaacattctgaagaaccttgtgggccctctgtgtatgtcacaggattcactccattagatgggaagctcctctgcagatcttttctgagtaatcccatctccatttctggcttctgctgagatggctgaggagacctgtaagtcacatgtataatctcttcaaagagccctttgtgtgaatgaatattcagatcttctgatccttctgaggcactagcaaaaggttgtgcagccacatccttggtcttgtttctggaacacccttttcaggcagcaaatctaatttttcacatcttttgcaatcttaatggtccgagaatttcccaaatcatcaaattctggttcccttttgcttaacagtttttccttctatctcttttttcttatatttcactaatcaccaagaaaccagtccacacctttcactttgcttggaaccctccagctaattattaaagtttatcacaagttctgctttccatgtaactgcaggatacaatccaactaagctttttactgttatataacaaggatcctcatccttccagtttctaataacacattcctgattttcttctgagccctcaccagcaatttctttaatacgcatattctaggcatggcgtctcacgcccgtaatcccagcactttgggaggctgaggccggtggatcacttgaggccaggagttcaagaccagcctggccatcatggtgaaaccccgtctgtaccaaaaatacaaaaattagccagacattgtggcacgtgcctgtaatcccagctactcaggaggctgaggcaggagaattgcttgaacccgggaggtggaggttgcagtgagccgagatcatgccaccttactccagcctgggcgacagagcgagactctgtctcaaaaaaaaaaaacattgcatattcttaccaacaatctgcttgtgatcatttagatatcctctaagacaatacaggttttctctactctacctcactttcttgagtcttcactagctgagtcattaacatccatatttctatctgcaggttattcaaggcaatctaatctaggctttttaaaatcatgtcctcacagttctctcagcctttccccattacccaatttcagagacacttccacatttttaagtatttgttacagtagcacctcatttccaggtaccataatcttaactgtataatccatagcatcctattgcagccataacaaattaccacaaatgcagtatcctacctttctgaaggcagaactctaaaatgtgtggggtctgtgttactttttgaggctctagaggagaacctgtttccttaccgtttagagtttctagcggctacccgtattccttcatttatggccccacatcactctgacctctgcttctatctttatatatcccttgcctcactctgacactcctgcctcccttgtgtgaggactcttgagattacatagggcccacctagataatctataataatctcttcacctcagcatccttaacttaatcatatttttaaagtgtcttttgccatgtaaggtaacatattcatagattctaaagattagaatatggacatctttgctggtggggcagagggacattattcaacccatcacatttggaaagcgttatctaattggccacattttaaacgtggtggcttgcgtttcctttagtaccagggtacaatgagaatggaacaaaaacctctttgagtgtaaccaaaacagggtgcccagaggtggtgtatggtctccatagtgcctcattgagtaacactgctctcctctactctcagagctttcattcaggtgaaatcatgataaaacatcaggggctgccataaggagaaaagatgcaatgacatttgtctgtgaggggatcatgcattcagggatatgtgttcaagtgaggaggaggtaatatccccttgacatattgaatgtattaatatatgtacatacatgagctcctctggctccatttggcacaaaatggcaactcccccaatctgttataaaagcagttctaaccacatagtatagtttactttgtaatataatacatttcatttcagaataagacaggtggtaaagatccatataaattaggggtttctcaaatctagagtaggagaggtctttaatattaactcacattttgccacattttacacactaacagcttctgagctctgtctctcattagctgccatgttgatgatttggagctgttgcttgatagcactgcctgccaacggcccaaaggagaggcattctggttttatagtcaaatgagtaaaagaacagaacgtaaacttgtctcatgcactaaagtagatgagacagtaaattgttttgattttgtttttgttgttaattaccaggcttgtatctctgggagcatatttttgaaggcttacttgatcccagcgatgtgactgctcaatggagagaaggaaagtcaatcgtaggaagaacacagtacaggtattggttgtattagttgtgcaacattaacctttgatgttttgctctgcaatattttctgtaaatactaaaagaaaaataataggaaaatatatttataaaaatacttctatttcaacttgtaaagaatagagaagtaaatctcatgaatatgtattcataattaagcttacttggaccttatgaaattgtatattacagaatactcctttttggcatcatatgtctgttttatttttacctaattatatagaaaagttcatactccacatcttacagcgtttgaatggtgacagccattgaaaacattctgtatcttggaggaataatatgtaaacctaaaagtattttcatttttctctttcatgtaatagtcatgttcactttttaaaatatttaggtgatatcaaagctcttgctgtcactttgtagatttttgtttattaaaacaaatttgatgagttctatcaggatttattttttattttagatttaataaagccaatgtattgcttagacttttttggcctttttatataactcttttctatgactgcatattttctgagtgtttttaagtatattaggattattttatttaggaaaactataattttatcatatgaaatgctattttattagattttgctttattgaaattaaaaataaaaacattatttttaaatgcttattttatataacagttgtattattgggggaaaatgtgaactaaagattctgctttgtattggaatttcagtcttttctacagaaatcaggaaaggaaaagctatagttaacctcaattttgttctaatttttactacagctttaattctttatttactttatatacacttggaaagcagttttattgcatgtatcttttcaaagttaaaaagtaaacaggtttttaaaattatcattggtaatgattatttttcctttcatcttcatgcttctgttgatctaatcccattcaagagcttaaatagacttacaatggttggatttgggtgtgtgaaagtaaatgtgtattatgtgtataaatctaatattttggtatttgaaaagtaaatgtgtgttaggaatattagtctaatccataatatataaaattttcagaaaagttattaaaaattcataaagttagcatctttaaggttaaaattatacattgttactataataatagtgaaagatttgagcaaagaacattaactcccaaaagaaagccaaatgtatcctttacttctgaaatatttgtgggagattttacaggcatcctctagagatactgcgtgttcagttccacaccactgcagtcaagcaaatactgcaataaagcaagtcatatgaatttttttattatccagtacatatgaaagttatgtttacactgtactacagtctattaagtgtgtaatagtattatgcctaaaaaaaaaaaatacgtaccttaagtgaaaaatactttattgctaaaaaatgctaacagttatctgacccatcagcaagtcatctttttgctggtggagggtcttgcctcgatgttgatgtctaatcagtgtattgatgactaatcagggtggtggttgctgaaggctggggtggctgtgacaatttcttaaaataagacaacaatgaagtttgccacatcagttgactcttccttcacaaaagttttctctgtagcacatgatgctatttggtggcatttttacccatagaacttctttcaaaattggagtcaatcctaggccggatgcagtggctcatgcctgtaatcccagtactttgggaggctgaggtagctggatcacttgaggtcaggagttcgagaccaacctggctatcatcgtgaaaccccgtctctactaaagatacaaaaattggctgcaagtggcagcacacacctgtaatcccagctacttgggaggctgaggcaaaagaatccttgaacctgggagtcagaggatgcagtgaggtaagatcatgccactgccctccaaccccgggcgacagaatgagtcaaagaaaaaaaaaaattggagccagtcctctcaaaccctactgctgctttatcaactacatttttggaatattctgaatcctttattgtcacttcaccaatgttcacaacattgtatcttcaccagaagtagattccatctcaggaaaccactttctctgctcattcataaaaagcaactcctcatctgttgaagttttatcatgagattgaagcaattcagtcacaccttcaggttccacttctaattctacttttctttccatttctaccacatcttcagtgacttcctccacttaaatctcgaacccctcaaagtcatccatgagggtttaaatcagcttcttccaaattccttttaatgttgatgttttgacctcgtcccatgaatcatgaatgttcatggtatctagaataatgaatcatctccagaaggttttcatttactttgcccagatccatcagaggaaccactgtctgtggcagctatagccttatgaaaagtatttcttttgttgttgttgtttgttgttttttttttgagacagagtcttgttctgtcatccaggctggagggcagtagcgtaatctcagcttcctgcaacttgcgcccctgggttcaagtgattctcgtgcttcaacatcccaagtagctgggactatgggcatacgccaccacacccagctaatttttgtatttttagtggagatggggtttcaccatgttggccaggtctcctgtctcggactcctgtccccaagtgatccacccgcttcagcctcccaaagtgctaggattacgggcgtgagccatcgtgtctggccaaaaagtatttcttaaataagacttgaaagtcaaaattactccttgatccatgggctgcagaatagatattttgttagcaggtatgaggacatgaatctcctgtacatctccatcagatctcttgggtgaccaggtgcattgtcaatgagcagtaatattttgaaaggaatccttttttctgagcagtacttctcaatagtaagcttaaaatattcagtaaaccatgctgtgaacagatgttgctgtcatctaggcttttttccatttatagggcacaggcagagtagatttaggatagttttaaaggtcctaggattttcagaatgataaatgagcattggcttcaacttaaagtcacccagctacatttagtccctgataagagaatcagcctgtcctttgaagctttgaagccaggcattgacttctctctagctatgaaagtcctagatgtcatcttctgctgatataaagctgtttcatctgcattgaaaatctgttgtctagtgtagccaccttcatcaatgatcttagctaaatcttctggataacttgatgcagcttctacattagtacttgctgcttcaccttgcatttttatgttatggagatggcttctttccttaaacctcatgaatcaacctctggcaacgtcagacttttctcctgcagcttcctcacctttctcaaccttcatagaattgaaaagagtggaggccttgctctggattaggctttggcttaagggaatgttgtggctggtttgatcctctatccagactattaaacctttctccatatgagcaataagactatttcaccttcacatcattcatgttgttcactggagtagcacttttcatttccttcaagaacttttcctttgcattcccaccttgactgtttggcataagaggcctagcttttagcttgcctcagcttttgacatgccttcctcactaagcttaactatttctagcttttggttgcaagcttctccaacccaccttattttattgttgttgttctgttttgttttgtcttaggcttttagcagcctgaagccatggcttttagtttctgtctttagtaataagcagaaaagagggataaggaaggggttttactggcccaaccagaaacagaaactaagaatccatgcctatattctctcccttggacactcctgaaagtgagagacttgcgactcttcctttcacctagagggcattcattatagggttattaattatagggaacacttagagggcattatagggttaataattggcctaatagtgttgtgtctcagggaatagggaggcccaaggagatggggagaaatgggggaatactggttggtggagcagttagaccacacacatagcatttatctattaagtttgccatcagatcttgtgagacttattcactatcatgagaacagtacaagaaagacctgcccccatgattcaattacttcccaccgggcacctcccacaacatgtgggaattgtgggagctacagttcaagatgagatttgggtggggacacagccaaaccatatcaccatctcatagtgagcacatgctgttggaaaatggtaccaatagaattgcttgactggggatcaccacaaactttcaatttgtaaaaaactctttatttgcaaagtacaataaagtgaagcacaataaaatgaggtgtgctggtattatggccaaagagtaataccgtttcctcttaggatttaagagaactatattcaagaaaggtcaccattgtatgagattttttttaaacagcttattaaagtgttaggttcatgaaaagtagcgtacataatttatccaaaattaataaacttttatgcaattgtaagtcttcagttgaaacaactacatgggtactaacttaagtgtttccacacattcaccatccttgtttgaccaaaagtgaatcagaagtaacggctcaccttgaagatattggaagaatttgtaagtactgttaagatacttgttgaaaataagtgtaaatatactttgtttaaataaacaaacgagcttatatcatttaattgtagcctcgagacaattctaagacagaagtagaaaggatatcatcagtgttgcagggctcatcaggctcaggaatgctgattttcatcaacacataggcccaaagaatgaattccagcataccaaataaatgatatagaatggaaagagagctgtcagtcaggccatgtgtttgtattggtttgactgacacattctttccatacaggcaggctacaattgataaccaattatttgagggttgattacataatggaaccatattatgggatttaattatatgtagtgcttttaactctgtttcagaaagaaagacagaaatatgactcctttttcaccactgaatcggtaacatcatccataggctgtgctcagaatatgaatgcatgaatacatacagggcaaactgaacttctggatgagcctgatgaagccctgtcacctctgggcagtgtagcatgtgactcagttattgagagtacagactctggagccagactatctttgttcaaattcttttatttttttcagacagagtcttgctctgtcacccaggctggagtgcagtggcgcaatctcggctcactgcaacctccacctcccgggttcaaacgattctcctgcctcagcctcctgagtagctgggattacaggcgcccatcaccatgcccaactaactgacctcatgatccacctgccttggcctccaaaagtgctgggattacacgtgtgagccaccacacctggcctagttcaaattcttgttctattactttgctgtctgaccttgggcaagtttcttaacctctctgtttcagtttcctcacatttaaggcaagtagtagttcatatttcacaggattattccaaagattaaatgtgttaataaattacagggcttagaatagtatctaacacacagtaatcactatagaagtcttgttgctcttttattttagtgttccttaactaagtactgcaacatcttcctacaagcagttctcctttttctgtttccattactgtctcttacccctccgtcatgtacctgcccacaaatgccttattgatacattctttatattaatatgttcaattaagttttaagctagcctgagacccattctgtctcttgaaggaactttgcctaccactactcatagccatcatatgttgatttatagtttaatctcataggacaattttatttttaatttcttaagaggaaccttgattctgctcatcgtgacttttgctcatcccccaaagactgccttcagaatcctatcatttctatgtatagtcattaccacaggctatataaatgtctacccatttggtaaaacaaaaggtagatcataaattattaattgttatcaagattcgattataacatcttcagtgagcatctgctacttatgaaagagttgaacttatttccaaagatcatgatagaataaaacatgtcagatggcatttttagaatttccagactacttttgtaagaagttagctcactatgaatgaaagcatttatagataacgttaatggttactgacatgacatttatttaggtcaaatgctggagcataaatcaatggagatcccaaataaaattttcattggtaaacaaagacaaaacagtatttcaaaatgccacatttattcttttaatgttaaaatatcctttaaaaaatagtagtgatagtgatggcccatgcttataaagagcttactatgcgccaaacagttctatacacttaataacttttagtttgtttaatccttaccacaaccctatgaagtatcattgtttacattttgcaagttaggaaactaagacaaaagagattaaataacttccccacaactgcaaactagtaattataacaaataacatctaacatttacatagctcttactatgtgtgagacactattctcagtgctcacaagcatccatgaggcaggtactgtgcttacctcgtttgagcactgaaaggctaagtacctggcctaaggttacatacttctaattagtgggtaaagccaaaagtcaagcactacactcttgactaagggactattttgagtaagaggcagtcaggggatttttatttttaatgtcttaagaagttggtgattctgtattggtccctaaagatcattttcagttttttgtagtaaatggaatcttgaaatctaagaactgatgagctaagcagtgtcctagagtagcaactctgagttcacaccttatccagtgtaatattagaaaccttgttttaaaaatgcactattttgatatatttttggtttgacagaagacagctgctgaaactctttctctctcatcactcctgttcagccgatgtctcacccaagcccatgtagtcaacataaagaaatgagaaattgccagctcttggctcttatgcctcttcaaagattaatgagcattcaggctgcttagaaggcatccagctgtgggtgagatgggcttccagcctggcagagtaaacactgaggcccgcagtcttgtcccagctctgctgctggcgtgctatgagatttcccagccatctggggtcttattgtcttattttaaaatggaaagaatcctgagtcaacagcaacatatgaagtggttgctgtgttccaggggcttttacagatattagctcagtgaattttaatcctcagaaccaccctgtgcagctggtggtattactcccattttgcaatgaaaaccttgatgttctgagagattaaatgactagtaaagatgggattgaaccatggtcctccctttaacatgatagattagtccacatcatctacaagtcacctccaatattaagtatattcaattctataatttcatgttgaattatttttaagagatgggggtcttgctatgttgcccagactggagtgtggtgactgttcacagacaagatcatagcatactacagcctctaactcctgggctcaagagatcctcctgccccagccttctgagtagctgggaatataggtatgcaacactggcccagcatcattctgaattcttaaatggggtcatttttagaaattcttatctatgctttgggtctagactttttttcctaatctgctacaacccagttataacctcatcttgacttttaaatgtttttagattttaatatcctctttatagtaatttaattacaattttgccataatctctgttaactatgatttaacttttgcacatctaatgtgcccaattcttgattatcttttaatgtttttaatttttttaatcgtgtgatttttcagggttatgtttactacttagtgaattttaggcacagggtgcacagtgcatgtatacacttgaagggttctctgatgcttttgcttacacaaactaaattaatagccccccttctgctatactcataattatgaaaaaaagagtgaagtgctgcaataaaagcatacctgatgcatgaaattataatagaagcaaataaaaaagaaaactttttctcccctaaattaatatataatatttctacaatagaaattcatctcttggtgatacatttaggagattttatatacttaggaaactaaaattgcctttagctacaggtaagctgcctaaatagtagtagaaatggagagaagtggggtgaaaaacaaatatttatgaccaaaaggaataaaaacttagctgtctttgaaaagataaatttgattcacataggatagtattatattattttctcttcagaacacaatttgtcatagaatggatcatagtctgaatgaacactgaataatttttttaggttaatcgcccttacctaaaaagaactttgggatacataaaaattagaacatcaagtaaacaacttcttacaatactgaagcctacttaataagagaaatgccgttgcttgaatcagccatcggctgatgactcatctcttaaagtaggcctcaactaccgagcaaagagatccttgcttggagggttatgtataatataagagaaaggaggttgccatcttgtagcctttaagtgataacttttcgtgttactggtacactccagtaggattctctggggccagctaaatccacctggcatgaatttcaaaatgccccatcataaggtagtctattcacagttggaggtctagcccttactcccatttcctctctctattgatgtgtagctgttgtaggacactcagatctctattatagtccactgtggtctgttcattacccaaggaaatggtttctccacagttcttgttctcagtttcttactaagttgtcagtcacattgcttaaaactttgaccaccaaaatatcattgctccctagctttggaaaatgtatttataattcttcaaaaattaaaatattaaataaattgagagatccattaattcatttctaccaaataattgttgagcacctcctaatgtttaatttctcctttcctccttcctagtctacggaaatgggcattagtgtctccttgcaaactcagacaaactaatagctgaagggggtagtggatttatttgtaaagttattaatttatgtactgcttggagcaacaaaagtaatatcttattcctaaagggccttttgaccgggcatggtggctcactcccataatcccagcactttgggaggccaaggcagcaggatcacttgagcctaggagtttgaggtcagcctgggcaacatagtgaaaccccatgatttttcatttaaaaaaaaaattaaaaataaaacagagggccgttccatagttttcattgtagcagaataaataaatatctaatttgtcagcaaaatatgtgaaagcaagatcttatgataacctcacctgggaagtaagaaatatatgtattttggtatgttaatgtatgggtgacagaacaagctgcagaggagactaataatttatttttaaaatatcaaaatataggctgggcatggtagctcccgcctgtaatcccagcactttgggaggccaaagcaggcagatcgttttgagctcaggagtttgagaccagcctaggcagcatggcgaaactgtatctctacaaaaaacacaaaaattagcacctgtcgtcccaggtacttgcggggctgaggtggaaggatagcttgagcctgggaggtcaaggctgcaagtgagctgtgatcacgtgactgcattcctgcctgggcgacagtgagaccctgtgtcaaaaaaaaagaagaagaagaagaagaagaagaagggccaggcatagtggctcacacctggaatcccagcagtttgggaggctgaagtaggaggattgcttcagcccaggaattcaagaccagcctaggaaatatggtgaaaccctgtctctacaaaaaacagaaaaactttgtgcgtggcagcacaaacctgtagtcccagctactagggaggatcacctgagcctgcgaggtcaaggctgcagtgagcctagatcacaccactgcactccagccggtgacagagcaagaccctgtctcaaaaaaaaaaaaaaaaaagtattaaaatataaaagttgggctatttctgtgtttataacacctttccttaatgagaggtgaatttataggctgtgtcttcaaaatgtataataattgaacccaatattaaatataataccagactcatttctcctctatttgagcatttatctctatgaactttaatctatagccatttaaactgctaatatttaaatatacccaaattatttcctgtaaaattatgggaaattattgttttttaatattttaattttttaacttgttctttttgaaataattttagacttaacaaaaatattgcaaaaatggtaccaaaaaaatccattacacctttcatccagattcctcaaatgctaacatcttacataattaccgtataattatttttttcaggaaaataacattgatacaaaactgttatctaatttacagatacacacattcccactactgtccattttctggcccagtttccaatccagaatcacacggtgtgcttggtttcatatctctttggcttcagccagtctgtgacagtttctcagtctttgttgaccttgtgacttatgaagagtactgcccatgtattttgtagaacgtcctttagtttgggtttgtctgatgtttccttacagttcagttcaggttatgtattttggttccgaatacctcagaaacaacatcgtgtcatcctcagtgtgtcatatttgttcccgttactgattatgttaactttgatcacttggctaaggtgcagtctgcctagtttgttcactgtaaagttactgtttttttccattgtgatatttactaggagattctctgggaccatgtagataacctgtttttcaatatgattacaaggtcccacagtatctccctttcacccacaaatgttagcatccatataaatacccaaagacaaataaagagataaatgccattcattgaatcagtcatcagctgattattcatctcttaaattaggcctcatcttcagagcaaggagtaaaatgtttagtagtcttaaacgttttgattttaagaaacaaaagtaaaaggagcacatcatttgaatatgatgaattattttggaacaaagaattaaattgtttgttatatgcaaataaatacataaaaaacaaccaagaaaacctcataaaaatccccagaatcactggataaaaatttaaaaataaagaaagtgcaatcccaataagactttaatgttgaccattcattaggaaaaaagcctactgcaatagtcctgtcgataaaaaaaagaagaaattgagaaaataaaaaagccaactattagaagaatttagggcctaaagaaaattatatttctttttctttttcttttttttttttttttttgtgacagagtcttgctctgtcatccaggctggagagcagtggcacgatcttggctcactgcaacctccacctcctaggttcaagcaattctcctgcctcagcctcccaagtagctgggattacaggcacctgccaccatgcccagctaatttttgtatttttagtagaaatggggtttcaccatgttggccaggctggtctcgaactcctgacctcaggtgatccacctgcctcagcctcccaaagtgctgggattacaggcgtgagccaccatgcccagcctcataaattattttcataccatatagaaagcataatgataagaatatgcatactctaccatgtttattgttatggaaatacagaagaaaggcaattaactcaatctaagtagagttaggggtgtggggcctatcaacaaatgttttctaaaggaggtgatagctgagcagtctttaaaatgagtagaagttagcaaggcagaaaaaagattatattcccagcagaagtgacatcagaggttcataagtgataaacttgggtttatgcatggaattgcaaaccaatcaatattcctagagcatgaagaaaaggtaaggtagctgagatggggaggattgagcaagggccagatcatggtgggccttgtatgtaccacattaaggctcttggactttattctagggtagtgaaaagcaattgaggatgattaagcaggatagtggtattgtcatgtgtttatgtgtgtagatttctttagcagccatgggggaaagtgatttgaaggagacagctgggtgcaggcagaccaagtaggagattggaagtatcccacagagataaaactaatggatgaaatagggaagtggtagtgggtcagagccagggacaaatttgagaaatatttaggagcaaaatggtcggaatttagggattaattagatgggaagatgagagagggaaacaaatctgagaagtccctagtttctagtttgcatgagtaggtagctaatgtgacacaaaaatagaaaatacagaaatagcaaatctgtccactcttctctagcccaccacccaacatctacctatctcctctttctcagcagacaaccctgcctcctctttcatcaggaaaattgaggacatcataattatctctcttaactagctgctgtaacatgtacctactctctgtctggtccctcacccatccttatctctttccaagctctcaaacattgagtgatctttcctggctcaaggttaaagcccaccacctgtgcatcccacctgcttctaggaccttgttccatgcattacttccttgctttcctttattctccacttcattcattattgctttatcaccttctcttcaaaactttcagaatccttgtctatactcactgtaatcacttccttacttctcaacccattgcagtttgactaacaaactttccaacacacatatgtacatacatacatacaacccaggtatctgaatcaaatgaaattttttgggcccttaaagtttcttcttttagatctgtggttccttgacggaggcactgtgggacatcaccaaatattttaaatatttatgggaaacactgatacttgatatctttcaggccctatgcaaactgcaagttcaaagcagtacagtttcaacattagattaccctgcatttatttgaacaatatcaggactttgtgaagctgggttttccatggttgccgtgataaaatgcacgcactgcacaaaaatgagtgtggaacaggaaatgacactgacagtgtccactgattccaaggtttgagaagttctatagtgctcaacaggtgcacacatgctattaaatatttgtgattagttaagaatgaaataggaatatgagtttttctttcagtgtctgtgtatttttttaagtcacttttaagctgttaggacatagatacttattaggttgtttagacctaatgactttaaaaattgaactgttaagcatttcttttagcttgggagacactgaaaaatttacaggaacactaaaggtgctaagaatctctgacctacaccttggcttcgcagtattgaccccatggctttcaccattaccaaaacacagggagttgtggacatccaagaccaagacagtataaatgtgcccttgaatgaatcatacttcattttgttaatttgtgtggatcactaaaattagaaagatattcctttcacatgaaagttacatttgagaatagcttcatatattttattttaatacattgactaaaacctactttgtttttcttttcttttcttttttttttttttttttttttgagacaacgtttcattgttacccaggctgaagtgcagtggcgtgatctcagctcactgcagccttgacttcctgggctcaagtgatcctcctgcctcagcctgctgagtagctgcaccaccatgcccagctaatttttgtattttttgtagagatgggttttcaccatattgtgtaggctggtctcgaactcctggactcaagcgatccgcctacctcagtcaactaaagtgctgggattacaggcatgagccaccacacccagctgtatggcactctgaaattgtttgggcacatgatatatatggacttaatgtcaaataaccaaatttgagtctgatctgtaccatttcctatctagtgtcagctagctttatgcaagtcatagaacctctctcaagatttccttttttttccttcataaaattggcctaacatggggaaggaggactggaagactttctcatgctcttaagaattatacctgcttatatttctaaaagagaaatacaaagtattcgtatgctaccaataataaatattttaaacataccataattatcatcatcattgctagtttttctagcccctcagattctgcatattgtcttaaattactaggttatcactgaatcattagtcattgccagtgctagatactgtccaaggcaaacatagtcctcaaaacatagtcctggtccctgtatgttatataattttagaataatgtcatataaatcatatggtacatgcacacatagtaaaatatatttttacgttttgtgctttaactaatatctgtttagtatttgttaaccatggagttatggaaaaacttaagctctgaagtgagacagaactttgttgagaactcgtcattgccattacaagctgacagctaaagtgcaatttcacaaatgccaatgagagaataatgaactcctcagagttgttgggggggttaatgatgacccatgcaaagtgcttatgtatcatgtatataaaaggcgttgaacaaatgtttttatccccagcagtaagaagcaatgaaagtaggctttgggtatatttgtgctgaaaattagattctatcaggatataaagaaatggtttaagcaagttgtaaagaatctaggataagagtgactaattttaagatgaattaaatggtacttgttctatttaatacatactagtgaaaatatttcaatggtactggttgttctaggcagcacttaatatgaaaaaaatgagttatgatacatgtctattcctttaatgaaaactttttaaaaatacagttaaaaagagagtaggctgagcacagtggctcatacctgtaatcccagcacgttggaaggccaaggcaggtgaatcacttgaggtcaggagttcaagaccagcctggccaacatggcaaaaaccctgtctctactaaaaatacaaaaattagttgggcatggtggcacgcacctgcagtcccagctactcaggagctgaggcacaagaattgcttgaacccaggaggcagaggctgctgtgagctgagatcatgccacagcactccagcctgagcaacagactgagactctgtctcaaaaaaaaaaaaaatggtaatacaacacattcccatttactcaccattcaaaactaacaaatttcagctctctgtcatatttgcttcagatatttaattttcctgttaaaaaaattaaatactttcaataagggtaaagctccctttgtactgttttctagtccctttcatcttccttcctcctcagatacaattgctatcataaatttgatgtggatcctcccattcaaatttttatatttatactgatcctaaatatatatgtgtaaataatttttatgactgtactttcaagtttatgtatattttgtgagtgtcctaatccttgctttttttaacattatatttttgagatataacattcatggaatgtttataatgccattcttcgtttcttaatttgtcagcactttctcatccattgagtcagatgaagagtgtaatagcagctcacaccataaaagggttgagaactactgactttaaatgcctttctggtttgaactaaaccattattttacagagttccatgctattcaattatatttctttgcttaagagtttaaattctagccagcatttattttcagtgtggttaaaacaacaacagaaaaaaaggtcaggcatggtggttcatgcctgtaatcccagtactttgggagactgaggtaggtggattgcttcagccaaggagttcaagaccagcatgggcaacatggtgaaaccccatctctacaaaaaaatacgaaaaattacctgtgtgtagtggtgcacacccgtagtcccagctactcgggaggctgaggtgggaggatcacctgagccagggaagttgaggctgcagtgagccaagattgcaccactgcactccagcctgggccacaagagttgagaccctgcctcaaaaaaaaaacaaaaaaacacaaaactatcacattttgtattatcatatgcaaattgatctgcctacagccaaagcttaccattaatctacagctatgccccatcattcaaacttgttcaaaagattgtattatagaaattttacttctagatagaatgtggattaaatctcattgtagattttgtataaaatgatgaatttctgataccacatacctttgttcaggctttgtttgtctcttgtttttgttgtgttgtttttaacagcttcatcactggtccagctgtaataccagggtacttctccgttgatgtgaataatgtggtactcattttaaatggaagagaaaaagcaaagatcttttatgccacccagtggttactttatgcacaaaatttagtgcaaattcaaaaactccagcatcttgctgttgttttgctcggaaatgaacattgtgataatgagtggataaacccattcctcaaaagaaatggaggcttcgtggagctgcttttcataatatatgacagcccctggattaatgacgtggatgtttttcagtggcctttaggagtagcaacgtaagtacaaaatatgattaaacatttttaggccctaacacctgaatttctgaaccaggaagacttattcaaaattgtaataaatttagttcttctgggattattgaggccaggtacagtctttctcagagataaaaacagggtgtggtcgcatccttcaataacaattatgatgtttttaagagtattttattctttaatgaggagatgagttactttttttcttttaaaaccccaaggcatagaatggatttttcaagcttattaggagtgccataaaaatatatttagcagagaaatggcagatagatttttttaaaaacaatgatagtatctatatatagtaaaaaaaggcaatattattatatcaggaatataccgtaccattgtgtttgagactggctgaatttatacaaatctcttctataaaaggagggattaattaaatgatagctaaggtttctcaagatacagtcttttaggccaggcgcagtggcttactgcctgtaatcccagcactttgggaggccaactaggcagattgctcgagtccaggagttcaagagcatcctgggcaacatggcaaaaccctatctctaaaaaaaaaaaaaatcaaaaattatccgggcatggtgacatggactcctgtatggcgcctctagtcctagctactcatgaggttgaggtgggaggatcacttaagcccaggagattgagctgagattgtaccactgcactctagcctgggcaacagagtgagatgagactgtctccccaaaaaaaaaaaaaaaaaaaaaaaaaaaaaagatatagtctttctccagctataaaatggaaaacatatatttttatctttctgttaataggatgtttttaattaagagcaagttgactttaagataagttgccactagtatataaacctcctgagagcagggatttttgtctcttttgttcactgttctatccacagagcctaaaacagcacctgcagagtaggtattctgtatttgttgagtggataaattatgaaaaatctcactgacatgatttttgaatcatacattcattattcatcattctgtccctggttgcgggatgtggccttagactgctgcctagttagcgacacagatgtcactggcacatctgtgccagtaatgagatgtattcccaagcctactcctataacaccctaactcagtaggtttggggtaaggccagacaaaaaggttcttgttaagtaaagccaggtttaagaccctcttaaaaatctattttttgagcagagcctgcatttgtaaaatgttttcatatagtataagatggaacctcttggtaatcatgatgttgttgcactaggccagtatatttcttatataggtctgtggttctcaaccaggggcaattttgcccaccgggaggcatttggcagtgtctggagacttttttttttttttttttttgagacgaagtcttgctctgtcaccccagctggagttcagtggcacgatcttggctctctgcaacctctgcctcccaggttctagccattctcctgcctcagcctcccaagtagctgggattacaggtgggcatcaccactcctggctaattttgtattttttatagagagggggtttcgccatgttggccaggctggtctcaaattcctgacctcaagtgatctgcctgccttggactcccacagtgctgagattataggcatgagccactgtgcctggcctggagacgtttttgattgtcacaactggaggaaagaggttgtcacaactggtatctagcagatagagcccagggatacagctgaacaccccacaatgtataggacagcctccacaagaaaaaattaacccaaaatgtcagtaatgctgaggctaagaaaccctgttatatacaaactgttaggtaaaattttgttctcgtgtgaaagttacatttcaggtacacagtttaatccctggtatttccaaatgctcataaaaataggtaacttttcctgtatggcataccatggttttatctgtcagtttgttttaatctacttgaaaagcccttgggattaatttttcagagccctttgcaatagcaaaatatataatctttccttttttttaattgacaaatagtaatggtatatgataatggggtacaaatgatgttttgaaatatatttacaacgtagaatgcttaaatcagactaacaaatccgtaaccttatatacttaacaatttttgtggtaaaaacataacatctgctgttttagcaattttgaaatatacagtgcattattatttattatagtcaccctattctgtgtgatagatcactaaagcttattcctcctgtccaactgaaacttcatacccttcgatcaacatcttccttttccccatccatctccctcccctggagtattctgtaatcttttcatcacctggttaaaatgttgcttaaatcgtgatcattatgaatagagaagagtctttatactttgaaggttttgaatgtaacatgcctaacagctgcagatgagtaatgcaagttaaagaatgtcaaaaacaaataactttaggcacaacatctctgtaacacttttgtaagagatgtcagtgtgaaattcaatttttttaagtcagtagattcagggagttttccaaagtattcatggaaaattacaatttgagatttagaaatcacattttaaacctcttctgtatacttcttgctacctaagagattgggttatggggaatttttgccaattctatatcatatgttaattcatgtgtatttatttttatagatacaggaattttcctgtggtggaggcaagttggtcaatgctgcatgatgagaggccatatttatgtaatttcttaggaacgatttatgaaaattcatccagacaggcactaatgaacattttgaaaaaagatgggaacgataagctttgttgggtttcagcaagagaacagtaagttctatgcttatttaattcattcattttgttctccagtctgagagttgctttatgtagaaacacaggtttccaaagaggcattgttaactctatttgtaccaatctttccccagaagatacattagtaattaaaactgtgaaaagactgggttgtacacatttagaatagagagaaccgcctatgactgtagtccatcttgaagaggaacactggtaactgtcatttgcaaatttcagttgttagggtttcctcaataatatttgttagtcacacaggagattatagatgctaatgagatacttaggttcatcactgagatgttgtgcagtggaccaattcagtgttccaagaccggtgtgcaggtctcacaaattcaggaattcaggaacctgacaccatcttcaggacatggaccttgtattcttctgtgaatccccagatctaacataggaccttgcacaaagtagacctaggataaatggtgagtggatgaatggttggatagggagactcaatagggttaaatgtcttcttttatgtagtaaccaggaaacaggtgttcatgttgtgaaggaagtaaatttgcaatcatttattttgtttttaaatagacaaatcaagttttcaaataaacaaagcataatgcagagtcatcagggaagtaatgccttaaaaatgtccagttaggtctggaattttactttttaaattatagcaggtactctttattgctaatgtaaccatatcatattcgttcagtcagtgtttaccaagcaattgctctatgccagaaacttgtttacccacagtaaatacagcagtgaacaaaacaaagtccatgccctcctggcacttaaatgcttgttggagtagacaagcaagtaaaatatattgtgtgtcagaagatgataaatgccctgtaaaaaattaagcagaagaatggcatagaaagagcttgggtgttggtggtggagcatttgctattttggaatagccaagaaaggcattcattagaaggttacatttatgcacaggccttaagaatgtgcatgggtgagtcttgtgtatatttgggagaagactattccagacgtagggaagagcaaaggccctgaggcaggcaggaatgtgcttactatgttacaggaacaacagggccagtatgtctggagtggaatgaatgaggacagtgtaaaataacaaaggttattatgggaataattcttgtaactcctctcataccattgagccagaggtttgagtagatgttttccttgtttctcattgttgcttctagactattctcccctttccctccctaataatcccaattttgaaactcatgtcagcagacaaaaccatccatcacccttactctctgaaatcatgcacttacccttgggtttctccccctacttcttcgaagagtttagctcctggtactctctagctctgtctgacactactctgttctcaattcttagtgactggcaaatctacatagatggtctttctgtcattttggtctttgcagttccttcacctcccctcctccaataatctgggcttccacctgacctcagccattctctctcatggttatttcctagactttgtcattacacatactgcaccttctgaacatgatctcaagtcccagcatctctttctacaaccaccatcatctgtcattccagctcattccgtgtaataatctgactctgacaattcagctggcacttagaatctattgttcctactacccttttgttgtccttcactcccctttcttcattttattcttcacctaacttaaatttcattgtcaatcataattgcctataccttcagctccctaattccctaatctggcaaaccataactctggttaaatccagctctctgcctactccatgcctgcacccatgcaactacacataattggagaaaggtgctaattgacctttatttaaacacgtgactttgaacctcaggtgcccagcagtcttatatttcccttgtccatatattctcccactctcctagaaggctgttttataccttcttctctcctacactctaacacctccgcctttcttactttatgaccctattgcttatttcactgagaatagtcaggagaaagcatctatctttttttttttcttttgagactgagtttcactcttattgcccaggctgtagtgcagtgacaggatctcggctcactgcaacctctacctcccaggttcaagcgattcttctgcctcagcctcccgtgtagttgggattacaggtgcacgccatcacgcccggctaattattgtatttagtagagacggggttttaccttgttggccaggttggtctcgaactcctgacctcaggtgatccacccgccttggcctcatgaagtgctgggattacaggcgtgagccaccgcacccagccgcgtctatctttctttactgatctttcagtttctacccttgcccctgtacagtccattctcaacacaatagccagattgattctgatgaaacctacatcacgtcatgtcaccccatgatcaaaagcctgcatgatagagtcccgtgtgaccattcagactttatcttctgcgcctgttccctcagttaccctacctcagccaccctggcttccccgcagctccttgaacatgccaggcacatgctgtctcatggccttcactcttgcttgctcttttatcccgccagatctacgtggcttgctccttcatccccaactctgtgctcagatgctgccgcagtaagacagtccctcatcacttatttaagattgcaaccctacccccttagaaactcctgctctacttactcctttgctcttttctcacagtattctaccccatctaaataatttactgacttcacttggtcactatccatctccaccactagaactagaatatatgctccatgagggcaaggtagggaagagaggacctagcactcccaaagtatcggttgaattattattatccattcagaagtgttacggtgactcctagattttataaatgtacaactgtaaaatgttccaattcttcaacatttttaagaaatctgtttgggccaggattttggatatctcttatgcctatcatctctataaagtttcaccatttcctgaaactgattttattaaaagataaggtatttttgttcacaaactatatacttagtaaagtgaaaactacagttgtttttctgattttctagctggcagcctcaggaaacaaatgaaagtcttaagaattaccaagatgccttgcttcagagtgatctcacattgtgcccggtcggagtaaacacagaatgctatcgaatctatgaggcttgctcctatggctccattcctgtggtggaagacgtgatgacagctggcaactgtgggaatacatctgtgcaccacggtgctcctctgcagttactcaagtccatgggtgctccctttatctttatcaagaactggaaggaactccctgctgttttagaaaaagagaaaactataattttacaagaaaaaattgaaagaagaaaaatgttacttcagtggtatcagcacttcaagacagagcttaaaatgaaatttactaatattttagaaagctcatttttaatgaataataaaagttaattatctttttgagctaacatgtgatttttaaaatcattttgactactgggtgtataaatgtgtttgtgtgtgtatgtatttatagatgttctttaaggtacccttgaaaactctacattatgtatgccacataatgacatttcagtcagtggtagactacatatatgatagtggtcccataagattataatggagctgaaaaatttctatcgcctagtgatgtcatagcctagtgatgacatatgtattgcaatacatcactcacgtgtttgtggtgatactggtgtaaacaaatctattgcactgccagtcaagtaaaagtacagcaattatgtcctgtacataatatttaataatgacaataaatgactatgttactggtttatgtatttactatactatactttttacaatttgtattagttcttgcattgctatgaataaatgcctgagattgagtaatttataaagaagagaggtttaattggctcacagttcaacagactgtacgggaagcatgaaaacttcaggaaacttaacaatcctggcagaaagcgaaggggaagcagacatgtcttcacgtggccagagcagagggaaaagggggtgggtgctacacacttttaaacaaccagatctcacaagcactcactaccaggaaagcagcaccataggggaaatccacctccatgacccaatctcctcccaccaggccctgcctccaacactggggattacaattcaacatgaggtttgggtgaggcacagatccaaaccatatcatcattattttcgagtgtactacttgtacttattaaaaaaaaaaaaaaagttaaacagcctcaggcagatccttcaggaggtatccagaagaagaaggcattgctatcaggagatggcagctccatgcctattattgcccctgaaggccttgtggtggggtgagatgtggaggtggaagacagtgatgttaatgattcttactctgtctaggcttaggctaatgcggttgtgtcttcatttttaacaaaaagtaagaaaataaaagtaacaaattttttaaatttttaaatagactaaagtttataaaataaggatataaaaaatatttttgtacagcagtataatgttttcagcagtgttattataaaataatcaaaaggtttaaaaagttataaagtaaaaatttacagtaagctaacattaatttattcgtcaagaaagaaaaatattttcttttttctttttctttttttttttttttttgagacgaagttgttcttattgcccaggctggagtgcagtgccatgatctcggctcaccgcaacctctgcctcccaggttcaagcgattctcctgcttcagcctcccaggtagctgggatagcaggcacctgccaccacgcccagctaattttttatatttttagtaaagacggggtttcatcatgttggccaggctggtcttgaactcttaacctcaggtgatccatctgccttggcctcccaaagtggtgggattacaggtgtgagctatcgcactcagccagaaaaatatttttttataaatttagtgtaggttaaatatacagggtttataaagtctacagtagtttacagtaatgtcctaggtcttcacattcactcaccactcactcattcactcagagcaacttccaggcctgcaagctccattcataaaagctctacacagatgtgccattttaatattttatatcatatttttactgtaccttttctatgtttaactacacaaatacttacatttgtgttacaattgcctatggtattcagtacagtgaagtgctatacatataggtttgcatcctaggagccatagcctaggtgtgtagtaggctgtactattcaggtttgcataagtacactctatgatgtttgcatgacaaaaccatgtaaggatgtgtttctaaggacatacccctgtcattaagccatgcatggctatagttctttagtatcttcagaaagaattagagtcccgcttgctgtaagttgtctggcatatgacttggcatcttcagtgtgtcacaggccctcaaatggctcttttagccccacctagatgtcttttgggcacttaaaccacataactacaactgtattcgttattgtctttttccacaatatacacacacaaacctatttcctctcaaacatttttaatttcagtaaatggtttcattagctgtttcccaagctacaatctgtaacatcatatttattcctccctattccgccaattaatcaccaaattatgtgccttttacccccaagtcttcctagaataaggcctctccctccatccccaccacctctccctcatttgcagattttgtcttgtctcagagggacaaccacaatagtgtgtcttccctgcctctccaactctcagcactgccttagtttcatgggtgcaagttaatcatttccaatt

SEQ ID NO: 15794 - DNA, 123513 bp, Human
  misc_feature (1)...(123513): n = A,T,C or G
caagcaattacccccattgtattttaccttattctgtaggaaatgtttcctttagtgcctctcttcaggaatcttgagggacaggcaggtatcttattcctatttgtatcctaggcctagcacagagcaggaacacactcaattgagccagcaggttctcaatgatttttaaaattacattaataattaacattaagtaagcactgtggcaagcactgtatctacattgtttcattcaccagtcattttagaagaaaagtacttttattacccccattttacaataaccgagagaaagcaaaattaatttgatctaaggtcaaatatgatctaagactaactagtgaggggcagaactttttctccaggctttgggcttcagatctgggctcttcaccaccacagatgaacaagtggataaatgaggacttcttttcattccgtggctgaagaagtgacatggaagagtctaccattcattttacagatacaattatgtatctgtaatacataatacataattatgtatctgtaatacataaaattacagtaagtcctaactcactgatgtttctaacttctgaatcatctttttcttcttctttctttcttgcaatcctaaaaccgtcagagaaactgttttgaactcatattgaagtgtaacccatccaagcactgggtgttttatgggaaagagaataaaccttttgtttggttcttacttcttaccacccattcatttgtaactatacaaatatcaagcacctactgtgtgctaggaacctttttttaggcactagagagacagaagtaaacaacaaaaaaatagtgagacctttacatacactagttctcctgctcgtcacaataactatatgaggtaatgatgacaacaataatagttaactcttaacagtgcttatctgtgcggggcactgggctacctgcttaatttgtattaactcattacaataagcttgtggggtaagggatatgttttccccattttacagatgagtaaagacacagagcaggaagtgatttgctcaagcttggaacccaggcagtgtggctctaattcccagtctattaactacagggcaatattttgtttcttaaatttatatcttcatatcacaacttttaggttgaggagtcttatccccatccagatcatctgactcccaaatccagaggtttgcacctgcaccccagcggcctcgcgaaataaatgagaatgtcttggaatttttgccaatactttctcttccaaagaactcaaactgatttccacgtaattctcactgatttgtgaaatgaaccttcctggactgtaaatttccccgcaaagagagggccagggccccgggtcgttttatactggccggggcacccagcagatggcgctatgttagtggccaccagctggctgccccgtcccccgagctcaccgcctccgccgaaagcttcccggccctccctcgctcacttctctctccccctcccaaccgagcccgggcccacgtgacctcaaggcggccaatgggtgagcagagagggcgagctggtccctgtggccgccattaaagcgaagggaaaacccgtgaattcggattaaagggggaaaaacaccgcccgctgggcccacaaaatgggggagactacggcgtccagccggtgaggccacaggagggcaaactttaggccggcttggcccaggaacgacacgaagacagagccagagaatggtctgagcccgcagacgccgccaccacctccgccgctgaggagactctgggcttaaggacatcgccgctgccgcgccgggggcctgggcttctctcccggttctcgcccttcccgctcctgtgcgggcgcctctccgcccgggagaaccgtcctgggcttgggctctgccgtctcggacttgattttgattatttattgtgtaatttattatttttcttgtggtaggggcacnnnnnnnnnnnnnnnnnnnngtcggaggcggcggtaatggcggatggtgggttgtggcgccggcggcggctgctgtgagggacgatgagtgcctccttcgtgccgaacggggccagcctggaagattgtcactgtaacctcttctgcctggtgagtgccggggccggcgggcgccgagggaggggggccgcgaggtgcgcccttgggccgtgggggagggggccgggtctggtccagatgcccgagttcccgggcgaggcccagccggagccggcgccctgcgaagctccgcggccagccccgggaggcggcgttcgctctcctacggtcccgggctctgtttaggggagtgttggcattttttctcgtcttgtttcggactctccttctcaccgtagtctcgtcctcaacttgagctccttatctggcaggacagtaacctttccctcttgtcttgcttaactgttgcttttctccttattggccctgtatccctgcttcacactttacattattgcccctgctccccaccgcctttatgtcttacccttttaatttggtttccccatgtaaacaggaccccagaacttaagccctagaaacctgtcttggttttacattttttttgtatgagtcaaactaacgccaggttagtttctttcttgggtgacttaagatctctctgtaaaagccagtaggtgccatttcatatgttttctttttaaactttgaaaacagtttgccatttttgacaatttctagccatcttgcttttattagaacatgatgtttttgtgagagtgaagggggctagtggacgaggtgctgtggttttgcactgtttctatatttattgtgttttggttgctttttcagaatgttttgagcaggctgctcccttgtttgattgaaatggaaagtcgagagaagcgggatgtagggatgatcattgtgtaggttagcccaggtctggtaacatccaacagttaaggctttcagaagtaccaactgttgcaaataacttgtcctgtatgggacagtagctgagcttcatcaatgactttaagtttgggtgactttactttttcattttctcctttgtgctatgagaaatattaagagtatatgataggtaagtgagttaagtgggaggagcacaactagttggcaagtgtaaactgccagtcatgtatcagcagtttcatttttggcaccttatgctttgctcctttaagttagattaaattactgaattcctcttgtcgaatttcttaacgcccatgctaaattgagatctttaatactctatcctcgtctacagtatgtttttcttttcaatgtccattaatcagcatctcttcacatgtaataagacatacaccaggttttatatttctatcttatccaactcagtctatttttggtacttttaggatcagttctttgaagatagactagcacaaatctgacagttctttgtgagtagctatttgacttttccgacaggggtgtgtgtgaagaattaacatagattttttcagaacttgttcagatgtcttttcattagagacgttacttctgtaaatgtggaataaaaacccatgatagggtctttaataattgattttcagttaaaagtttgacaccagtgaacaaatgtgaccagttaggacagagaaaaatgtactctgtttgcatattgaagtgtgtgtctatatttaacatcattcagtttcttctgtttctacttggagtacatatttgcttgctattcagtgacatggtggtggtaatttttaactgtattcttctccctaaaattcttggttgttgaattataaagtctttttttgttctaatttgcagtcaatatctcaagcatacattgaaaaattgtaatgtcttaatgaaataagagacatcatattgagtacttttgactttgagtgaatatgcagtaataaaacttaatgctttctttccttcaggctgacttgacaggaattaagtggaaaaaatatgtatggcaaggcccaacttctgcccctattctgtttcctgtgacagaagaagaccccattttgagcagttttagtcgctgccttaaggcagatgtacttggtgtttggcggcgagatcaaagacctggaagaagagaattgtggatattttggtggggtgaagaccccagttttgctgaccttattcaccatgacttatcaggtgaaagaaactttccatttctaactaatgatatagcaacattgtatacttctcccagaatgtcatatgtattacaaattaagtttgtttttgtgggagacttaggaggccagataaaaattcagcttcattgttttatttcaccatgattattttattttacttaaattatccatgttgttatagctgggtttttaaggcgtgaatgactttctccttccaccacctctcttcttaatttctcacaggtagttagggcccgaagaaggcatgttacattaatctaaaaaaatggaatcaggaaacagagttcctaacaaagtcgtgtaatagtttagaagccagatgtaacttttgagtcacttcagccactgctgaagttgagtcttttgcattgaataggcagatgattctaaaagtactggaaatgtaactatccgtgtgtgtgtgtgtgtgtgtgtggtgtgtgtgtgtgtgtgtgtgttttaaggcatgtattttgttattgtcatttgtgctatttgattaacttatgaaggcatatgttaatttagttatttttggaaagtgactcatatactgttctgtcaaacataataagagaaaagtgccaacttgtttagcttttatgggacatgggatcataatctaaaaggttacacaaacaattttattgtgagcaaatcaatgtgattacttccttattttcttgacttttaggaccaaatgctactttagaaagagaaactatagcttttcatataattactgaagctttaaattgtgaaagtcagtattaactgaatcttagataataggaatataaatgattggttgtatgctataaggttccaaagacttcagtaagatagtttgataatgatttttgacagataaacttaggatttctagataattttttttaagttcttatttgaaattgagtactctgaagtttttgttattgtatctctgacctataggatctattttatttttggatagaatgtattctaggtgtctgtatcttgaactggtacttagtaagaccaacatttatgtaggaatgtacgtgttacatttgtatgttttgataattgcttttcacattctaatgaacatactctccagtgttaattgttatttttgagagtgactgcaattcttcaagaaagctttccagcttttgtagtttttctaataagatgcctgctgcagagtccagtccttagttgtgtgtatttaatgtagttctaaatgtgtaaagtgatgtgtatatgtatatacatatatgtacatatacatgatgtatgtatatatggtagttttagcgagacaatactttctaattatgccaaaagctaagtccgccagcctcctttttctttcattgttttggatatagtatttgagttattttaatcgttaagtggtcataaaaatcaccttactagaatgtttggagactgtataacattgttgaaaaactataaactattgataaaatatatttgttgataaaacataattattgataaaactataatggtgacttaggggctttggtcttcttaataaagttggcagagcatctaaacagactaaacagatctttttttaagattccatgaaatacactttgtagaatcaaagataattttaagagatacataatgtttaattttttttttctttttttctttttaagtagagatggggtcttgctgtgttgaccaggctggtcttgaactcctgaactctagtgatccttccatcttaacctcccaaagtgctgggattacaagtgtgagcccctgcacctggcctagttttaccgtaatagaaaaaatattgtgaaagttaaaagactattaaagttagatgtgagctgctttgatggatattgttaaaagtcagttttgtcttctaggtttcatgttaccagtcagatatgttttctccactgaaactaggttacagtcttaaacatttttctctagctttgatttttagcgtaattttcaaaaatggtagttacttgtacctttaaaatagtgatcagctgggtgccatggctcactcacgcctgtaatcccagcacttttgggaggctgaggcaggcagatcgcagggtcaggagatagagaccatcctggccaacatggtgaaaccccatctctactgaagacacaaaaattagctgggcatggtggcacgcacctgtagttccagctactcagtaggctgaggcaggagaattgcttgatcccaggaggcggaggttgcagtgagccgagatcttgccactgcactccagcctgggcgacagagtgagactctgtctcaaaaaaaaaaatagatagtgatcttgaacgtgaatgaaaataattttgggaggttggttttttttttttttttgagacggagtctcattctgtcccgcgggctggagtgcagtggcgtgatctcgctctctgagtgcagtggagcttgcttgctgcaagctctgcctcctgggttcatgccatactcctactacctcagcctcctgagtacctgggactacaggcgcccaccaccacgcccggctaattttttgtatttttaatagagacggggtttcactgttagacaggatggtctcgatctcctgagcttgtgatccgccagccttggcctcccaaactgctgggattacaggcaggaggtagggttttaactgctgtcagactttactgaatgctaatgaatggtaaatagctttttttttgagatggagtcttgctttgtcgcccaggctggagtgcagtggcgcaatctcagctcactgcaacctccacctcctgggttcaagcgattctcctgtctcagcctcccgagtagctgggattacaggcacatgctgccacactcggctaattttttgtatttttagtagagatggggtttcaccgtgttcgccaggctggtctcgaactcctgagcgcagacagtccacccgcctcggcctcccaaagtgctaggattacaggcgtgagtcactgcacctggccgtaaataacttaaaaatttatcaaagtgaagtgattgaaataataaactgaaatacaattaggagtggtatatgatcatatttattgttccaaagcttgtcctgtactgttttagtttgcatagtcagtgttatttatataatattttagcttttcttaaaaataaaacctgttatttacttaagaatgttgttacttaaatcagacgtatcttaaagcataataaggttttttcagatggaatatatttgtcttgcccttttctttgctctagggacagcgtctacctccctcttggggtaattagtctgcctctgtctctctagctaacccctttttcatttcttccatctgtggcactctatttccttcttctaagctcccctgagaagagagcagctggacagtacagggtagcatcagctgctggaggcagtcctgagttccaagtggaggtgtagcactgaggaatggggtaccggaaggacccaggtggtaactaaaaagctggttaatttagcttgagcctgctcttcacaggcagtgtccttctgtttggttcagcacacaccacatcttgttactgaagtgttttttattatggtgataatattgcccttgtttttcttggtagtgagggaagagggaaagcatttcttttttcaaagattagaattctcagtttttcttaactggaatattcagtaacagaaatacagaattgcctttgtttaacccccttagctcctttgtgtcatgcagtgtatttttaaaaattaactaatgaaccaatattgatactttattattaactaaagtatatatttggatttcctttatttttttgcctaatatgtttttcttttctaggatctcatttaagatacccctattacatttaattgtcatgtctccttaggctttgttagactgtgacagtttctcagactttctttggttttgatgatttcgacagttctgaagaatctgttcagattccatagtgcattttaaatttcattttctcttatgtcacttagcatttgtttgggttaccttcctttcaagtttagctgatgtgtagaaatagaatgtaaacttattttattgctaactggcaaagatcagttacagcaaatcacgtctgatttaatacatactttaaaccctcagttactcattttgtagcagtaagtcaataccgttgagcaaagtaatttgcaaaggctggatgatttttggatcaggatttgtgctaactagtattagccaaactataacattccagaaggttatttgttcaaaaaatctcttgaattccaaagccaaacatagatgattttcttactttttgctttatcctctataggataatgattagttgaatcggggtcgatatgttttgatacaaaaaggattagggaataaaactcctttggggttacagcttttttctttctttctttcttttttttttttttttttttttgagatgaagtctcgctctgtctcccaggctggagtgtagtggggcgatcttggctcactgcgacctccgcctcccaggttcaagcgatccttctgcctcagcctcccgagtagttgggactacaggcatgtgtcatcacgcctggctaatttttgtatttttggtagagattttaataggagtttcgccatgttggccaggctggtctggaactcctggcctcaggtgatctgcccgcctcagcctccccaagtgctgggattacaggcatgagccaccatgcctggccccttttttttaaaaattgtattttgtagctttgtttagtggttgtgtgatagtgggtgaaagaggtataaaatgggtgatgggaaaatcttagctcagtccctctggtcaagaatctctgtggtgggtaggactggtacttttaagtgtactgttaatttgcttcagagcaagattgtatcattttcattaatgtgttcttgaaggagagttttctgtgtatttttattctgtgttctaacatttttggaattcaattgctgtcatcattggcttttattctttccctttaaataaaaataaaagcaaacactgcgtcctctcccatttgtcatcttaaaaaaatcatagcaagttagactgtgatgagactctttgagaaaactgataccttgtgaactaaaaaaactcagggctaaaaatatttgttctttttcctggctcctgaggtctgtaaagtagattttagtaacatgttcagatagttttattataccagaattttatcataatgaatagtgctcaaactaagtggactattgttctgaatttaattttggatgttttaattgaaggatattaactgtagtggactttaaccttaaatgacagctgttaataggattgacagatagataaacagccaggcataggaatctagtcccagccaaactaaaacattgttgtgtgccccacatagtctaaagagagtaatttatttctactattgtaaaatttacttgtgatgtggcccgactctttaaattggctagtctcctaggtgacaacttcatttgctgtatttcttctgcatactgtttttttgatcaagtgtatcttctaagttttcaagccaaacataacatactaggctgtttttaaatcagttttcaagttttgccatagataatgatgcggccaacttaaggctctcggtatatttgttgaatgtataggttattaatgattattcaggagaaacactgatctagcatttaaacatttctctttatttcaggaaatacatggtattttctaccatgttaatttttgagccattattcattagcatatgttacattttaatagttttgcaaaattgtattggagaagattcattttttaccaccgtggagatatttaaagatgccatttttttgagaaaaatgttgagtgcagggtgtgtctgcttttttggttgtgattttttttccccattgatagagaattattttgatgacttatcacatactttggcactactgtaatctgcatcttcaggaaaaaaatatggtaatcaaatttagcatttgtgttttcttccaataaatagtccataaaaatttcaagaaacactgatgattaagaactgtaatgctaatagtaacagaaaagtactaagaatgcagagttgaactttattttctctggacatagagctacaagagaaggaatttttttttcttttttttgtagggatggaggtcacactttgtctcactcagcctgcagtgcttaatcatagctcactgcagcctccgactcctggactcaagcaatcctcccacctcagcttccccagcagctgggcctacaggcattgccactatgccctactaactaaaaaaagttttttggagtcagggtcttcctgtattgccaggctagtcttgaactcctagcttcaagtgatccttctgtcttagcttcccaagtagctgggattacaggcatgagtcattgcacctggctagaggaggaaaatagttatatagattaagcagactttttctattaggctctggttaagttcaaaagagataggtaaagatttgccatatgttcccttctccttcccctccctattataatgctggtgttgagattcaagaacttgtttcaattagtgtaaatagtgcatatcactatgccttgagtgggttggttgtaccatttcacttttcgtatctgaatacaacgtgtagaaagtacttttattacagttattagattgtcaggatattagaaacttggctcagtaggcttcttgtttctaagtgattcccaacaaaaccaaaaaccttcagactttattgagcgttattaggacttactctcgtttttctcagcaacaaaatatgaaattatattactttagtgtaatggttgcttagttgcttgccatatagatgaggacatacttcagagatacgttggatttagaaaacctcaacaggtggtctctacttgtttgttttatgcatagctcctatttagtgttaatgagaattgtgggcactggggacataagatgcccaccccctctgaaagcattagaataatgagggagaaatgcttcaagattaatactgattacttttctaaaccacattcaatattctttttttttttgagatggagtcttgctctgtcaccaggctggagtgcagtggcgtgatctcggtttactgcagcctctgccacccagttcaagtgattctcctgcctcagcctcccggatagctgggactacaggtgcatgccatctcgcccagctaagttttgtatttttagtagagatggggtttcactatgttggccaggctggtcttgaactcctgacctcagatgatccacctgcctcgacctcccaaagtgctgggattataggcatgagccaccgcacatggcctcacattaaatattcttaaatcatttgactgcaagtttaactaaaatagattttacaaaataaaaccataaaattttcagaatttcatgtgaaaatttataaattgtgctttagcttttactattgcaaaggtttttttttttgtttttttgagtcagagtctcgctatgtcgcccacagtggagtgcagtggtgtgatctcagctcactgcaactcccatctcttgggctcaggtgattctcatgcctcagcctcctgagtagctgggactacagccgtgccatgcatggctaatttttatatttttagtagaaatggggttttgccatgttggccaggctggtctcgaactcctggcctcaagtggtccacttgccttggcctcctgaagtgctgggattacaggcatgagccaccacacctggcctcagcctcccggatagcaggcgtgagccaccacacctggcttcagcctcccagaaagcagatttttttatttactatttttgcgaaggagacaaagtcattttctagttttaaatgactaatttatttgaagtttataacaactgtacaaccttgatacttacaaatggtaactgtgtcttgggtctttgatgctttaaaacttaggagaaatatgttggtagtggtttcttatgtagaacaagtgttacaaccatcagaaggtagggatttttgaaataaaaggtaataaaaataaaagatactaaattgattgtaaagaggtgaagaattggaagatattcctaacataattctgttggaattaagaacatgtatattctagtagtcataagtctcataatttgaggtaaaagtcttaatgtagctatttaattttgaaatggtaggacctcattaaattgaaagcagatcaattgagattcttttctctttttttgtcatcaactcacaaatatgcttgtgatctagacctttaattaattaaagtgaagtcactttgtgctgcttctctattctcctagcctaatactttctttaatgaagtgaaacccataaacgttttggttttaaatggaagtagataacggtgtctttgatataatagaatgtgaatttttcctatttaatatttatgattaatattagacttaaaaaattattctataccaattctgaaatattgtcattttctcaagcttattctacttttttttccctaagcttacctttttttttgtttgtttgtttttttggagactgaatctcactctgtcccaggctggagtgcagtggcacgatcttggctcactgtaatctctccctcttgggtgattctcccacctcagcctcccgagtagctgggattacagggctgcactatgacgcctggctaatttttgtatttttagtagagatgggctttcatcatgttggcgaggctggtcttgaactcctgacctcaggtgatccgcccacctcagcctcccaaagtgctaggattacaggcgtgagtaactgcgcccagcctaaagcttatttaaaataaaatttaaaaaaaaattagttgctttgaaagacttgactatcatttaggagaaaatataaaaccaacattaatctttgtagtggcacagaatttctagtgcagttaaagtccactatcatactttttagttaatgtttattctacccatttgttgtataaattgtgcatataaaccatgtgtaactcttaatacatgtctttgcttttattcagaagctcatattgtgtctgtttttctgtgggtatagtgtatgcatttttggtgttgaattgagaaacgtttgtcttttatttttacttaaacattgaacacagatgacccatatttacaaaatgtttataaaggtatataggctatagaaggagagttaattatatttagactaagcaatttaaaatcttgtaatgaaagttagagtgctgaagtggtatcattatttgtagcacgatttgttggatgctttgtgacagatatgaaatggatagagtacacaaaaaaatttttctgacctacatccagacttatctcaaaatgactgtgttaatgtttttttggtaaattaacttggagtgattaatagatttgttggcaaaattgaagctatatagttagtgaagatagctataattttatttgacagaagtgccatttacaatttaagtctttaaatttttaaatttctcccccaagtaaagggtcctgtactgaataataatcatgggaataatttgtttgaaatgagacctaaggtggctgatagtgcaccgcttgttaggctctgtgccaacagcttcctttttattcatcacttagtgttgtagtggagtcgtggattagaatgctgatggacatgaaatgttttgactttaattattaactggctagtttttttggcaggttgaatgactaggggaattaggacaaagtaacaagtgagccagcttagaaattggcatcataggtgtagagtgtgtttaatattttccaggttatacaaacaagtgtccttttcattaatacaggaaccaattcagtatgttcatgatgtcattgaattttataaggtggaaaaatacttttcaggtaatttaatagaatatgtggcacttagaccttttattccttgtggagtaactttgaaacctgataatgtctagagatacattgaagtgattgtagcttaatattctggggtaagctagtgttgatgaatatagagtttaaactgtaaccttttttacttggctctgaatagattatagtgtcactattttattatttccttcatttctcttttagaagaagaagatggagtgtgggagaatggactttcctatgaatgccgtactctgcttttcaaagcagttcacaatctattggaacggtgtttaatgaacaggaattttgtacgtattggcaagtggtttgtaaagccttatgaaaaagatgaaaaacctataaataaaaggtaagctatcttaaattctgacgtgatatttctttagatttgttcctttttgtgtcttaacagagaatgtgggataaaacaagctaatatacagacatattccagaggttgtcagtgacagagtactagatacagtcaggttttttttttttttaaaccactttacaaacttccctttatacactttaagcattttcttactgtaggaataggctgtattttaatacagtggcctaaattttgatttgtgatgatagacttaatgtgggatgaaagcagagacttaggcttggaagtatcttttttttagtatttgtggaaatatatgcacagcactctgatattaaaattaagtaacaacacctgttaaggatagtgatctgtgagtatgttttggatcaagttaacccttcttattcccaatctctcaattccctttaattaaagtaatttaaatttgtgttttctatataagaccatttactctttgagagcttataattttcttgagcaatgaattaagcaaatttatgacactacttattagactagttgcagatagaggcacagaagacttatgatagatacctccttctcctatgcaattaaaaccttcaggttactcgcttctccgtgatttagataatataaggcatagtctctcaaaagatttaagttcccagcagtcattgagttagtgagacttcaagagagatgaaccagtggcaagtaagttgggatgtggggaagagaaaactaaagggaacttactaatttttcctgaaagatgtgagaggatgtgaagtgaacatttggttgagattgtaatcattttgaggtctttgatgtcatatatgcacatcttttttcatgtgcacctggagtttttgtttgtttgttttttcaaactttttagttttagtaagactggatgagtagataagcctggataaataaaggtgctttcattttttttcctctttgaaaattaacgtaaacctttattgttaacaaaatacttgtgtaagttcagaatgcattcagctggaaatgacagaacaacattaactacttggcttatgtagggattgatttttctcagtagcaagcagtatggaggtcgatagtttagtactggtatagctgttcaataatgtcatcaaggattcaaagttccccagagttttctctgtgccatctttacatcttcatggtcctcccgtgtgttgcacctccagacctcacagtggattccaggcaggaagagaaaggaagggaggaagtaaggaaggtgtggcacctgagtcagaaagtaaattattttctggaaactttagttgacatatctttggccatactaagagaaacaaatatcttttatttggaaacagctgctctgaacaaatgaagtttttgttagtaagaagaaagggctgatagatattagatagataccaaagatcaaagaagtggaaatggatattgggtaggcagttaacaatatctgccatatacatttatttatttattttgagacaaagtctcactctgttgcccaggctggagtgcagtggtgcaatctcagctcactgcaacctctgcttcccaggttcaagtgattctcctgcctcagtctcccaagtagctgggattataggcgtgtgccaccacacctggctaattttgtgtatttttagtagaaacggggttttgccatgttgcccaggcttgtcttgaactcctgagctcaggcaatccacccgcctcggcctcctaaagtgctgggattacaggcgtgagccactgctcccagccaggcatatagatttatgtagttttaagaagtcaaacagattaccaagatttaaaatgaaaggctgcaatcctgagccccaatgaatagatttgctcctcagaagcagccctttttaattcttctgtttcttttaagttacctgtttaaaaattttgaaagacataacatgcttattcttgagttatcatttaggattaatctagtggactttttttttttttggtcacaacagcctaccattgaaattctattgactttctattgagaggttagctatcttacttcccccgactcaacacttggatattggcacttttgcacacacttcttttccctctccttttccttttttttttttttctgatacggagtttcactcttgttgcccaggctggagcgcaatggtatgatctcggctcactgcaacctctgcctcccaggttcaagtgattctcctgcctcagcctcctgagtagctgggattacaggcgtctgccatcatacccagctaatttttgtgtttttagtagagacaggtttcgccatgttggctaggctggtcttgaactcttgacctcaagtgatccactcaccttgacctcccaaagtgctgggattacaggcatgagccgctgcacctggcttcctctccctttccttatcttgccaatatagttataagttttggtaaaaacaatatttgtttatactcttataattttataaatattatttgtaactgagccatagtatattgaaacacatttcatttcattctttttttttttttggagacagagcctcactctgtcacccaggctggagtgcagtggcgcgatctcagctcactgcaagctctgcctccctggttcacgccattctcctgcctcagcctcccgagtagctgggactacaggtgcccgccaccacgcccagctaattttttgtatttttagtagagatggggtttcaccatgtagccaggatggtctcgatctcctgaccttgtgatccgcccacctcggcctccccaagtgctgggattacaggcgtgagccacggcgcccagccttcacatttcatttcttgtacatcgttttgttttcccaggtgttaatgattatccctttttttcacttaattattaatgttatgagttagtaaacacctgcctgtactctgccactttttttgtaaataaagttttgttgtaacacagccatgctcattcattgatagattgttttatgcctgctttcacactagagcagagttaaatagttatgatagagacagatggcttgcaaagctgaaaatacttagcctgaaatattttctagctgactttttgtagtttgctgactcctgatctgtgtacttgttggtagttcatcagtagactatctattagaagtataaatcacttctccctaccttcaaggactttgtataatcttatgagtttccctttttttctcctcttgttaattaatatccctgttgttacccttcattcttcttttccgatttggattagtagttctgtagtcctgtttcacagtagtcatcttggggattctctttgcttttcccttcttgttggatccctcatttctcatttctcctttttttttttttttttgtcttatttactgttatggtggtgcccaacctgagagtagtttcctgagagtgcaaggatggtgatacttttgagatcctctgtgttggaattctgagtcaaaccgcagaattgcaggctcttaagtttctttcttttctatccttataattgatagttttgactgggtatagaatctttgattagcaaccctcttagacttctgggtactaaaatgctaactggaggttctgtgtatgtgagtagcttatgacattgcaggctttactagagtgaatgatctggggacttgactctttttattgggtgcctgtcacccacctgccagtatttgtacgctctgtcacctgcttaagtagttttcccagaggagactttcagtactctgactagagggtataagctgggctgccagtgtttagtgaacctattggggaaaggaggtttggaggtggggctcacttacatagtggttaaattttcacttaatcttttaaatacatcatctcagctgtatctgaatatctctaattctgagtccctctgtttcaaccatttcaaagagtggacctcttaagtttttcactgatctggaagaaagtggagaggctctaatatctttgaactttcattccttctgctttctttttctttcctttttttttttttttttttttttttgaaacagtctcactctgtcaggctggagtacagtggtgcaatcttggctcacttcaacctccacctcccaggttcaagcggttctcatgcctcagcctcccaagtagctgggaccacagacactagccaccacgactggctaatttttgtatttttaaggagacggggtttcgccatgttggctaggctggtcttgatctcctggcctcaagtgttctgcccacctcagcctcccaaagtgctgggattacaggtgtgagccactgtgtccagccccttctcttttcagttacacctatatatccaccttcagggatatatatatacatatatacatatatatatatatatatatgtatatgtatatgtatatgtatatatgtatatataccagtaccttcaacttctgagcctttctgggattctgtggtttgactcagtttataactttgtaagtttaaccactgcacccggctttctttatgaaaaactcttaaaaggctattgataattgaaaatataggctcacacctgtaatccaccactaaggggccgaggtgggaggatggcttgagaccaggagtttgagagcagcctgggaaacatagctagacccccgtctctctctctctctctcttttttaatgatcttattttatttatttatttgtttgtttatttttactttaagttctgcaatacatgtgcagaacgtgcaggtttgttaatagatacataagtgccgtggtggtttgctgcacctatcagcccgtcatctgggttttaagccccatatgcattaggtatttgtccttatgctctccctctccatgctccctatcccctaacaggccccagtctgtgatgttcccctccctgtgtccatgtgttctcactgttcaactcccacttttgagtgagaacatacagtgtttggttttctgttcttgtgttagtttgctgaggatgatggtttccagcttcatccatgtccctgcaaaggacataaactcattctttttgtttttgagatgaagtcttgctctatcgcccagggtggagtacagtggcatgatttcagctcactgcaacctccacctcctggattcaagcaattctcctgccttagcctcccgagtagctgggattataggcacccaccagcacgcccggctaatttttgtatttttagtagagacggggtttcaccatgttagccagactggtctcgaactcctgacctcaggtaatccgcccatgtcggcctcccaaaggcctgggattacaggcgtgagccaccatgcccagccgaactcattctttttttatggctgcagacccccgtctctttaaaaaaaaaaaaaagctgggcacagtggcacacactctgaagtgggacttcagagtcccagctactctgaagactgaggtgggaggatcacttgagctcagaagattgaggctgcattgagttaggattgtgctgttgtactccagcctgggcaacagagcaagaccctgtcttaaaaaaaaaaaattgaaattataactttttttttttgagataaggtctcttattttgtcacccaggctggagtgcagtggcacaatcatggctcattgcagcccaaactgccaggctcaagtagtcctcacacctcagcctcccatgtagctgggaccacaggtgcacgctaccaaggctggttaatttttgtagattttgtagagacaagatatcaccatgttgcctaggctggtcttgaactgagctcaagctacccaccatctttggcctcgcaaagtgctaggattacaggcatgagccagtgtacctggccaaaaatacaacttttaattggatattttcatgaatccaacagatgctgcttgttatttaaccatgtaattgagcactagtgtttttccatgggctgacccatttaggaggggaactaaattaagattgtattttattagtgaagtgttaccagaaatagtatatgctctttcgagttactcttgaaccatagttgtggtataataactgactttattctggaaagataaatgctgctcctcaaatctcttttttacaggaactttcttaccctttttccttctttggaaaagcaagtaggacaaaaatcaagcagctaagtctatctttaagttattacttcggacttcttttctgttgaattcagtggaatgatatagggaaggtagataaagattgattataaattaatgcatttctagaccattctgaaacataagtattatatagactgtttttgttgactaatcaattcacttttggtataagtattctgaaaaaagaacaagagttgtaaagaaagaaaatttatgatgtgaaactactttgacctgaacaaaggagaaaataatattgcttacctttttatcttctttttcctttctttaaaatttttaaagaaaaaaatctcattttctgataatctggacctacatgtagttgtgtgtttaacagtctttagggactgaaagagaggaaatagaatcaaattctagggatacagctaggttacctgtaaagaatcccgcaagtgtaagagtaaccacaggaacaaaccagtcttcagataattggtttaaagaatgatgaccagtgttttcttgaatagtttaggtgttttcctacattgctggggactggatcacatgacaggcattgagttttctagtgagcccacaagcaaatgggttgtagtaagtaccactgacttaatgtaggttttagtctcttctataaaagatattctgaacttgccatgtttgagagtgcatttgaaaaagattatcttgaataagaactttttttttttttaaatagagacagggtcttgctctgtgcccaagatggatggcagtagcgcaatcataactcattgcagccacaaacttctgggcctaattggttctcccacctcagcctccagagtagctgggactacaggcacacaccaaccacgcctggccaagaactttcttaagattgtgtttggttaagctttttgtcatgttgaatctgttgtagccatttagctgagtgtgcggtaaagtttgtgtatttagcaaaagttttaaatgcttctaggagggtatacagaatagaaacatactagtaaagaattctttttttagacagctagttcagtatcttacgtatatagtgacataggaggttttgttaagtggcagatgagattgtgtataggagggaaatagttaatagggaacatgtttgattttaatacatactttaatcttaccccattccctcaactatatataattgatttctatggaaaaaatatgttgttaaatcttttttgatatatttactgtatgtaaaatagttatctttaattccaattttaaaaggcaatataggccagatgtggtggctcatgcctgtaatcccagcactttgggaggccaaggcaggcagatcacttgaggtcaggagttcgagactagcctggccaacatggtgaaaccctgtctctactaaaagtacaaaaatgagccaggtatggtggcatgtgcctgtaattccagctacttgggaggctgaggcaggagaatcacttaacccgggaggtggaggttgcagtgagcagagatcgtgccactgcactccagcctgggtgacaagagtgaaactccatctcaaaaaaggcaatatagagtattacatgttatatatgtgtgtttgtatgtctatattacattatgtgtatacatatagacatgtacatataggatataataaatccttgctggatataacataaagaaaataggattaaatatttggttcaatatgttctaagcctttgtattagaataattagagccctggaattagtagtaaaaaacttagtccatagagagtgataaatttttgattttgtgggataaagcagtaaaagttcacaggaaggaaaggatggctgttgttaatggccattgtattgggcagtgtagatgtagaacattttcatcattgcagaaagttatttttttgggtggtattgcttacacaagaacctttatatttataattaaaacagtacttttggtgcttcaataaagaaattcatcgattttttttttttaaggaagtaaatgaaagaatatgctttaaatttcacccataaagctgtgtttattttctgccatatgtatggcttttacattatctcgtgctctccaaaactgattaaaaataggcaccatgagatgtaagtctcccctgaaaatgtattattaaccattagtagcgttaggatgtcctttggttaggtttctcactgtctccgaaaaggcaaatttctagagaagctaggagctattgctgttaggttttttatggactcatttcctctcttcctgtcatctaatgtactgtccagtagaagtataatgtgagccacataggtaatttaaaattttctactaggcacatttaaaaagctaaaaaaaaactaaatgtataggcaaaattaattgtaatatattttttaattcagtaagtccaaaataatatcatgtcagcatataattaactatgcagaaggttttaatgaaatagtttactttttgtactgcttttgaaattaggtgtgtgtgctgtgcttagagtatatctcagtttggattggccacattttaagtcaccaatagttatatgtgtgtattggctattgtatttacaacacagttctaggggtttaagcccagttgaacttggtagtgtttattagtgaaaggtaccttctctggtggtcagtgaacccttctggaattgtatgctaaattgtgagtatgctttagaatctcaaaggcaagaagaatcccgtaccttgtatcagtcagggtatgaactctctgctaaattaggtgtagttacttcagcagactggatgtgcctttttattgttttccctgtagcctgtctataatgttttgtccttaatgtctgtcatcaagattattatgtatcatttctgaaatcttaaatgatgatgtcactagaatttgcatggtcaattttctacattttcatgctttctagaacgtttatgagaaaaatgctaagacttctcctatttttcctccttgttgaggttttcttacaataatttttctttctttctttctttcttttttttttttttttttttttttttttggagacagggtcttgctttgtctcctaggccagagtacagtggtgtaatcttgactcactccaacctctgcctcctgggcgcaaacaattctcctgcctcagcctcccaaatactcaggacttaggagtacaccaccacacctgactaagttttgtaatttaggtagagatggggtttctctgctggccatgttgaccaggctggtctctaactcctagcctcaagtgatcctccagcctcagcctctcaaagtactgggattacaggtgtgagccaccatgcccagcctttcttaccgtaatttctttctataattcttactgtagactcttacaaatctgtccaagctcatacagctatcaagtgttggagctgcattttaggcatgaaaaatatgaggtagattatggacccctatagaccgatatgtctcctacacatgtattttttttaagttacaggaaatagtaaaaaccataatacttaaaaacaacaataaaaagcagcattttgcagaacacttgaagtggtaaaccagaataatgttgttgctaagttttgtggggtttttttggttttttttttttttttttttgagatgaaaccttgctctgtcaccaggctggagtgcagtggcgcaatctcggctcattgcaactgccacctcccaggttcaagcgattctcctgcctcagcctcccgagtagctgggactacaggcgtgtgccaccatgcccagctaatttttatgtttttagtagagtcggggtttcaccgtgttagccaggatggtcttgatttcttgacctcatgatccacccgccttggcctcccaaagtgttgggattacaggcatcagcccccgtgcctggccactttctaagtattatttactgtataatgtaagtaatatgttcactgagtgagcagaaatatgtacaggattcacaggtaagatgttaacttctggattttagtatagatcttttgttcatggagctatgttaataatacctgatactggtattatacctgtaaatttaaaaatttaaaagttactctgaaggctgtagaaatacagattaatgattcccaaacttgtctggatgtgggaatcacctggagagcttacaaaaaattattgatgcctgtgtcttaacctgggactgtaatctgggctttggaaattttagaagatcctaatgtaagacaagtttggaaacttttgaattcacggaataaaaataatctcagaattaagatggctaggggaggctgggcacagtggctcatgcttgtaatccctgcactttgggaggccaagacaggaggattgcttaagctcaggagttcaagaccagcctggacaacatagtgagacctcatctctacaaaaaataaattctaaaaattatctggacatagtggctcacacctgtagtcccacctaacttcgttggctgaggcaggaaaatcgcttgagctcaggaggtggaagctgcagtgaattctgatcatgccactgcactccagcctgagtgacagagcaaggccctgtctcaaaggaaaaaaaaaaagatgactacagtttctttttattgtggtaaaatgtacgtaacaaaacttaataatttttcagtgtacagttcagtggcattaagtacattcacattgttaaccatcaccactatctatctgcagaactttttcatcatcccaaactgaatgtgtactcataaaagagtggcagctcttcaatttttcttttcttttcttctgcttcagataaccaccattctactttgtctgtctagaaacttgactattgcaggtacctcatatgagtggaatcatgtagtatttgtccttttttgtctgggttatttcagtaagcataaaatcttcaagattcatttatgaagcatgtgatagaattccccttatttttaaggctgaatagtattccgttgtatgtatatactacattttgtttatgtattaatctgtaaatggtatttgggttgttttcaccttttggctattgtgaataatgctgctatgaacattggtctgcatatctctcatcaagtccctgctttaagttcctttgggtgtctacccagaagtggaattgctggatcatatggtaatttgaagtacaatttttggaggaatttccatactgctttccatggtggctgcactattttacattcccaaaggcaatgcagaggagtgccattttctccacatcctcatcaacacttgttatttcctgttttttttaaagctatttttatgggtgtgaggtggtatcttactgtgtttttggtttgcatttccctaatgattagtgatgtgttgagcatgttatgtgtttatcggccatttttatatcatttttggagaaacgacttttgaagtcttttgcccatttttttaattggttgatagggtgtttagagtttgaagtcagcattctctttactagtattatgattttaacacaagccatttaacctctttgtgcctcggattctctactggcaaatgggatatcatttttctgtagctgcttaatacaaatgctagaaataggtttgatgtggcactgcctaatctagcatacatatggaattgttgctgttagagcagccagctttaatctataagcacgtcttcattttctgttttagaaataatcttttgattaatttcagtacttaatttgaggaacttttttttccacgatggaagattgttcaagtttcatttataaaattctgcctcattcataactttttgttttagatattgtagtgtgagctcatggagagcaacagtattctctgcaatcctttatagtaactaataatacttcgaattgttattgtggtgacatgtttttgttttaactcacttttctgagtgttaaataccaaaaatgtttgatgggatgatacaaataacatttctccttggaaaaaaagcaagtctgaatttactatgttagtattttctaattgttttataatattctctgactagaatattgcctttaatataaggatttcggagatttgggtgtggtggtgcacacctgtagttcaagctacttaagaggctgcggcaggaggatcacttgaggttgggagtttgaggctgtagtgctccgcgactgtgcctgtgaatagccactgcactccatcctgggtaacatagggagactgccatctcttaaaaaaaatttcaggccggcacagtggctcacgcctgtaattccagcactttgggatgccaaggtgggcggatcacctgaggttaggtgttcaagaccagtctggccaatacatggcaaaaccccgtctctactaaaagaatacaaaaaaaactagccggacgcagtggcaggcgcctgtcatcccagctacttgggaggctgaggcaagagaattgcttgaacccgggaggcggagtttgcagtgagccaagatcacgccattgcactccaaccttggtgacaagagtgaaactgtctcaaaaaaaaaaaaaaaaaaaaaaatcttggctgggtgcggtggttcatgcctgtaatttatagcactttgggaggccgaggtaggcagatcacttgaggtcaggagtttgagaccagcctggccaacatggtaaaaccctgtctctactaaaaatacaaaaattagctgggcatggtcatgggtgcctgtaatcccagctactcaggaggcagaggaagaagaatcgctttaacctgggaagtggaggctgcagtgagccaaggtcgcaccactgcactccatcttgggcaacagagcaagaaacttgtatcacatatttagaatattgtttccctccagtatcacatacaaacttggtttattttaaaccactgaatgttacaataagatcagactattgtatattgggattacatgctagcagtataggaggtagtgattctttgatcatagactgctgggattgagtgttgttagtaaatagggtagtggcagataaacagtgggagctgagaccattggttacatgttttgtactttggaatactggattgctacaaagactccttggagaccaatttatccctttatatcaagaagccaaattttattttcttatttaacagataaaatggggccagatgaggttagcttatgcttgtaatctcagcactttgggaggccaaggtggagggattgcttgaggccaagagtttgaggccagcctgggcaacatagtgagcccccccgcccctgccatccctagggggaaaaaaaaaattagctgggtgtggtagcgcacacctgtagtcccagctactcaagagggtgagatgggaggatttcttgagtccagtagtttgaggctgcagcaagctacgattgtatcactgcactccagtgagaacctgtctctaaaccataaaattaaaaaatgaagtgggtaagtgctcattggaaagactgttagggaacttgaaagatgacttttatgattttatacatactagagtaaacttattttcctaaataatatttaagataggtcaaattaatgtatatttaaacatttcccatattataatattttcaggaaaatagatttttaaaatgttaaaaatgcttttaaaataatttttaaaatcttttaaaatgtttttaaaataatttttaaaattattttaaaatgctttgtcatgagaaaaatccattttaaatatctttttttgtttggagactggagggcagtggtgtcatcatagctcactgcaccctcaacctctcaggctcagatgttccttctacctcagcctcagcctctcgagtagctgggaccacaggcatgcaccacaccccacctagctaatttttaatttttttgtggagatggggtcttatgctgcctaggctggtcccaaacccctgggctcaagcccaactcctcttgcctcagcctcccaagtgctgagataacaggcatgactggctgtttttaaattctcttatttaatatttcatgtatgaaatgaaacagttgaaaactgtgtttttaagaactatactccactgattaaaggaacagtagataaaaggttataaaattcaggtctcctagccgctgtgtctttttttttttttttttttttttttttttgagatgaagtctcactctgttgcccaggctgaagtgcagtggcaagatctcaacccactgcaatctctgcctccctgggttcaagtgattctcctgcctcagcctccttagtaactgggattacaggtgtgtgccaccacacccagctaatttttgtatttttagtagaaacagaatttcaccttgttggccaggctggtctcaaattgctgggctcaaacgatccacctgccttgccctcccgaagtgctgggattacaggcctctttgtctttttttttttttttttgagatggagtcttgctctgtcacccaggctggagtgcagtggtgtgatcttggctcactgcaacctgcgtctcctgggttcaagcgattctcatgcctcagcctcctgagtagctgggattacaggcgcataccactgcacctccggctaatttttgtatttttagtagagatggggttttgccaagttggccaggctggtctcaaactcctgacctcaggtgatccacccacctcagcctcccaaagtgctgggattacaggcatgagccaccactcccagccattgtcactgctttcttaacaagaatgataaggtttttgtttgttttttgttttagttatattatttttagtttttctgtcagttacattaatttttattttattttatttttatttacttatatgttttttgagacagtcttactctgtcgcccatgctgtaatgcagtggtgtgatcttggctcactgcagcctccacatcgtggattcaagcgattcgcatgcctcagcctcccaagtagctgggattacaggcacctgccactgcgcctggctaattttttgtatttttagggagatggaggtttcaccatgttggccatgctggtcttgaactcttggccttaagtgatctgcctgccttccaagtgctgggattacagatgtgagccactgtgcctggcctaaaaaaaatttatttcgattaaaagcattttttagactagtcacatatgcagtagtggaaagaggggaaagagtagaacaaggagtttgatctgcaactaactgaacagtcaactgaggtaactcactaccttcagactagcctctgtcagttacatttgtaacttgaataacatgcttaaatttctatttcttgttctatcaagtttagacattttgtattgactccatatgtataagatacagaaattcttagctctgtattgctttttgcctcttttctaccatctattttcccacttctgttaactctagcattacttttactataatttaattttaattcactatgttctgcttatccagaagaaattcaagagggcttatacatatataaaacaggttctgagttgattaatatcatagtttaaaaaacttttaaggatgaattcttaagataaatgtgtggagaaggaataaaaagagtttattttcttagtgtacactcttatcctcctctgcgcaacttgacccttctaaattgtatcttgaagatacctctgatgtccttgggaacttttattttccaacctgtatacccagccatacctgaatttcattaaggtgtactgttttgcatatattcttgattctaggatgccttcaactgtaagacccattattgctttaaaataatgttattggttgggaggggattgcattaaatgattagtccaattaattaataaagtgagaaaacatttatagtttcttatatagaggggaaaataggcaaaaataaaaattaagtcactgttaattctgttgtccgcctttattttctttatccaaataaaactttttttttctttaaaaaaaaaaaaaagagctgggtacagtggcccacatctgtagtcccagctgctttggaggctgaggtcagaggatcccttgagcccaggagttacaagccaccctgggcaacatactgagaccctctctctttctttaaaaaagaaaaagaaaaaaaaaattgaccctactattttggtagcctatccctttccaataaacctactcttctattttaacttatttttgtggctatataataattctatgtgtgaatgtacctaactcgtttaactggttcctgtatttgcagcctttcctactataaacagtgttgtaaagaacatttcttatagctaagtctttgctcatatccatgattttttttcttctgatgaagtagaatttttgggcaaaatagggtatgcatttttgcatacttcctaataaagaaaagcaagttaacatttttggccactagtcatcactaagataaaactttttcttcttttttagtgaacacttgtcctgctccttcacctttttcttgcatggagacagcaatgtttgtaccagtgtggaaattaaccaacatcaacctgtataccttctcagtgaagagcatatcacccttgctcaacagtctaatagcccatttcaaggtagattattttattatattaggtatttgatcttttattgaaagatccttatttgacttcataattttacatttggggattgatggaattccccctgatctttagcctaatgatgattttgatgtcatttactttttccttccccattacagtgttaagtcagtgaaataaatttttaaatacaggtattaccaaaaaattcttgaccgtgaatggtgaagtagtttaaagtgttcttttagatagcataatggatttatatgtgttaatgttttcaaggttatcttgtatgtcaggtcatataagccatattttgtttgtttgtttttgtttttgttttttgagacggagtttcgctctgtcgcccaggctggtgtgcagtggcatgatcttggttcactgcaacctccacctcccggattcaagcaattctcctacctcagcctcctgagtagctggggttacaggcgcgttccaccaagcctggccaatttttgtattttttttagtagaactgggtttcatcttgttggccaggctggtcttgaacacctgacctcaagtggtccacctgcctcggcctcccaaagtgctgggattataggtgtgagtgagccaccatgtccggccagagccatgtgtaacatagctacaaagggacttttgatactatttatactatgaaaaaagttgaattctagaagaaatattttataagattgctgaattgcctctaaggcttggcagtgtgttcttattttaactttaaacctaatatttgctttttaaagtttacatggcagtacattataaatatttagatttatatatctatattgtttttcctcagattgctttttcttagaatgctttttcttagtgggagtcaaagtaaattgaaggatacacaaatattcccagcttctgttaaaaatcttaagagtttgggcagacaatttttttttttttttttttgagatgaagtctccctctgttgcccaggctagagtgcagtggtgccatcttggctcactgcagcctctgcctcccgggttcaagcagttctccagcctcagcctcccgagtagctgggattgcaggcgtgtgcaaccacacccagctaattttttttgtattttattagagacagggtttcaccatgttgaccaggctggtcttgaactcctgacctcaggtgatccacccgcctcagcctcccaaaatgctgggattacaggcgtgaaccactatgcccagcctgggcagacaaatttttaacagtttatataataaactcagtgtcatactttatcttcacagtaacgaagtataataagttgatttttctctggaatggttattactggtttccttttcttttttataattgcacgattatttgccacatttttcactgtgttcttatttggtaaaacagtcttttgttacttatttgatgtctgctttgggtttctagttatcttatgcccatttggactaaatggcactctcacaggacaggcattcaagatgtctgattcagctacaaaaaaattaattggtgaatggaaacagttctatcctatctcatgttgcttgaaggagatgtctgaagaaaaacaggaagatatggattgggaagatgattctttagctgcagtagaagttcttgttggtatggatcctgagtattattcctaaggggaaaatgcatgattgtatgtgttagttatattttgctgaataacaaacaagtctaataactcagtggctttcaacaccaaagatttattccttaatttcctgcccacattacttaagggctgcatcttagctggtttggctccatgtatctgctcattctgtaacctaggttaaatgaatatcccagtagctaggacatgctgttcttatgagaacagaagaataatagggactgaacctaaccatgtaagtgtactcagagcttctgctgggatatggtgtatgttacatctgctcacattgcattagacaaagctagttaaatggccaagccaaagtcattggggcagggaaatatattctgtctagagggaagcatgcttaggatgggacagttaattgtgaatgaattaatatttggaggctgaaaagttgacaacctgtgttgtatgatgttttaacatttggtaaaactaccacttccaataacttaagagacagaaaatgtaactaaagaatttatgactttggcatgctctgcctgccaaaagggtcagatttttttatatttttttattatttatttaatttatttttatttttttgaggtggagtctcgctctgttgcccaggctggagtgcaatggcgcgatcttggctcactgcaacctcctccgcctcccaggttcaagcgcttttcgtgcctcagtcttgagagtagctgggattacaggcgcatgccaccatgcccacctaatttttgtaatgctagtagagatggggttttgccgtgttggccaggctggtctcaaattcctgacctcaagtgatccacctaccttggcctcccagagtgctgggattactggcgtgagccaccgtgcccagcctaaaagggtcagattttttcagattggctgtattctctatgtcctctcattcagggacccaggttaacaaagtacccacatctgggacatgttaatctcatagcagaagacagaagtgagagaagctgcactgaccctgcaggcacatttaaagcttctgttaggatgtggcttatatcacatgcttacattccagagcaagtcacacagcctgacaatggagtgaagacatatactctacctcagagaggcatgagaggaggcatggagaaagtataatttaggagataattggaattagaatctaccatattgtatttaagggaatctaatggtaatgttagacgtgaagatcaccttatttcatcttttttttttttttttttttcctgagacggaatctcgctctgtcgctgctcaggctggagtgcaatggcgtgatctctgctcactgcaacctccacctcccgggctcaagcagttctcctgcctcaccctcccaagtagctgggattacaggtgcctgccaccacgcccagctaaattttgtatttttagtagagatggggtttagccatgttggccaggttgctcttgaactcctgacttcaaatgacccacctgcctcggcctcccaaagtgctaggattacaggtgtgagctaccactcctggcctgttttttttgttgttgtttgtctgttttttttttaagaaaaagattaccagtgctcactttaaataaacccattactactagagcagttgtgacagaaacagaaaaaacacacattttttaggcttttaaaatagaggcatatagaaaagtaagtagaaaatggttcataattctagtgtccagattacctttgttaaacttaaacaataaaattgaaaaagtaatacacattaagttggtcagaagtgcacataaagatttaaaaaacacatttctagaaatctaaaaaaaggaaagctgcctttttccaaatctctctcagcaaagataaccaccactgacagcttattgtggtttattgtggtttcttctaaaaaagagaaaaaaaaaaaagaaaagaaaaacttatgccaaagaagcttatatttataaaaatgtatttttatttgtataaatgtgatacctacttttccattatagtacttttgagtgaaactaattcactagtcacaaaggtaattggttttcctgtcccatttttttcctttcagctggtgtccgaatgatctacccagcatgctttgttctagtccctcagtcagacattcctactcctagccctgtgggatccactcactgttcatcttcttgcttgggtgtccaccaagtgcctgcttccacaagagatcctgctatgtcttcggttacgcttacaccacctacgtctcctgaggaagtccaaacaggtatagcagtaatttgtctcatcagctctggtaatttgttattttgtgtacagtaagtacttaagaaataatttattttgaaatagtttcaaacttcttgagaatttacaagtgtagtacaagtaatttccttagccatatttccaaactgttattatttactccatcaccctgtctgtatgatgtacattcattatcattggtctttttctgaaccatttgagaacaacctacagacatgatgtcccatcactcctgtgtactcagtgtgtttcccagaattaaggacactctcctatacaactattactcgatcctcttagtcagaaaatcagcattgatacactgccatccagtttgcattccctgttttagatattttgctttctgtatttaaaagtagcgtgcttttatttttaaaggtttatgtgtttatctataattaaaattactccaacagagcagcccattgctgtgttctaattcttagcccttaagtcctacaaaaataaacccaagcttttacagtaactgtcaatacagaactaaagcgttttagctattaaaaggggtttagttaccaaggtgcttattttcagcaaaacgccctgttactcagaagaacatacgcatatactaaagttctgacccatcgattcatgcaacagtttatatctctgccctccctccatctacctttaaaacaaaaacacagaagaactttttacaatggaggagaaacgtataaaaacacagaagagctttttacaatggaggggaaatatgctcatgctcagctgaccttacaaaaaagactgtctaatttccaactaaatgagaacactaaagtgtttggctaaaatccagcaatgattgactgacccaggtcagaggctggcagggacagaagggccagagtgctgccgctgcaggggctcatcctggcctccaaaccccaccttgatgtggaagccaggctctgtgcagcagctccatggctggtgtccagggccccttcgcactactccgaagtccttccagtctccccacctctggccagcctctgaccttgatgatgtcactctgggcatcaggatagtctggtttgcttatacagcatgatccatgggacacctccttccttgccctcagcccacctcccccgacacgccaccgtgtgctggccctgcctggctcctgagaaccccactcttggtactgagagtggtaggttacagagatgtacttgattgccacatttgcctaatgagatctggttccaaaaagtagcatgctttttatctcaaaatataaataattttaccagatagctggagcagcttgtatcacaaattaataaaaaacccaaataatgttactttaaacctacctttattctcctacagcctgtttttttgttttgttttcagttgatcctcagtctgtccagaagtgggtcaaattttcttcagtatctgatggcttcaactccgatagtactagccaccatggtgggaaaatacccagaaaattagcaaatcatgtggtggatagagtttggcaagaatgcaatatgaacagagcacagaacaagtgtgtattttcatttataagttcaaaaattgcatgttgataattacttataattagaagatatctaaagtataaacagtcatttgtttgatttttctttaactcataatgttgatctttaaaattaatttcaatgctacattgaggtttgatagaaaattttatgaattttaaagaattttgtaactttaaatcttaggaggaagtattctgcttcatcaggtggtctatgcgaagaagcgacagctgctaaagtggcatcctgggattttgttgaagccacacaaagaacaaattgcagttgtttgaggtagattatttcccgatcgattgatgcctatgtgtgatagtttgttacgccactgaatgcttatgcccactttatttgaaacagcttacatgaacatatgtcaggattttttttcaaaagaaaattcaggaaaaatatttcaggaatttgaagctgattatagaagtacatgtaaatataagctttcagttcattcactgttaccagaggcagactctgaaagttttgtttcctagtagctaaataaaagacaattttatatggagctatggtatatatagtatctataagctatacagccatataaatctcttgagaaaagcattccttcctcaatggcactacctgagaaatttatcccaagagttctttctttttttaaaaaatgaagagacagggtcttgctttgttacccaggctggagtgatcatggctcactgcaacctcaaacttctggcctcagtcgatcctcctgccccagcctcccaagtagctagggttataggcatgtgccaccacacctggctaattaaaagaaaaaaaaattcgtagagaggggatcttggtatgttgtccaggcttatttcgaactcctaacctcaaacagtcctccccttggctttccaaagtgctatgattacaggtgtgagccaccatatctggcctacagtaatctttttttattttttattttttgagatggagtcttgctctgtcccctggtctggagtgcagtggcgtgatctcggctcactgcaagctccacctcccgggttcacgccattctcctgcctcagcctcccaagtagctgggactacaggcgcccgccaccatgcccagctaattttttttttttttttaaagtagagacagggtttcactgtgttagccaggatggtctcaatctcctgacctcatgatacaatctttttttaatagtaaatacagtgttgggttttgaagagtaatttcatttctttttttttaagcttttatttttggttcagggttacatgtgcaggtttgtgaaataggtaaagtcatgtcacaagggtttgctgtatagattattttgtcactcagatactaagcctagtacccagtagttactttttctgctcctgttgctcctgccagcctccaccctcaagtagaccccagtgtctgttggacccttctttgtgtccatgagttctcatcatttagctaccacttataggtgagaacaggcagtaattggctttctgttcctgtgctaaggataatgacctccagctcatccatgttcctgcagatgacatgatctcattctttttttatggctgcacagtattccatggtgtatatgtaccacattttctttatccagtctgtcattgatgggcatttaggttgattccatgtctttgctattgtgaatagtgctgcagtggacatttgcgtatatgtgtctttatggtagaatgatttatattccctgggtatataaccagtaatggggttgctgggtcggatggtagttgtagctctttgaggaatcaccactgctttccacagtggttgaactattttcacttccatcaacagtgtataaatgtttccttctcaacctcgccagcatctgttattttttgactttttaataatagccattctgactggtgtgagatgttatctcattatggttttgatttgcatttctctaatgatcagtgatgttgagcttttttacatatgcatgttggctgcacatatgtcttcttttgaaaagttttcatgtcctttgcccactttttaacaggattttttttatatataaatttaagtttttttagatactggatattagacatttgtcagcatagtttgcaaaacttttctcccattatgtaggttatctgtttagtctgttgataatttctgtggctgtgcaaatgctctttagtttaattagatcccatctgtcagtttttgcttttgttgtgattgcttttgacatcttcgtcatgaaatttttgcccatttctgtgtccagagtggtattgtctaggttgtcttccagggtttttatagttttgggttttacatttcagtctttaatccatcttgagttgatgtttatgtattaaggaaggggtccgatttcagtcatctgcatatgactagccacttataccagcaccatttattgaatagggagtcctttccccattgcttgtttttgtgagctttgtcaaagatcagatggttgtggcagtgcagccttatttctgggctctctattctgtttcattggtctatgtgtctgttttagtaccagtaccatgctgttttggtaactgtagtcctatagtattgtttaagccaggtaacatgatgcctccagcattgttctttttgcttaggattgccttggctatttgggctctttttgaatttcatagaaatttaaaaatagtttttcctagttctgtgaagaatgtcattggtagtttgataagaatagcattgaatccaaattgctttgggcagtatggccattttaaggatattgattcttcctatccatgagcatggaatgtttttctgtttttttgcatcatctctgatttctttgagcagtgttttgtaattcttattgtagagatctttaacctttctggtaagctgtattcccagttattttactctttttgtggcagatgtgactgggattgcatttctgatttggctctcatcttggctgttgttggtatatagggatgctagtgatttttgtacagtgattttgtatcctgaaattttactgaagttgtttatcagctgaaggagcttttgggctgagactgtgaggttttccaggtctagaatcatgttgtctgccaacagggttacttttgtttcctttcttcctatttgaatgccctttatttttttctccctgattcttctggccaggactccccatactattttgaataggagtgagaggaggcattcttatcttgtgccacttttcaaggggagtgcttccagctacagtctttttttttttttttttaatgataaatacagtgatggattttgtggagtaatttcttataacattctttgggcagctgtaggtgaaatgttgaaataagattcagaaaataggattctgtaagggaagaactgtcacaagggagcaaaactcaaagcatgacaaaactgtcacgctttctaatggattatattggttgaatgattggtagaagaatagatgaacgtggaattctttagaaatttatttagtttataaaggccttttgataaggtttggttatgagaagttttaaaattatgttgcctagagtttattattttatcctgcagattaaacatagatcataggcttttgcattcaagtaaacagtaatggccttgacatccctagtcagaacttgtgatggaatagatggtcacctgtctttctcatggaagtgaaccaaacaaatggagtgcctgcaggttagggccaaggtttttcttacatttgctctgttggtttgaatatataataacagactctctcaagtgtgctgttatgtttttgcataaattgaatattcttatggaggctctttggattaaagaatacgtaatttttaaaagtctggcaactttgttgaaaatttacctctgttagagagattggaataaaaacaaggatatatttagctattgtttagcagtttaaaatagctaaaaaaaccacacctaatctgaacataatttgtataagaatgggggtcagcaaacagtgatgaattcgccatatttggcccactgcctgttttgtatggcctgtaagctgaaaatgattttttttaatttgtttgagacgatatctcgcagacaggagtgcaatggtgtgatctcggctcactgcaacctccgcctcccaggttcaagcagttctcctgcctcagccttcagaatagccaggactataggcacgcgccaccatacctggctaattttttgtattatttagtagagacggggtttcaccatgttggtcagtctgttctcaaactcctgacctcaggtgatccatctgccttggcctcccaaagtgttgggattataggtgtgagccaccatgcccagccaactgaaaatgatttttacgttttttaaaagttgaaaaaaataaagaatgttttatggtatgtgaaagttgtgtgaaattcggatttcagtattgataaataaggatttattagaacacagccacattcatttatttacatattgtctgtggtcacttttaccccacaatggcagagttgaatagttgtgacacagtctggcccccaggggataaaatatttactctctggttcactacagaaaaagtttgctaatccctggtctaagactaaaagaatgcttaaatgtaagtaagcttttcccaaactaccatttgaccgagcaatcctattactggatatatatacccagaggaatataaaacattctgtcataaagacacatgcacgggaatgttcatagcagcactattcacaataacaaagacatggaatcaacctaagtgctcatcactgacagcctggataaagaaaatgtgcatgtacaccatggaatactgtgcagccataaaaaaaaatgagatcatgtcttctgcaggaacatgaatggagctggaggtcattttccttagcaaactaatgcaggaactgaaaattaaatattgcctgttctcacttataagtgggagctaaatgatgagaactcatggacacaaagaagggaacaacagacactgggtccagtggaggctgggaggagggagaggagcagaaaaaataactattggatactagtcctttaatacctgtgtgatgaaataatctgtaaacaaacccccatgacatgagtttacctatataacaaacctgcgaatttacccctgaacctaaaataaaagttgagaaaaaaataaattaggattttctttcccactagtggaatttttatcaaatagttctgttttagttcctaaactagacttttttattctttttgaaaaggtggattttaagtattttgtctaaaatggttttagaggaaggcattaaaatatgcatgttggcaacacaggtttaaattcttggtctttaagctgaacttttatttttaaaaagttgttttctcttgtccaggcgcagtggcttatgcctgtaatcccagcactttgggttgctgaggcaggtggatcacgtgaggtcaggagttcaagaccagcctggccaacatggtgaaataccatctctattaaaaatacaaaaattagccaggcatggtggcacacgcctgtaatcccagctactcaggaggctgaggcaggagaatcgcttgaacccggaaggcagaggttgcagtgagccaagatggcgttactgcactttggtgttggtggcagagcgagactccgtctcaaaaaaaaaaaagtcatttttaaaagtattttcagaaatttctcagaggcatatagagatttaatatgctaaaattttacataatcgatacgtgtgacttgctttggttagtttgctcctttagtaaatacagcatttctaataatttacttaaaaaaattagtattacattttgtactttaggtcttctgcccaccacaaatctagcttatttcttaagtgaaggtaagacagatagacagtgagctactacatgtgtatcctctttgccatagaatatataggaggttggggggcatacattgataactgactctgttaaatcggcctctagctcgctctcaaatccatttctgctttttctctgttctgttctgtattgcagggaattaaatttcctagactcgtttgctttctggagttggctaataggaggcactaacagaagattggagggtgagaggagggaagaagccagggtctttccccagtccctttttgagccaactccagcagcagctcccttgtgtcctattaacacagccccttcctcatggtcccagttactactgagcagatcctgctatggttctagcaccatcctgagcttctgggatatggtgagactacatcatcttattgtcctttcagtgctagaagtcatagaagctccctgctattactagtctctgggtttcctcactttcctctgttttgtataaccggttctctatagtgaatttcttctgtgtgaaagataggtctggaccctgcctgataacattggcttctcttaaaaattgatttgggaagaaaaaaaattcataactgtaacagacaatttacatgaatagaaattattttaagaaatttaaagtatatgaataaagcctaagttccccttgaccatcctttctctcccccaagcctactcactctccctagaagtggctagttgccaattagatactatttctccatacttaattttatgtattctcctctcaacacataaatattattatttttttagagactagctgtgtcgcccaggctggagtgcagtgatgaaatcatggctcattatagcctcaaactcctgggctgaaacgatcctcctgcctcagtctcccaactagctagaactacaggtgtgtgccacaatgctcggataatttttaaatattttgtagagacggggtcatgctatgttgcccaggctggtcttgaactcctgggctcaagcgatcttcctgcctcagcctcccaaagtgctgagattacaggcatgagccaccatgcctggcctcacataagtattattctgatttatttttcacagctaatttttttcacttaatgtgcctcagatctttccatattagttacttatatagctctgcttcattgtttaaaaattttcctgtggctgggtgtggtggctcattcctgtaatcccagcagtttgggaggccaagggagaaggattgcttggggccaggagttcaagactagcctggacaatgtagtgataactctcttttttaaaagaaaaatgaaaaaaatgttattaatattccactgaatggaagtatcatagtttatgtaatcattctggatttgatggacatacagtttgtttccataggtgttttttgcttgtgcttgctttaaaaaaaaagtaatactgctgtaactatcaattatttagtaggtttttttgaatccttactctgtgacagaaggtgtcctaggctcagaatacactagctaacaaagctcctgctattatgaagtctgcattctcttggaagtgaggcagataatttgtttttaagaatatatatatatatatatatattttttttttgagacagtcttgctctgttgcccaggctgaagtgcagtgatgccatctcagctcactgcaacctccgtctcctgggttgaggggattcttgtgcctcagcctcctgagtagctggtgctacaggtatataccaccacatccagattaattgttgtatttttagtagagatggggttttaccatgttggtcaggctggtctcaaactcctgacctcaaatgatccacgtaccttggcctcccaaagtgcaggaattacagacgtgagccactgtgcccaggctttagaaggattttaaatcctttttaaatttgaatgagtgctgggaaggaaataaactaggtgggtgatgtgataaagagttgtaggcgagagggctatttaagtacgtgtgacatcaaaaaaggttctaccgattttactcacactttttgcatatagaaaatgttggtttttcttgtgatttcactgatctgagaactatcctcaaaattattttttgccattataataagtgagaagcataaaattgtttgtcgcatttttcattagcgagattgaatagcgcacatttactgatattagactttagtgtggtggaatgttcataggaaaactgcacatagaaagcaggctgctcgccccgtccgggaggtgaggggcgcctctgcccggccgcccctactgggaagtgaggagcccctctgcccggccagccgccccgtccgggagggaggtgggggggtcagccccctgcccggccagccgccccgtccgggagggaggtggggaggggtcagccccccgcccggccagccaccccgtccgggagggaggtgggggggtcagccccccgcccggccagccgccccatccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaagaggggaaaggcggggaaaagattgagaaatcggatggttgccgtgtctgtgtagaaagaggtagacatgggagacttttcattttgttctgtactaagaaaaattcttctgccttgtgatcctgttgatctgtgaccttacccccaaccctgtgccctctgaaacatgtgctgtgtccactcagggttaaatggattaagggcagtgcaagatgtgctttgttaaacagatgcttgaaggcagcatgctcattaagagtcatcaccactccctaatctcaagtacccagggacacaaacactgaggaaggccgcagggtcctctgcctaggaaaaccagagacctttgttcacttgtttatctgctgaccttccctccactattgtcctatgaccctgccaaatacccctctgcgagaaacacccaagaatgatcaattaaaaaaaaaaaaaaaaaaaaagaaagcaggccaggtgcagtgactcacgcctgaaatcccagcactttggaaggccaaggcgggaggatcacgaggtcaaaagatcgagaccatcctggccaccatggtgaaaccccatctctactaaaagtacaaaaaaaaattagccgggcgtggtgatgcacacctgtagtcccagctacttgggaggctgaggcaggagactcgcttgaacctgggaggcagaggttgcagtgagccgagatcgtgccactgcactccagcctggcaaaagagcgagactgtctaaaaaaagaaaaataaaaagcaaactacagtataaagtgggttacagaaagtctcaatgatgtattcatatgtaaaaaattaaaggagctgcacacttaaatgtgcactatttattgtaagttatacctcaataaaaggttttctttaatcttcataaaaaaaaaaagaaaggctgctaagtaaaaagcaatacattaaatttctcatgttaacattaaagtactgcatacctaacatcaataggaaaaaataatctaaaaggattactctgttggtttgtgctttgaggacaatttcttttttttacaaagattgctcaatgtggttgtgttctagcatgaagttcagttgtttggccttgcgcagtggttcacacctgtaatcccagcactttgggaggccgaggcgggcggatcacagggtcaggagatcgagaccatcctggctaacgcagtgaaaccgtgtttctactaaaaatacaaaaaaattagccaggcttggtggtgggcgcctatagtcccagctactcgggaggctaaggcaggagaatggcgtgaacctggcaggcagagcttgcagtaagccgagattgtgccactgcactccagcctgggtgacaagagcgaggctccgtctcaaaaaaaaaaaaaagaaaaaaagaaattcaattgtactctctaaagaaactagcttttagaaagaggtctgtatagaagaaaagggctgatttaatgttgtcaaaaatttagagaactgctgctattagtatgtagccccagttaatagtttcttactcttaatagctgggtaagtgaatgtatggccatttacttttcacatcccttgtacacttgggacataactaaatagttcacctcagatgaatggagatcctatttctcctactgccttgcataaaatagactaattctcaaacttttttgtctcagaacttatttacagtcttaaaaaattaccgaagactgcaaagtacgtttattacatctatttatattttagagaaattttaaagcaccacttattaaaaacaataatttcagtgcatattaacatgaataaaatagacatccactatattttccaaaacagtagccaaaaagctaattgagtggcattgttttacagttgtgcaagtctctttaatattgagtgtagtaagatagttgaattcttatatctgcttctgcattcggcctattgctggatattgtcttggttgaagtatatgaagaaaatccagcctcatgtagctatgcaattggagaagggaagagagtattttaataactttttcagataattgtggatattcttctttgatactacaccaaaaattgacaagtggtagtttcttaagggttggttggaatgtggaatctaaagccctgtcagtggttgtacttcactaataactgaatggatctttcgattttgtaacatcatgcattggtcatttgaaaaatatcagttcactgggttatatagatctgaatgttggcacattttgttatatatactcatctctaaatatccgtgtaggatcgatattctagaaccctcacagataacaaaatctacggatgctcaagtccttcatataaaatgagttagtattcatataacccgtatgcatccttcagtatacttttttttttttttttgagatagggtctttgcctctgttgcccaggcaggagtgcagtggtgtcatcttggcttactgcaacctgcccctccctggctcgagcgattttcgtgcctcagcctcccaagtagctgggactacaggcatgcgccaccacgcccagctaactttttgtgtgtgtgtatttgtaatagagattgggtttcaccatgttggccagcctggtcttgaactcctggcctcaagtaatccacccacctcagcctcccaaagtgttggggttacaggcatgagccactgtacctggcccttcagtgtaaacaatctgtagtttgtttataatacctaatacaatgtgttacgtaaatagttgttataccgtattgtttttacaatttatattattttttattcttgtactgttaacttttcatttttgaaaaataatatttttcatctctggttggttgaatttgaggatgtggaattcagccaatgcagagtatcaaaatatttcattcattaatattgccagtgatctcacctgaaaagtatttaagtattagaaagctcaagcactgtgtcagatagttttccaaaattctaaatattgcagtggtaccaactgtattagcagtagtagtcattgtttagcagtcaagctcaaaatgattagttcttccttaaatgacaaactcattttgttcatgtttgataacctaataaacaaatctgccaaatgaccaaatatggataatcttagtttatctaccagtcctttgttcttcaaatggtgtttcatgaaaaaagctagtttcagcttgtaactcagtcgtacaagcgcttttcctcaaaatagccattgtacttcaaatctatagcagaaatgctttatatgcactacctatttctttatacagagtgtaaaaagattgtataaggattgagattaataaaaattatttttgctgtcttcatgaaggacattcttaagtgatactatcataaaaaacaacaaactgaatgtgtggtggtggagaaagcagtgactactactgctagtacagttggtaccactccctttgattcatgttcagttgctagaagttttgctgcctattgtttttgcaccatctttgtaaatttcaacataataaaaaagtcagatactgttttgatgctattatgaaaatagttttgaacccctgtagcccctgaaaaggagggttcatagaccatactttgaatttagtagacaaatatttgaataattgatgagttaatgatactgttattttttcctttttatattctttttttcagtttcttctcttgatttagaagtttggtgttctatttttgttcttttgttaattgaattaatcatttattatgcctgctttccttaaagtctaaagttagagtctacgctctttttatggaatgaacaaagaccttggaatactttaatcttgctcctcaaatctttcatgcttttttttttttttttttagcattttagttctactctgttttgttattagaaacttcaaacatggacaaaagtaagcgaattgggcaatgaattcctgtttatcaaccattcgtattcacttactgtgtttgcttcaactagaccttttctcttgctgaagatctttaaaatttgtttaatttactttatttatttatttatttattattattattatatattttttgaggtggagtctcattctgtcacccaggctggagtgcagtgacgtgatcttggctcacttgcaacctccacctcctgggttcaagtgattctcctgcctcagcctcctgagtagttgggattacaggcgcctgccaccacacccggctaattttttgtagttttagtagagacggggtttcactgtgttggctaggctggtctagaacccccgacctcaggtgttccgtccgccttggcctcccaaagtgctgggattacaggcatgagccaccatgcccagcccaatatattttattgaacttgatttatctaaaatattattttgacatacagtaattgtgatgaaacattagtgatatttggcatttctttattttataacatgtcttggaaaattggtattttacatctatagcacatctcaatttggactagccacttgtcaagtgtctaatagctacatgtaacttgtggctaccattattggatagtgcagctttataaattaggtagaaataggactgaagggctggaagatacagaaaagatgaatttctattcaatattaagaatttaccttctagcagttggagctatttgatgagggggatgcatctccttatacagtagtatggtccttgtcattgaaagtattcaaaaagaacccattcaagccaatgaggtggctcttgcctgtaatcccagctacctgggaggctgtagtgagcgctaatcgcggcactgtgttccagcctgggcaacagcatgacgaaaaaaaaagagaagggattattcatacgttgggtatgacctgctgggtttttttttttgttgttgatcttggttttttgtgtttttgaacaaatttctgtgtttaaaaaaaaaaatgctcttttacaaagttcaggctgggtgagtggctcatgcctgtaatcccagcactttgggaggctgaagtggggtagatcacttgagatcagggagtttgagaccagcctgggcaacatggcaaaaaccggtctctactaaaaaaaaaaaaaaaaaaaaaaaaaaagtgtatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatctctcattgagtggaaatctcagtgcgcactgaaagaaatcttttttttgtttgtttttgtttttgttttttttgagatggagtcttgctctgtcacccaggctggagtgcagtggcgtgatctcggctcactgcaacctctgcctcctgggttcaagctattctcctgcctcagcctctcgagtaggtgggactacaggcgcgtgccaccacacctggctaattttttattttttgtaaggacggggttttaccatgttggccaagctggtctcgaactcctcacctcaggtgatccgcccacctcatcctcccaaagtgctgggattgcaggtgtcagccaccatgcccagcctagaaatcttaaacttaacaaaattgtttgatttttaggtgtatcatttaagttcttcgttttagaattgcttcaaattatgaggaagaaattattttaggcattttctttcccttttctagtcagtttattctttttgtagtgctaagtatttggagaaggtaggtatggtgtgaggcccatcaatcagtcaattctagcactttccagactgatgtaacttctatttagtagagtagaatacgctttctggccagttgctgtaggattgtaggtgatgactaagcttagccaagccattaatttataataattactaacaggaaatatcaggtacatttaaaaatgagtaaatttcaagccttgttataccttttaaccttaactagaatcttacctctatatttaaattagatactaaaatatttaaatcatgtaagacataatctttggctgtctgatcacatggctattaaatgagcatgagataattggcttttatgaatgtttctgcatgcccttatattttatttaggtcacgagcaaagtatttttttcccctttcaaattcaaattattttacttttagtattacatgtgaaaaagaaatgataaccgaagtgtctaatactattaactggtattatacttcgccataatagtgatactgtaaatatgaaacctttattttcacttttcaggcacaaaaatctcaagtcaagaaatgctggacaacaaggacaggcaccatctttaggtcagcaacaacaaatacttcctaagcacaagaccaatgagaagcaagaaaagagtgaaaagccacagaaacgccccttgactccttttcaccatcgtgtgtctgttagtgatgatgttggcatggacgcagattcagccagccaaagacttgtgatctctgctccagacagtcaagtgagattttcaaatatccgaactaatgatgtagcaaagactcctcagatgcatggcaccgaaatggcaaattcacctcaaccacccccacttagtcctcacccttgtgatgtggttgatgaaggagtgactaaaacaccttcaactcctcagagtcaacatttttatcaaatgccaacaccagatcccttggttccttctaaaccaatggaagataggatagacagtttgtcccagtctttcccacctcaatatcaggaagctgtagaacctacagtatatgttggtacagcagtaaacttggaagaagatgaagccaatatagcctggaagtattacaagttcccaaagaaaaaagatgtagagtttttaccacctcaacttccaagtgataaattcaaggatgatccagttggaccttttggacaggaaagtgtaacatcagttacagagtatgtattttttttaatagtcaccattataatttaagggtggaagtgatgcaagttcttaatactaggactcagtattggattcaaggtaggatttacaagaataaattcattgagtattaactttgcattattcctttactgtgttttttcctcagggaacttcttcattatgaaataactttagccacaaaaagtggagaaaataatgtgtaaacacttgtacatcagccaacttaaggattttacatacagttagaattcccatgtactgtttttcttcttccagtcttccttccactgtcctgaatttggtaccttttttttttttttgagacagagtctctgtcacccaggctagagtgtagaggcacgatctaggcccactgaaatttccgcctctgggttcaagcgaccctcctgcctcagcctcccgagtagctgggattacaggtgtgagccaccacacccagctaatttttgtatttttagtagagatggggtttcaccatgctggctaggctggtctcgaactcctgacctcaagtgatccacccacctcggcctcctgaagtgttgggattacaggcatgagccaccgcacctggcctcaatttggtacttattatttcagtacatgtttttatacgtgtagctctagttattcattttaattgctttatggtatttccttatgaatatatagtaaatacctaaactcttaaagatggatatgttggttattttcagtttttcaccctaacattttccattttgtttggtacacatttccttgtttacttgtataagaatttttttaggaaatacatctaaaagccattttcaacatggctatgtccattttcaacattaagggttgttgcccagttgcagttcagcaactggtatatagtttaaaccctcatgaaccagcagtgtatgagaatggctgttgcactatattttcctctatagttggtcttacaagatttaatttcagtaatttacagcatgcaaaatgtcatctcattgtctaaatatgtgtcttccagatttctagtgagattgagcatcatttaaaatgttttgggtgtatttaggtttcctgttctgtgacttgcctagtcatcgtattttttagtccatttttcttttttttctgatgtattatttgcatgctctgggtattaatcctgcattagttttatgtgctataggtttcttcctccattggtggtttgccttctttgtccactgtattaatgttatactttgggcagaagaaggcttttttccaggtatcccttgactttctatgttgttattaatacatttatagtctgtctaataagccttttacatataaatttttctaaaaggtgaaaatcaaccagtaaaatacgattatgctcaatagaactgtctacctatttattagtacaaggccaaggaatgtacaaagattacgattccttccttatcagatcattgtcagtgaattaccttttttttagtgaattacttgcttattgcttaaatgctactaataggttaaataatgtcttagactttatttgcttaaaatgtcacattttcattatcgatttatgtttattttttaatgtagctttttttctcaacatcagattgctccagataatgtaactattatatggagtttaatactttcttatttctgttataatgtgaaccagttgctttctagacttgttttcagctctctaggatttcattttgattagactcaagttaataccacaattttttataactagtggcttctttttggttttgcctttattttcttggtgaatatctttagctccctcggggggagggggcggcggggggaagagtgggagataaatttggcatcctttgtatttctgaaaatgacctgatttttttgccctcatgcttggattgataatttggctacatgttggtttcataattgaaaataatttcccccttgaactcataggcattgctttactgtcttctggtatcttcagaagaaatgtgtaataatgagtttcattcttgctcatttaaaaaaacgcgatctcttctgtgaggcttttaaggtcttctcttagctttagaaatgtcacaagaatctgtgtagcaggtataatgatcttttttccagtccttgtgctgggcacttgaaaggctaactcaattttttttttttttttttttttttttgagacagagcctcgctctgtggcccaggctggagtacagttgcgcgatccctgctcactgcaagctccgcctcctggttcacaccattctcctgcctcagcctcctgagtagctgggactacaggcgcccaccaccactcctggctaattttttatattttttagtagagacgggggtttcaccgtgttagccaggatggtctcgatctcctgacctcatgatccgcccgccccggcctcccaaagtgctgggattacaggcgtgagccactgcgcacagcttttttttttttttttttttgagacagtctcgctctttcctccaggctggagtgcagtggcgtgatctcggctcactggaagctctgccttccgggttcaggccattttcctgtctcagcctcccgagtagctgggactataggtgcgcaccagcacactctgctaattttttatgttttttattttttgagacgtagtctcgttctctcgcccaggctggagtgaagtggcgcgatcttggctcactgcaagttccgcctcccgggttcacgccattttcctgcctcagcctcccaagtagctggggctacaggcgcctgccaccatgcccggctaattttttgtatttttagtagagacggggtttcaccgtgttagccaggatggtctggatctcccgacctcgtgatccgcccgcctcggcctcctaaagtgctgggattacaggcgtgaaccaccacgcccggccaaggtctaactcagtttgaaggcctttgttctgccatttggaaattctctatttcttaggtaataccatctcctaaaaaattctttttaaaacttccatgattcagatggtgctctgttttctcaggggattctcaactttcttgaattctgaatttttctttctcatgttttaaaaacattctcaactgattttttttaaaaataacattccgttgtttgatgttctgtgattttatttttctctagaattactttattttggtcttgttctttactcggattcttcttgtcgtatttctggttgttttttgtttttttgtttttgagatggagtcttgctctcttgtccaggctggagtgcagtggcgctatctcggctcactgcaacctccgcctcccaggtccaagcagcccttctgcctcagcctccagaggaactgggactataggcacgtgccaccacgcctgtctgattttttgtatttttagcagagacggggtttcaccttgttagccaggatggtcttgatctcctgacctcgtgatctgcctgccttgacctcccaaagtgctgggattacaggcatgagccaccacgcccgacttgattgttactattattttaattttatttttttgagatggagtctcattctgtctcctaagctggagtgcaatggtgtgatctgagctcactgcaacctccacctcccgggttcaagcgtttctcctgcctcagcctcccaagtagctgggactataagtgcgtgccaccatgcccggctaatttttgtatttttaatagagacggggtttcaccatgttggtcaggctggtctcgaactccttacctcaagtgatccactggcctcggcctcccaaagtgctgggattacagacaggcatgagccaccacacctggcctgtctagacgtattttaatgtgagagaatagatagactgattggaaatgttgtatataggtagagcttgttgactggtggtccttgctcattcaataaatactttagtatgtaatgtgtataggtgtcagataattcgctttatgataactggatggggaatttttggaagggaaggcaaccattcctaaaattccagaatgaaaaggatgttatacttattttgacaggtagtttattcattttccttaaaaaggaatctttcttgttgtcccattttcagctctttttctcacttttgtttttcttctccttcctgtctccccttctcctttttctttttccctccccccccccttttttttttttttactgctccttgcagagcagggctacacccataggcagtgtgaccaaagtaaccccttcttctcatttctgtccggattttttctcacttttccaggcagttagactctcctgttgtttatgtagttgggctataatcccttcttttgcatattgtaggctgtgaactttttctgctgtattttatcttattttgagcttccctgagacttagtgaaacatctggtccatttatagcctctctctcatttttcctactgttagagatttattctctgttaaaatacctagccgagtgctctggttgtgtcaggaggattgcttgatcccaggagttccgggctgctgtgcactatgccgattaagtgtctgcatcaagttcagcatcagtatggtgacctccaggttgcctgacgactggtgaaccagcctaggatggaaatgggcaggtcaaaactcctatgctgatagtggtgggattgcacctgtgaatagccactgtactccagcctgggcagcagtgagaccctgtctcttaaaaaataatagtaaattaaaatgcttttatcgtcattttagcagataagtcctgtgcttcatctggccctttgaatctaaaagtattttagtatgattttattttgttttattttattttatttattttgagacagagtcttactgtgtcattcaggctggagcgcattggcgcagtctcggctcactgcaacttccacctcccaggttcacgcgattcttgtgcctcaacctccagaatagctgggattacaggcgtgcaccaccacgatcagataatttttgtatttttnnnnnnnnnnnnnnnnnnnntgatctcaagtgatcagtctgtgtcagcctccccagtgctgggattacagacacgagccactctgcccatctatgattttatttttaattaaaattaatctggattgttaattaagagatatcagtatactcttagggattgtggaagacagtgagcttatttaatagtcagcaggtctcttgaaagtaaatgatatcttagggctgggcgtggtgggtcacgcctgtaatcccagcactttgggaggccacgcgggtggatcacctgaagtcaggagttccagaccagcctggccaacatggtgaaaccctgtctctactaaaaatacaaaaattagctgggtgtggtggcgtgcgcctgtaatcccagatacttggaggctaaggagaatcgtttgaacaaggaggcggaagttaacagtgagcagagatcactccactgcactccagcctgggcgacagagcgagactccgtctcaaaaaaaaaaaaaaaaaaaagtaaatgatgtcttagaaacaagccttaaaagatcttaatcttactcttgctaaatgtagtataagtctaagccagcctcagctcttggcctgagattactagtctccttgtttctattctacatgtattctctacacagcagtgagggtaatcattgcaagtaaaatattgtcttacttatttgcttaaatctctcccatagtttccctttacacttagagtaaaatccagaccctttctcctgatctgtaagattgtatgcagtctcttgcctccctagttcttcacccatgttacctactggtatcctacttgtctcctgatttagctacaccagcatccttgataaattattcaaaaagccaagctcattcctcatggccttttagaattggattataaagagggtgaactgcttatcccttcttatcattcagtgctgctcaaaagttatcttctcagggaagattttcctcaccattttatctaaactatggtctttctctcccaaatcactgcctatcctgtatgctgcttttaatttcttcttagcatatatctgaaattatattatgtatttgctaatggtcttttccctattagaatgtaagctctatgagggcaaggactcttgtcttgtttactgctgtattcttctagcataaacacacacacccccttagaacaattctggatacacaatagaaattcagcaaatgtttgggtgaatgaaatggccctaaaatactattttaaaacttgttttctttccaggttatattttcttatttaatgtgtgtaaaaatgtggtggtatgaagttttttggttttaaaaccttcaatagtgagtttttgtgggcacattgtattcataagagctgttaattctagccataactttaaataaatgtattggttgcttgtgtacatgactatctgtaagtaaaatgaaggtctcttagaagttaatacagtttaaccttaaaatctgttctaaaattatttgacatttttctcactgaataagaatgagaaggaggaagcatagtgtagaaaagtagcgtgcagggtagagtggtactggattgtaattatgtaagttaaggaaataacatgctttgcctattccttgtcaccctttttttctgccttatagacaagggaaaaaaaagattgaataaaagagttttaattttaatcatatgtcttatgtgaatattgttttggttatactagttactgaaatgtgtatcatgtcacagttcactttttgctttttttttttttttttttttgagttttgctgttgttgctcaggctggagtgcaatggcacaatcttggctcactgcaacctctgcctcctggcttcaagcaattctcctgcctcaccctcccaagtagctgggattacaggcatgcaccatcacgcctgactaattttttgtatttagtagagacgaggtgtcaccatgttggtcaggctggtctcgaactcctgacctcaggtgatccacctgcctcagcctcacaaagtgctgggattacaggtgtgaggcactgcacctggccacaatttgcttttagatataagccttgtttttgtagtatgataatagattagatgataaggtaaatatccagaaggtgaaccatcaaaggcttagctgctatgttaactaagaagcatttatggaatataaattgttctatagttggtaggttaaaagtttgcttttaaaaataatcatctggatgattctatccttttcctggaattattgttctgtgtagtatttctcaactggggcaattttatatccctccagccccatccccaggtaacatttgccaatgtgtagagacatttttggttatcaccttggggtgtgctactggcacctagtaggtagaaattagagatgctgctaaatatcttacagtgcacaggataatctcccataacaaaaaattatccagctcgaagtgttagaagtgttaaggtactttaatataatgaataacttgtaacagaaaattgaattctaaagtaatagttattagaaagatcagcgtgtttactgattgacttcattggggagattccccatactatttcagtcactccaaactagagtgagatacttgacatggtcttttatatgctgaaacaaaaatgcttttttttcttatagtgaaaaggattttgttggaataattggataatttattacctgctgttaatattgcttcagatatgatgtgacaaggatcaaaataatagttgtctccttgtagaaagtggtacagccaattgacaaagttagatgatgttccctgtcattaaaataaattccatgaattactgttattctcttttgatggctttttttttttttttttttttgagatggagttttgcttttgttgcccgggctggagtgcagtggcgcaatctcggctcactgcaacctccgcctcccaggttcaagtgattctcctgccttggcctcccgagtagctgggattacaggcgtgtgccaccacacctggcaaatttttgtattttcagtagagacgggtttcgccatgttggccaggctggtcttgaactccctacctcaggtgatccgcccacctcagcctcccaaagtgctgggattacaggagtgagccaccgtgcccagccctcttttgatggcatttaaacaaccctcttaaattctttctggaagcacttacaattttaaagatgtaatatgatcaaacacctctttagtcatagagtaattcattcagaagcctggtttgtttatattagtaaattggtgaatttctgtcacctagtcattgtaaatatctattattatttttccattctttgagttttgaaagtgcatttaaatgtttagcagttaattttaataaagttaattacagggctgttgcaagtcctctgcattttgtatctcttcttaggagtattatttttctttttaaattcatattcttaaaaggtatttttaaaatcagtttcaataaaactgaagtttctcttacgcaggatgctgtggggcactgttagtgtataaaataaatttactcttgaccataaatgaaattgtagtctaatggaaaatagcatattatctgatagaggtataaataaaatatagtacagacacagagtggggaataatttaattccatttatgaagctccagaagctttatgtagtttggtatggttagattataggggtgctccttagtagtttggtgtgtcatgatgagaaatgagacctgaaaagcgtaggactatagaatggaatagcagaatagtattcataagtttgtatattatccttgagatgatggagggactattgcaagtattgagtgagataaaatgacaagttttagaaaataaggattttggaaaaactcaccaagtaatgttattgaaaggttgcttgaaatgaaaagatatgtctgtgtgaaaggagatcagtttggacaactcatatagaaagtgatgtgaggccgacactgggaaattagaagtagcagggatgtatgaatgttatagatgctgtggaatatattttgaagaactttgcagccagttaaacagtaaagtaggagaataacaggagagtttaaggccaagcgtatttagttcatgaggtagaaagatgagaaagaataggtttgaaggtgtctgtaccattgtttttacccactttaggctaaatcttaccaaacttaatttttctgatttttttaaagtagcgtttctaagtagaagtaccttggaataactattgaaatacctaggctgggcgcagtgactcacgcctgtaatcccagcactttgggaggccgaggtgggtggatcacgaggtcaggagtttgagaccagcttggccaacatggtgaaaccctgtctctactaaaaatacaaaaaattagctgggcgtggtggcaggcgcctgtaatcccagctattcaggaggctgaggtaggagaatcgcttaaacctgggagccagaggttgcagtgagccaagaccacgccactgcactccatcctgagcaacagagcaagactccatctccaaaaaataaaacaacaaaaaacaaaactattgatacaccttatgaaagtaaggtcttgctaaataatgaaggtctggctaaataataatggcatatccacttaaataagcaaaggaaatctgtataggctgatatgagaagctctgtatgtagatgaggaaccaaagtacatatgtgcatacatatatgctggcatatacctaggtttttttccaccttaattagatgatagaaatagtacttgttatcttgaaggagagagattgatacttaggcttttcatctttttgtactacatgactttagctatgtacatgtaatgtgagtacatcgtaaacatgtgaatgcagtttgaggtgcctgctgagagattccatcaggcggttgggatcatgtctgaaacttaatagaggggattgctgataacccagttagagtagatatacaatgcaaaaggacaagaatgcatcagtagaaacagagaactagtggatttataatagtggaacttttacaggtatgtgacttcatagaaaattacggtaggagaaattcaaagctttgttttatttgtgttaagtgaaactccattttctgtttggtgtaaataaatgtttccattgattgctattgaaaggtggcactgtccttccatagtagtgggttagtgaaagaaattaatactcttgatttttattttttctttttatgagagaggatcttgctctgttacccaggctatggtgcagtggcatgatcatggctcactgcagccttgaactcctgggctcaagccatccatcctccttagcctcccaagaagctgagactacagacatgtgacaataccgcttggctaattaaaaacatttttttttagccaggattttagacaggatctcgctatgttgtccaggctggtcttgaactcctggtctccggtgatgctactaccttggcctcccaaagcgctgggattacagatgtgagccactgcacccagccctcttgatttttctgattagcagtttcaggtggtgatggctacctaactagtatagcattatagaatttatcatttctgagtaccttttttattcttagactttcatgtgtagcaattttatgtttaacttttcattgactatgtttgtaaaagtaaaatttctctaatttgttagaatttacttgtggggaaggagaggttggagtggaacatagcataacccatatataagatacacgtggcaaatatctttttttctaattctttttagtttatctattagttaatgatagcatgtatttcagaatagaggctaagaaccatatagattttaaagatagcaaaatttctggcaagaaacattatatctttttttcatgggtttagcacttagttttagaagaatttgtgattgtttagtctgtgattctgattcagagggaaacctgtctaaaccctgagcaaagaaagaactgtatttgagcatagttctttacatgttttattctgtagccaaagtatatcaggatatcttagccatgatattcatcaatagaattaactcctatgttgtgttagtggtataccagatttgtatgtatatagttgtagaatacattatttgatctctaaaacatagttctgaatgcctttgattcacagaaagaagtctgtgatgaaataaacttgttttgatttttctgtactctaaatcttttaagtaagtcttctatatttgctgttttattttaatgcaaataaagctttcctttgacagtgaccttggctcagtttagggattgattctgaatataggagacggtaaaaaaaaaaaaaaaaaaaaaagtaccatttaaaaagtgggagattttaggctgggctcagtagctcacacctgtaatcccagcactttgggaggcaaacatgggaggatcacttgagcccaggagttcaagaccagcctgggcaatatagtgagatcctgtctctacaaaaaataaaaaactagccaagtgtggtggtacacacctgtagtcccagctactcaggaggccgaagagggaggatactttgaactctggaggtggaggttgtagtgagctgagaccgcaccactgcattccagcctgggtgacagcaagaccttgtctcaaaaaaaaaaaaaaaaaaaaaaaggcggtgggaagattttgacattattgcattcatttgtttcttaactttccgtctgtagcttatctgcttctataattgtcatcttaaaaactgtcatacctcatctggaagaatttttattgaataaaggcataacagcatatgctaccataagctatgttaaattctatatgagtacatttcaggatagtatgttattgtcatagtaaaaggaaagagttgcaattaatgaataatataatgctttgggccttgcagcacttcctgttcatggctgtacctgatctttttgcagtttgtctgtatttagctttatgtctaattgaaactgtgtctgtagttaattatttggctgtatgtgaaagttcgtttgaggaaaggagagggttattcgtattctaaaagtgtatgtgtactatataattgatgttgacagtatggtaattagagtttttttatctggcatctcttaaaagtaacaatttttaattctattatcagctttaaatatagaatgtataatgtaaatgaatttatattttaaaatttattgtgtcttgatactcttgaaattgactacatttaaattctttgcacatgctaatgtctgtgagaatgattcaataaaataacaaacagtcatatttaggtaatgcatttggtttactcattttttattttaatagagccctgtgcagtagagttggtttttttaataatgttactgcacagtagtctagcaactacttatgtaaacagtgtgaaggtttttatacttctgccagaggacaacgtaatatgaaacaccgagttttatttgtctctacagagagtagtagtgtctttcaggctgggggaagggagatttcttatactttattccctaaggatagttatttgaatataaatacttaaaatcttttcatttctgactttgccactatgtgacctcagcaaagcccttgattttacataatttccacatcaaagtcagggataataccctttgcttcttatcttaaaatattattttaagtattaaataagaaaagtacatatcaaagtagttagaattactattttaaaaagatttgcattagtgaatatttggtagacaattcagctaaccgttatttagagtctaatgtggtgaggtaaaaaactacacttgatactcagctgtttatagaacagaactatcctgatgattaattataaaacatatccccaatgacagtgtgctagcattatattcccacagcagaaagtttttgtatgcttgggattttagtttttgcaataaatctggggcgtatttggaataataatgatatgtatttgagcatttgatagcatgtttagaaatcagtttttgttttgatggcctactttgccccgagtttgtaagagatcaagtgctactagtgttaggcattagtgaatagatgaatgagataagatttgcctgtgagtcaaagaatgtacgatctgcaaataccttcattgctaccagaccttacatatcttacaatttttgtcttagtactcagagtagataagcagtggcattggtaccttctagtgtgtaaaaattgtttatttcaaagtacaagatagtgtattttagtagtactaatgcaaaaacatctcagtctgtgatttttagatttcatttattcactagcaagtattgacacctattatgtaccaggtactctaggcatctgtgctaaattagtgaacaaaggttagacccctgtccttgtggagcttttatgttctagtgtgagtgacagtcaactatgaatataataaattatgtaatatgttaaaagataaatgctatgcaggaaaatagagcagggtaagggggattattattgaggcaagtgggcatgggcatattgctatttaaaataaagtagttatgggctcataggtgacatttaagcaaagacttgaaggaagtgagcgagttggccatgcagatatttggaaggagaatgttccccataaaagaaatagccaggaatgggtctggaacccattgaggaacataaaggaagcccttggaagcagtataagagaggactagaatagtaaaagatgaagaggagaagaacaagatgatgggaagttttcataggatggtataaggactttggtttttttctcagagtgaaatagtcattgcaagattctggccatgatctgactgcaagcttggctgctagctactgttaggacaacctgagaaccttagctttgtaaacccgagagaataggaatttgagagtctaaacatgtcttatgcaaaccagaagctaatgattctgtgttcacactcaccgagcagtcgggtcttcagagagaaaaaactcctgatgctttccagggttctttggtatagatcagcttgcttcttgttgtggcatccctcttttatccttagatttcagctttctgtggtctgtcagtttccactagctcatctttccaacttccttgttgtcttctcttttattctgtcatctcctgtcattttattggttattttaggagaataaagagaaacaatttcttagttgctgtgttgaaccagaagactaataacttaaaaattgatgtgccaatgtgattagaaaactcagatacttgcactgaaacttcactttccattgtgaaacatcttgccagaattaatagtaataatgctattttcatgaaacacaaatcaggccttcaaaaatttaaaacttaaagtatatctactcatggcagtaaaaaaaaaatacataatcactttccttgtataaatgtataaattgtttaaaagtattttactcacttttataaagctcccactttgagtcactgtactggagcagtttagatttaagagcccctttcagggaatggatttgtacaaaatagtgtgcttgaggacttgagaaccgtgagttacctaaaccgtgaattacctaaagacaacatattttggtagaaagatcatatagttaggaaacttggattttggccccatttctctatggctaaattttagacttcaataaattatttaatattttcatgcctcctcatttctgaaataagggattgtaggttagataatctttaagtaattctaaaaacattatgatacttaacgtcattttggaaatttttaatgcttatgtggataattaattttttttaatttttttatgcaggttaatggtgcaatgtaagaaacctttaaaagtttctgatgaattagtgcagcaatatcaaattaaaaaccagtgtctttcagcaatagcatctgatgcagaacaagaacctaaaattgatccatatgcatttgttgaaggagatgaggaattcctttttcctgataaaaaagatagacaaaatagtgagagagaagctggaaaaaaacacaaggtaagagaaatcacagtacaccaaagggtcactgttgattttgtagcactgcatatagtaacactcttactaccacagttatctcacttcttttgtcttagaatagaaagagtaatcatttatttagaaaaacttatttttgcccggctgcggtggctcatgcctgtaataccagcacttggggaggccgaggcaggcagatcacctgaggacaggagtttgagaccagcttggccaacatggtgaaaccctgtctctaataaaaatacaaaaagtagctgggtgtggtggtgtgcgccttgtaatcccagctattcgggaggctgaggcaggagaatcccttgaacccaggaggcagaggttgcagtgagccaagatcaggctactgcactccagcttgggtgacagagcgagactccgtctcaaaaagaaaaaaagaaaaatgtatttttttgaatgggtaaatcaagcacatggtaccaattatagctgacctctgataatgaaaatattttgttgtttaaaagtttctgggttggataaagggcatattaaacttgtcataattgaaatcaggacatttaggtaggctattttgacagtgattttaaaatatgttgtaagtgaattaccagttttcaaagatacaataaaatatacatcactgagtttaaaaaatatgtgctatttttgaatatgtgattcaggaacttacagtgcacctagaagtaaaaatgaagtgcaagatatatagttattagaataaaatttaaaaatcaaatatatgagaatttgttaagattaagataactttgctacacaggaattatgtcttatatacaaaatatgaaaataggctagacacagtggcccacgcttgtaatcccagcactttgggaggctgaggtgggtggatcactaggtctggagttcgagagcagcctggccaagatggtgaaaccccatctctactaaaatcacaaaaattagctgggtgcgatggcgggcgcctgtagtcccagctactcaggaggctgacacaggagaatcgcttgaacccaggaggcagaagttgcagtgagctgagatcatgccagtgaacttctgcctggtgacagagcaatactccgtttaaaaaaaaaaaaaattgaaatctgtaaagttatgaaaaggatccaataatacgtgtgagttttttttttgtttgtttgtttgttttgagacggagtttcgctcttgttgcccaggctggagtgcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtgtggtggtgcatgcctgtaatctcagctgcttgggaggctgaggcgggagaatctcttgaacccaggagggggaggttgcagtgagccaagatcatgccactgcactttagcgtgggtgacagagtgagactctgtctcaaaaaaaaaaaaaaaaaaagaaagaaagaaagaaagaacatggactttggaatttgacagatttaggataaaatttcagctctcactgtttatcagccatattttctggggcacattagagtctctacttttgtctataagataaacataccacaggccaggcgtggtggctcatacttataatcccagcactttgggaggctgaggtgggcggatcacaaggtcaagagattgagaccatcctggccaatgtggtgaaaccacatctctactaaaaatacaaaaattagctgggcgtggtggcatgtgtctgtagtcctagctacttgggaagctgaggcaggagaatcacttgaacctaggaggcagaggttgcagtgagccgagatcgtgccactgtactacagcctggtgatagagcgagagtccatctcaaaaaaaaagtaataataagcatactacttacttgttaactgtaagaatcagtgataatgtatgttaaacacttagctggatgcctgacacacagctcctcaataattggtagattttattgttggtaaattatatatttcagcctaacatgaaatatttgtttgcaggtagaagatgggacatctagtgtaacagtgttatcacatgaagaagatgctatgtcattatttagtccctctatcaagcaaggtaaaatctttatttcctaatgaaaatattgcattccaggattgttactacagactgatctgatattgttggacttctaatgttcctttttgtataattcattatgtttcatagaaaggaatctttcttaaatgatgggtttattggttatcttttattggaagaagcaagttcaggtgatagaatttgtgtttttaattgttgcagcctctttcctgtttttacatataaaaatagttttctattaaaaactcagttttatgtaatagatttctcacccccttctactgggaattacgtgaaaggaagtaaaagaatgaaggcacatattgactggaaagtgattgagaaaaggccattgttatactatgccaaggctatggttatactctccaggaaaaacacacttgaaaaaaatgggagaaagatactgatgtccagttggttgacagtagagtgtttcatcatcataactccaagtgtttgctctctgaagacactactttcaagcctatagcaatgggggttacaattcgaagactatcagttctcttcatacctgtctccattgtttaaattataattgaaaaatggatctgggcaccgtggctcacgcccgtaatcccagcactttgggaggccaaggtgggtggatcacttgaggtcaggagttcaagaccagcctgtccaacatggtgaaacaccatccctactaaaaaaatacaaaaattaggccgggcacagtggctcacacctgtaatctcagcactttgggaggccgtggcgggcggatcacgaggtcaagagattgagaccatcctggccaacatggtgaaaccccgtctctactaaaaaaatagaaaaattagctgggcatggaggcacgcgcctatggttccagctactcgggaggctgaggcaggagaatgcttgaacctgggaggcagaggttgcagtgtgccgagatcatgtcactgtactccagcctggcgacagagcgagactctgtctcaaacaaacaaacaaacaaaaattagctgggcgtggtggtgcatgcatgtagtcccagcaacttgggaggctgaggcagcagaatcgcatgaacccaggaggcagaggttgtggtgagccaagttgggctgggcacaatggcttacacctgtaaggccgaggcaggtggatcacctgaggtcaggaggtgaagaccagcctggccaacaaggtgaaaccctgtctctactaaaaatacaaaaataaagcatgtgtggtgccaggtgcctgtaatcccagctacttgggaggctgaggcaggagaatcgcttgaacccaagaggcagagattgcagtgagccgagattgtgccactgcactgcagcctgggtgacagagcgagactctgtctcaaaaaataaataaataaataaaaattgaaaaatgatttagaataagctcaactatgattgtgttgtgacatagaataaataggagtaaaatgttttaaagttttcacctgtaaaatgaggagataaggtcattgcctaaggtccttcagatctaaaaccacaatttctaaattaaactttactggaattttgctgtcattttcttcccacacacacaagttaagagagctgttctgaggccactaattcaacaaatacttagttagcacctgttatgtgtaggtactgtttgggtattggggacacagtggtcaagactccactttgaatatgtctgacttaaactccttgtgaatggaatagagagacatagtatagtaattcatttacaaaacccatttaacttgtaaaataatttttttaattgacaagtaaaaattatatatatttatggtatacaacatgatgttttgggggggagtgtgtatatatatatatatatatatatacacagtgcgccaagtgtgtgtgtgtatatatatatatagtgagaccctatacatatatacacacatactaaaaaatatatatatatttacatttttttaacattttactcatattctgtgtcacaacacagttacagtttatcttattctaaatcatttttcagttataatttaaacaatggagactggtatgaggagaattgttagtctcctattgtaaccccacaactataagcttgaaagtactgtcaagtcttcagtgagcaaacacttggaattattttacatatatatgtgtgagtgtgtatatatatgtgtgtgtgtatatgtgtgtgtatgtatatatagtggaatgggtagatcaagctgtttaacatatgcattaccttacataccttttttgtgcgtgtgggtgagaatacttaaaatctactttcagcaatttgcaagtatacaatatgttattattcactatgatgtacagcaaaatccatttaacttttgatgtgggcaaagtaagtcatcttctggtgtgtgttttcgatgacaaagttttaatatttggaataaatagagggtcagtctgtggataaccaaaaataagaaaaaaatctatctgaacaatgaacaaatggtctaggtagcttgaaaattcaacagtttggattctttgccggagtgatctacagattcagagcaatccctatcaaaattccaatgacacttttcacagtaatagaaaaaacaatcctaaaatgtgtatagggtcacaaaaggccctgaatggctaaagcagtcttgagcaaaaagaacaaagttggtggcatcacactacctgatttgaaagtctgctgcaaggccaagtgtcatggcccatgcctataatctcagtattttgggaggccacagtaggagaattgcttgaggccaggagttcaagaccaccttggccaacgtagtgagaccctatctgtgtaaaaacaataaataggccaggtgcagtggctcatgcctgtaatccgagcactttgggaggccaaggtgggcagatcacctgaggtcaggagtttgagaccagcctggtcaacatggcaaaactccgtttctactaaaaatacaaaattagccaggtgtggtggcgtgcacctgtaatcccatctatttgggaggctgaggcagaattgcttgaatctaggagtcggaggttgcagtgagccaggatcgctccattgcactccagcctgggtgacaagagtgaaactccatctccaatcaatcaatcaatcaaatgttaaatattttaaaaattaaaatatatggctgggcgtggtggctcacgcctgtaatcccaacactttgggaggccaaggcaggtggatcatgaggtcaggagattgagaccatcctggctaacacagtgaaaccccgtctctactaataatacaaaaaatcagccgggtgtggtggcacacacctgtagtcccagctacttgggagctgaggcaggagaatcgcttgaatccgggagacagaggttgcagtgagccgagatcacgccactgcactccagcctgggcgacagagcgagactctgtctcaaaaaaaaaaaaaaagctggattcatggaagtagaaagtaaagtggtgattaccagagactgggggtaggggaatggggatggccaggggacacaaaatttcagttgggaggaataagttcaagagatctattgtaaattgtggttactacaattaataatagattgtatatttgaaaattcagagtagattttaagtgttcccaacataaaaaaaagtacctgtatatgaggtaatgaatatgttcagtagcttgatttagtcatttcacaatacatacattaaaaaaaaaaacgaaaaaactcggaaacaaattgggttgtttgggctacttacctatgctaggatgttccctgggatataggaaacatgtaagccccttcttgtgcctgtagttcagctttctcaaaatgtgagacatatgctacattctggagtatctccaaggtggagcttcaaaatcttggtttttagtaagtatcttagatgatttttacttttaaaatttcaaaggcacaactctagtgaatctttagaactgacacaccagagacactggggaagtgacttttatctttctgaaaacgaggactctcaagtcagttaacagagaatgatttggaaggttatgtatcaaattgtttttcttgtgcaggaatatattgggagtttaattttcattgtaattggtatcatgtttttgttaccctaaaacagggcgagagggtaggaaaataaaattgtagtacggtaactaagcggtaatatttatctagtacttaagcacctagtactgggcgaagcacattaccaacattctattacattttattcttggtattgaggcacagagacattaagtaatttgtcgagggtcatactgttagtggtggagctgggattcagattaaagtctgtctggcccaagagtcagctcttgatcattgttctgttcttcgtttacatttcagaaagatagaaaaatacaggccaggtgaggtggctcacacctgtaatcccagcacttcagaaacagaggtgggcagattgcttgagcccagaagctcaagaccagtctgggcaatatggcaaaaccccaactcgaggaaaaaaaaaaaaattaactgggcatagggtcacgtgcctgtagtcccagctactggggtgggaggattgcttgaacccgagaggtcaaggctacagtgaggtgtgattgcaccactgcatttcagcctggtggtgacagagcgagaccccgtctcaaaaaaaagaaaaaaaaattacaagtatgtgtatgtgtatttaattgtttttctaatagtatttatatttttatttgatgcattaattattcatgtagagtacttagctattttatggattacctgaccttatagtgagcttcctgggaaagatataatcatttatttataacttttttttctataaaaacactttctcgattttaaacaataaagtacaatttcttgttgcataatccccttatgaccttaaagttatatgtctaatttaaaaagaatagtacttatgtggtcattagtagcaggtttttttttgttttttgtttttgtttttaagatggagtctcgctctgtctcccaggctggagtgcaatggtgctatctcggctcactgcaacctctgcctcctgggttcaagcagttctccgtctcatcctcccaagtagctgggattacatgcgcctgccaccacactcagctgatttttgtagttttagtagagacggggtttcaccatcttggccaggctggtcctgaactcctgacctcgtgatccaccctcctcggcctcccaaagtgctgggattacaggcatagtagtagcagttttaattttatttttctgattgacttttgtagatgctccacgccctactagtcatgcccgtcctccatcaacaagtttgatttatgactcagacctggctgtctcttatactgaccttgataatctcttcaattctgatgaagatgaactaacagtgagtatctcattaatgaataggattataatttgttttccttgattttattatttttttattttttagaagtgatttgtgagtttaatactatgttttagccctgaacaataggaaatatagtaaaacctcattcattgatttcttttttaaatctcatgtttgagtagtcttgccatagtgtcatctataaactttgagggttttgtttctccttttgtttttacatttgggggacacatgattaaccttaatttgagctctgccgtatgttctgttttgtagttttaggaagcagaattattttcctatttgattctgtagtttgagaaatgactctggaatttactcattcagagaacacatacataattgacattaaagttatttgctttgtcaatttattaaggaataccagctcttttgaatttgttttgcatcacagctattataagacagatacatgatataacaataaaagaggaaaaaaataatatttaatctttaacacccatttgcagagaaaggtgaagataaaagaaattaaagcttaaaatgagattccctagaatgtcaagtctctgtcaaattaatgaattgggtgctgcattatcataaaagggaattccttttcatctgcataaaggtagcttggaaacttctatggtacatttgatctttcctttcctatataatatgcatttagtcctctctcaacatatatatctctatatgtgtgtatatgtgtgtgtgtacatatacatatatatatattgcagatacataaacttttactgtgtatcccataatgtagtacattttagggcaccctttactaggcaactatatccttgaatgctttggcacattcatactttctctctactaccattcctgtatcagctgtggttcctctgaaataaaagattgtagtcagaacgtggtctacatattaatatttatcacagactgtctaacagaagacatggaacaaatgttagctctgaaaacactggtaagagcttggagatagtaaaacttgtttgttcaatctactaaaagttaggaactctattgctttgtcattagatcttctgaagtttgtacttagttttacctgttaacagtatttttgcaggaatagggagactattaaaacaaggtgaaagtataaataagaatttagataggtgagtgattgattatataggaaactttaatgtgttcaacttaaggagacaaatgctttctctgcaagtatcttttaccaagaagcatttctaatgttaattacaaccccttcttattgcaggttttcttatttttatttattttaagacaagagtctcattgtattgcccatgctggagtgcagtggtgcagtcctggctcactgcaacctctgcctcccaggctcaagcaattcttgtgcctcagcctcccgagtagctggaattacaggcatgccccacccagctaattttttgtatttttagtagagatgaggtttcaccatgttggccaggctggtctcaaactcctggcctcaaattgatctgcctgcctcagcctcccaaagtgctgggattacaggtgtgagctaccatgtccggcctcttattactgggttttaagttaaggttaaccttacttctgtgtattttgaaagtattggtcattttctttggaggaactttttccttttaatttggaggcttaccaaataaattaatctggagtcagtgattaagaaatattttatatctttcaacactagtatgtatttggctgtatcacagattcaaaatactacttttaatgaatgggctttactgttaagttatatctgaatgattactattttgagatcacattggatgtaaaattttagataaatatgtgctttttttaaatagcctggatctaaaaaatcagcaaatggatcagatgataaagccagctgcaaggaatcaaagacaggaaatctggacccgttatcttgcataagtaagcttccctcatctgtgctcgagataaatttgcgaacttttaatctcaacaaagctccccactccttttggtttaaacacagattcgcctatttttagtcatgttaaaatgtatgtttttattaaatataggcactgcagatcttcataaaatgtatcctacaccaccatcattggaacaacatattatgggattttccccaatgaatatgaataataaagaatatggtagtatggatacaacacctggaggaactgttctagaaggaaatagttctagtataggagcgcagttcaaaattgaggttgatgagggattctgtagccccaaaccttctgaaattaaagtaagtatgttttttctagaaaaataattcacttcctatattttcttatagaattaatttgttgctatagtcaaaaattattttatagtggttgcggttttgtagctaagttgaggactgaattattgttgtcactattaagaatgcatttaagaaaataatagaattgtatttagattttattctgtttaaagaaaggaaaaaaggtccagagcctgtttgtttatttattttttcctcctagaagataagatactgaaaacctaccatctttatattgtaggatttttcttatgtctataagcctgaaaattgtcaaattctagtgggatgttccatgtttgcacctctaaaaactctaccaagccaatatctgccccctatcaaattgccagaagagtgtatttaccgtcagagttggactgttggaaaattggaattgctttcttcagggccttcaatgccattcatcaaagaggggtatgatttatgttgttacaatagtatgtgactgcttatacagctttaatttttttttcatagatttacctggtatgctggaaaaataaaattggtttttgaaaattctaaaaattatttctggttaatcaattatagtgattggctgggagcagtgaatcacgcctgtaattcccatactttgggaggccaaggcaggcgtatcccttgaggtcaggagtttgagatcagcctggccaacatacgaaacctcgtctctactaaaaatacaaaaattagccaagcgtggtggcgcatgcttgtagtcccagctacttgggaggctgaggcacaagaatggcttgaacctgggagtcaggcattgcagggagccgagatcgcaccagtgcactccagcctgggcaagagtgagactttgtctcaaaaaaaaaaaaaaaaaggttaattgggtatggataaactattaggaaacttaagactattatgcttgatttgtattccgaagcaccttttcttttgggctgcaattttaaattgctcccatttttacatttgccatcttttccacacttttcacattttaacatctctgacttggtcagtttcaactcaaggctaaaagaaatctgaatctgagatgtcttataagtggtagcattttaaaattaccatttttccctttttacacatgagcatctctaaaatcatttttctttttttatagtcagtagcatcttagaatcaaggaaatataagtatttctagtaaacaaaatttatagatagtaaatatggatgtctaggtatgcattagtgtatagagtgcttattaatgatttttgaacttgttaattgatccttagtcaacaacaatcacttagagtagatatgttaaccagaaataagaattgactgtgcttgtaattcttgcaatacttgtcctttcataattttctatgtaattgaaaaacatttgggacgtttttagttgtatttcacattactaatatgttcctttatatatatatttgatcttcttttaccctggtgatgatagtgatggaagtaatatggatcaagaatatggcactgcttatacacctcaaactcatacttcttttgggatgcctcctagcagtgcacctcctagtaacagcggagcaggaattcttccttctccatccacccctcggtttccaactccaaggactccaaggactcctcggactcctcgtggagctggtggacctgctagtgctcaaggttcagtcaaatatgaaaattcagacttgtattcaccagcttctaccccatctacatgcagaccccttaattctgttgaacctgcaactgtcccttccatccctgaagcacacagtctttatgtaaacctcatcctttcagaatcagttatgaatttgtttaaagactgtaactttgatagttgttgcatctgtgtttgcaacatgaacatcaagggtgccgatgttggagtttacattccagatccaacgcaggaagcacaatataggtgtacctgtggcttcagtgctgtcatgaacagaaaatttggaaacaattcaggattatttcttgaagatgaactagatatcataggacgcaatacagactgtggcaaagaagcagaaaaacgttttgaagctctcagggctacctctgctgaacatgttaatggaggactaaaggaatctgaaaaattatctgatgatttgatattattgctacaagatcagtgcactaatttattttcaccctttggagcagcagaccaagatccttttcctaaaagtggtgtaattagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacggtaaagtatgccaataaaatacttttttgtttgcttatttccctttagttacattcttaggaaaaagtaataaaggcagtttcccatgtggcaaatacatttaaagttggacttaaaactctttatggatgatgtttttaaagggagaatttcttagcagtttagtttaatttcaccaataaaagtatggttattataaatctgtaattatatacttatgtaggaatatgaaaggcacattccatatatttattagcataacattgctagtggtctgctttattcaacattctttcactcattaagtatttactgggcaccttgtatgtgccaggtattagcctagattcactgttgaacaaagcacacatattctttgccctttttgaatctataatttagtggagaaaataggaaataaacaaaaaagcatataatagatagtaagaagtaatttggaggaaaagcagagtaaaacagaacaagacaccacatatgtactattttagatgtatggtcagataagatactactgaggagatagcatatgggaaaactcctacataacatagaatatgagctatgtagttaaatgagggaagagtgtttcaggcagtgcaaagaccctgagggagtattttgcttttacatgtttgaggaacattaaggtgactgatgctgctggaatgctttgtgtgatagggagactggaaggagatgaaatttaggaggtagccattcaccagcatcatttagagtcttatagaccatgtaaggcctttgtggtttatactaaatgtgatgggaagctattgaacagttttgacaaggaaagtaacatgatccttattctgattgttttttaagagatctctcagtctggcacagtggctcatgcctgtaatcccagcactttgggaggctgaggtaggcaggtcacctgaggtcaggagttcgagacctgcctgaccaacatagtgaaatcccgtctttactaaaaatttaaaattagctgggcttggtggtgggcgcctataatcccagctactcgggaggctaaggcaggataattacttgaacctgggaggcggaagttgcagtgagccaagatcgcactactgcactccagcctgggcaacaggagtgaaactcccatctaaaagaaaaaaaaaatggctgggtgcggtggctcatgcgtctaatcccagcactttgggagactgaggtgggcagatcatgaggccaggagtttgagaccagcctgcccaatatggtgaaaaatacaaaaattagccagcatggtggggcgtgcctgtggtcccagctgctcaggaggccaaggcagaggagttgcttgaacctggggggcggaggttgtgttgagctgagataatgccactgcactccagcctgggcaacagagcaagacactctgttgctattgtgtggaaaatagcgttggggtttggaagtagtgaaagtgagaacagaagcaggataaatcagttggaaggcagtttcagtagcttaggtgaaagatgatggtagcttagacaagataagaggccagcgagatgtaagtaataggttttaggttatttgggaaatagaacctacagggtttgccaaaagacgtgtaaggaaagatgaggcatcaataatagcttgagcacctgggtgaatggtagtactaactacagaggagggaaacacgggggagtaaatcagatacacatttggagataatatgttttaaattcagaggaatgattgggtctggagatagaaaaattttgtgtgtgagttattatgaaaagctgtggatctggatgaaataaactgtagagtaattgtagatagagtagtacaaggatggagctgacatttataagtggggagggagaaaaggcaccaggaaaggaaattgagaaggaggttggaggaaaaccaagggagcatggtatcctagaaatcaggtatagggaatttttgtttgtttgtttttgttttgagacagagtctcgctctgtcaccaggctggagtgcagtggcgtgatctcggcccactgcaacctccacctcccgggttcaagcaattctcctgcctcagcctcccaagtggctggggactacaggtgcacgccaccacacccggctaattttttgtattttagtagagacgaggtttcactgtgttgcccaggctggtctcgaactcctgagctcaggcaatccacctgcctcggcctcccaaagtgctgggattacaggtgtgagccaccgtgcctggcccgggaatatttagaagagagtgatcatctctatcaaatacttcgatacattaaggtgaaaactgagacaggctattggatgtgaccaaatagaagttggtggtcaccttgataggcagtttcagtcaatctgattggagtgggttcacaaaagaacgggatgagaagcaaacttagacaattttctggggacttttgctgtaaatagcagagaaattgcataatagggttaaaagagaggtttattattattttattaaaggtgcattgggagtgatcctatagaaaggaattttttttaattgacagatatggcttatggctgtaatcccagcatttgggaggctgaggcaggcagatcatttgagcccaggagttcaagaccagcctggtgaacatggcaaaacccatctctactaaaaatacaaaaattagctgggtgtggtagcatgcacctgtagtctcagctacttgggaggctgaggtgggagtatagcttgaacctaggaggtggaggattcggtgaaccatgattgtaccactgcactccagcctatttgacagagtgagatttttctcaaaaagaaaaaaatggccatgtttgcagggttgagtaatcatgatagtacagatggaatgttatatggcttctgaaaatgaattacagttatgtataacaaatagatgaatcttagtgatactattgaggagaggaagagggaacaagtcccagaagattacatatagtcagataccctttaaaaatacctctttaatgtattaccgttaataaagttttgaaacaagcacaactaaatgtattatttacatgcacataaaattgagaatattggttaattcttgaaatttcacatgtgtccaaaaatgaccaagagatagggatagggagaaacatttaataagatcgtttttggtaatgttctagttcttgggcagtgagattacagttgttcattttattattaaagaaaatttttgaaatgtaagaggacaacacatggaccagtgattaagttcatgtatatgacagtatcagcatttatccaattattcattctcagggaccaaatttaaaaagggaaagacacaaataaatatcataggtattcaaaaaaaaggaaagattattttaagccatatagagtagttaagatcataggctgtggactcagactgcctgggtttgaaacatgactctagcactatatactaccatgactctagcactatatactacctgctaccttgggccaagttagttaacctttctgtgccttgatttcttaaaatagggtcaataatagatttactttacagggtattgagagaatcaaatgaaatacagagcagttgatccgcccaccttggccccccacaaagtgctgggattccaggcatgagccacccaggagtttgagaccagcctgaccaacctagtgaaaccccatctctactaaaaatacaaaaattagctgggcatggtggcgcatgcctataatcccagctactcgggaggctaaggcaggagaattgcttgaccccatgaggtggatattgcagtgagcccgagatcctgccattgtactccagcccaggcgacaagagtgaaactcggtctgaaaaaaaataaaaaaaataaaaagcagttttggaggttgcaatgagcctgagatcctgccatttcgctccagcccggcaacaagagtgaaactcggtctgaagaaaaaaaaaaaaaggcagtttttggcacatagtaagaactcagatgttagtagtggtaatgacagcagcaggaggattagtggcactctttataattattttgtttttaagaaccaacttatttgccaaataatggaaaatattgagctttacctggtatatgttttttgaataacagtaagcactgatgtaaacagaaagctgcagacttgaaaatgaatttcttaacaacttgtccaaagaaaataatttagtacaagaaagagagaaatggggctgggcaccatggctcacctctgtaatcccagcattttgggaggctgaggcgggagtattgcttgagaccaggagtttgagagaagaaagaaaagcctttatatttcaattaaaaattttcagtattaaaaacaaataatgggccgggcacggtggctcatgcctgtaatcccagcactttgggaggccgaggcaagtggatcacaaggtcagatcaagaacatcctggctaacacggtaaaaccccgtctctactaaaactacaaaaaattagccaggcgtggtggcgggcacctgtagtcccagctactcgggaggctgaggcaggagaatggtgtgaacccgggagggggagcttacagtgagcagagatggtgccaccgcactccagcctgggcgacagagagagactccgtctcaagaaaaataataatgttggaaaacataaatgtgcaatattagaatactttgattaaattatagcagcatcatgaaatggtggcaagctcctgcattagagcccttggcatgtttcctccctcttggatactcgttttccagatatttatgtggataactctgtctcctttaaatcttgtcagatatcatcttctcattataaaaatgcaaacccttcttcttgttctccatcttgctttttttccatagtgtggactattaccttctaacataataaaatttattaattgttgtttcttacccccattaagtacactctttgcaaagttctgtgtaaaggcaaagatttttgtctataatctaaacacctagaataatgaacacagtagatgatcaggatattaaaatagatgtttggatttgtttatttagttttaacatcttgaaagaaggttatgtttgaatgaatttaaaagtctacaaagtatagtttgtatatatatgtattttttctgttttttttgtttctttgtttttgagacggagtctcactctgttgcccaggctggagtgcagtggcgcgatctcggctcactgcaagctccgcctaccgggatcacgccattctcctgcctcagcctctccagtagctgggactacaggtgcccgccacatgcccagctaattttttgtatttttagtagagacgggtttcaacgtgttagccagaatggtctcgatctcctgacctcgtgatccacctgcctcggcctcccaaagtgctgggattacaagtgtgagccaccgcacccagccagtatagtttgtatattttaatgacaacattaattttgttgaagatagacaaagctctgttctaattataaaaaatacatacttgctgaacaaaaattaagaataccatacaattcacccatttaaaatgtacagttggctgctttttagtatgcagagttggacagtcatcaacacagtgggttttaaaacattttcatattaaaccccctacccgttagcagtcactccctttttccgtccaaccttctttcctagctatagacaaccactaagtctattttctgtctctctagatttgccgcttttggatattgcatatcaatcgaattatatactgtatggtcttcagtgactggcttttttcgctttccataatgttttcaaggttcatctatgctatagcacatattagtactttattgccaaataatattccattgtatgaagataccgtattttatttatccattcattagttgatggatatttagattttttccactttttggctattatgaataaagctcccatgaacatttgtgtacaagtttttatatggacatgtttttattactcttaagtggattcactgagtcatattctgtttaatctttatttatttattttttttttgagacggagtctcgctcttgttgcccaggctggggtgcagtggcgcaatcttggctcactgcaacctccacctcccaggttcaagcaattctcccgcctcagcctcccaagtaactgggattacaggctcctgccaccatacccagctaatttttgtatttttagtagaaatggggtttcaccatgttggccaggctggtctcaaactcctgacctcaggtgacctgcctgcctcggcctcccaaagtgctgggattacaggcatgagccattgcgcttggcctttgttttgttttgagacagagtctcactctgtcatccaggctggagtgcagtggggtacgatcttggctcattgcaaccaccaactcccaggttcaagtgattcttgtgcctcagcctccctggtagctgggattacaagcatgcaccaccacacctgactggtttaatcttttgaggaaccgccagattgttttccatagcagctgcaccattttacataactaccagcaatatatgagggtttcacttacacttgtcacattgtttttcttattatagtcatcttataatcaaagtatctcattgtgatactttgtgtgaagtagtatctcattgtggtttcatctgcatttccctaatgactaataatgttgaagattgtttcatgtgcttgttgtccatttgtatatcttctttggagaaatgacttttcagattttttgcccgtttttaaaattaggtttttatgtattgttgaatcctgagttctttatatatcttggatacaaggatataagcccccttatcacatgtgtgatttgcatatattttctcctgtactctggattgtcttttcattttttttttttttaagatacggggtcttgctactttgcccaggctggtctcaaactcttggattcaagggatcctcccgctgcagcctccccaagtagctaggactgcaggggcctactatcacactcagcttcttttcactttcctttttttcatatctccataggatgtgaaatctttttactttcttgatggtattctttgaagcacaaacatttttaattttgatgaagtccaatttattttttctcttgttgcttgtgcttttgatgtctaggtcaggacctaacccaaggtcttgaaaatttactcctattacttttttgaaataactttgtagttttagctcttatatttagatctctgatccattctgaattttttgtgtatagtatatggaagggttctgacttcattcttttgcatgtggatatctagttgtcccagaatcatctatggaaaaatgttatctttaagttgtcttggtacctttgtcaaaaatcaatttatcataagcatgaggtttgatttctggattttcagtttatttctattgattgattatcctccatgatcactcctttttttttaacttttaggttatgggtacatgtgccaggtttgttatattaagtaaaaggtaaacttgtgtcctgggggtcagcatacagattattttgtcatgcaggtaataagcatagtacttgataggtatttttttgtgatcatctttatttatttatttttgagaaagggtctcgctctgttgtccaggctgaagtgcagtgttacgctatcatggctcactgtaaccttgacctcatgggttcaagtgatcctcccacttcagtctcctgagtagctgggaccacaggcgtgtggcaccatacccagctaactttttgtagagacagggttttgccatgttgcgcaggctgcctgtgacctcctaagctcgagcagtctgactgcctcagtctcccaaagtgctgcaattacaggcatgagccaccacccaagcccggcccgttagcattttcaactactaagtagtattctactatgtatacaaaagtttatttaagcatattacatattaagtattgtatttggaacttagttttatctagttccgtacacttttttttgtttttgtttttgttttttgagacaacaggctctcactttgtcacccaagctggagtgcaatgccatgatctcggctcactgcaacccctgccttctgggtttaagcgattctcctgccttagcctcccgagtagctgggattacaggcatgtgccaccatgcctggctaagttttatattttttggtagagacagggtttcactgtgttggccaggctggtctcaaactcctgacctcaaacagtccacccgccttggcctcccaaagtgctggaattacaggtgtgagccactgggcccagccactacactttttaggtataggaaattggggccaataacgataaactaggcaaaggtaataacgaattaaaattgaataatttaatataactgtgctcaaacaggtttagtggtacaactggaccattctgggggccacatttattatatcaatatcttttagtgatttttcctttagccatttgacatttatgaggagcacctttcatacccattctgatagttggtcagaaatgcaggtcataatttgataatttataaatatttaagatgtataagcttataaaatatttatggataatatactttttagcagtgtgagcaagttactgtataatttctgtattttagaattgttaaagtctactttttttttcaaattaaactttaataattatgaccagtctttattcactttaccatagtagtgctaatgatgggatataatttcaatgtgaggcagacttctttctggtaaaatacctacagcaccaaaacagccaacataaatgcaaaaagaaagaaatttatttgattaatttataaattgattaatcagctaatgaatgactttttatggaaataagttacagtaactttttattgtgtgtcttcttggttgtaagaatctagaagaacctttttacagatcatcttgtagaacttaatgcaattctctgcacaagtaagggtttaatcttcttgatgctgaagacctgaacttccctatatgtgttttgtattatcttaaaattttatttgtgttggcaatagcaattcttaattacttgttttttttaaaatgcttgtagatgtgagtatgcagtgctcacaggatatacttcgaatgctcctctctcttcagccagttcttcaggatgccattcagaaaaaaagaacagtaagaccttggggtgttcagggtcctctcacttggcaacaatttcataaaatggctggccgaggctcttatggtaagtaatttatagtgatatataatgactaattttatatcagtcctcagatttctgtgcccaactagaataagcacattagttttctttaaatatatttgtgatatattcttaaggccactgtggtccaatcctagctttttttcccaccatttccaacattcagcttactcaactctccaactccacttcaaaaggagtggcttctcttaggtctgttcttacacatagggggctttccctcaagattttacatgaagaaagggacatactgcttagattttttttttaaaggcaaaaaaaatacttttgttatttattttacaaaattaaatgaaaaagggaggtggagtgggaaatgagggttatactagtgataaaaggccccctaaggtcttcatttaaaaagaattacaactaagaagaaatttgctggttgtgaccagagtagcaaatgaattctcataataggtatgcagatttattgtcagctgtgatgaaaatgccattccaaatatttgaattatttgttgaagattgtctctgaaaggtgggccgtaattggagtttttcagatatatttggaatgatacgtcttgaaatctttgacttttgtgtatggatttggaatgtattacatatgaaagtagtagatttgcctatattttccttttctccctcttttaatggctaaataatttaaatctcattacaaaactaatattctgtgaaaaatgcaggtcaatgaaaatatattttattttattttattttatttatttggttttttttggagacagagtctcgctttgtcgcccaggctggagtgcactggcgccgtcttggctcaccgtaacctccgcctcctgggttcacacaattctcctggcttagcctcccgaacagctgggagtatgggtgcacgccaccatgcccggctcatttttttacttttagtagagacagggtttcatcacgttggccgggctggtttcaaactcctggcctcaggtgatctgcctgcctcagcctccctaagtgctgggattacaggcatgagccactgtgcccggccagaaaatatattttagtataaacttttacattattttaaaaactaagatggtagccggcgtggtggctcacgcctgtaatcttagcacttttgaaggccaaggcaggtgcatcacctgaagttgggagttcttcaagaccagcctgaccaacgtggagaaaccccgtctctactaaaaatacaaaataagccgggcatggtggtgcgtgtctgtaatcccagctacttgagaggctgtggcaggagaagaagaatcacttgaacccgggaggcgcaggttgccgccagccgaggttgccatgagccgagatcgcgccattgtactccagcctaggcaacaaaagcgaaactccatctcaaaaaaaaaaaaaaaaaagtagatatttatttatttatttctgtaccttaactgattttggagatcatttctatctgcacatatagagattatctttttttatggctatatgtattccattgttccttacatatgataatatattttaccagtgcagtgtttatgaacatacaaattgttaccaccattatcattacagctacttttcagtaatgcacagatccctggctttaaagcatgggtgtatttttattttatttattattattatttttgagatttgttctgtcaccctggctggagtacagtggcacaatcatggctcactgcagccataacctcctgggtccaagtgatcctctcacctcagcctgccaagtagctggtactacaggtgctcaccaccacacccagctaatttttgtatattttgtagagatgaggttttgccatgttgcccaggctggtctccaactcctgggccctagtgatctgcccaactcaccctcccaaagggctaggattataagcacccagacgtgtatttcaagaaaaaaaaaaaaaaaaacctaaataactatctgtaatgccttttttttttttttttttttttttgagacagtctcactctcttgcccagactggagtgcagtggcatgatctcagctcactgcaccctctgcctcccaggttcaagcagttctcatgcatcagcctcacgagtagctgggattacaggcatgcattaaccacacctggctaatttttgtatttttactagagatgggattttgccatcttgcccagtctgttcttgaactgcttgcctcaagtgatccacctacctaggcctcccaaagtgctgagattacaggcgtgagccaccatgcccagcccctgtaatatcagtttgaattcccaccagttaaagtgcctgttttcccaaagccttgcctagtaggatgctgattcagtggatgaaaaatggttatttcccattatagtttgagagactaaatagtacagactgtggggatagatttcttgggtttaaattcctactctgctacttcttgtgaaatgctagagaaattgcttaacttcctcatttatgttttctcatctctaaaatgaagttaataatagtttctgccttatgttttttgtgaggattaaatgagttagtacatgcaaagagctttgaacagtacctagcacatagaattatcattgtttgctattattaattttaaattgcttttttaatgagaaagagcatctttttatgtgttagagatagttttgttttgtaatctccatgttcttaacccatttttctattaggttgttggtcattttcttttaaaaatttttttattatggtaagaacactcaccaggcatgacgactcacgcctgtaatcccagcactttgggaggccgaggtgggcagatcacttgaggtcaggagtttgaaaccagcctggccaacatggtgaaaccccatctctaccaaaaattcaaaaattatcccggtatggtgatgtgtgcctataatcccagctactcaggaggctgaggtgagataattgcttgaacccaggaggtggaggttggagtgagtggagatcgcaccactgcactgcagcctaggcaacagagcaagactgtctcaaaaacaaaacaaaaaaaaactaaaagaaagaacacttaacatgagatctgcgctcttagtaaggttttttcttttttctattttttaaattatattatttttaaatgtataaataaggatggtgtctcactatgttgcctaggcctcaaactcctgggctcaagtaatcctcccacctcagtctcccaaggtgctgagattacaggcatgagccacagcacctggcctacagtgtatttttatgccaattttttttttgtttgtttttnnnnnnnnnnnnnnnnnnnnnnnnnnnnnnnnnnnnnnnnnnnnnnnnnnnnnnnnnnnnnnnnnnnnnnnnnnnnnnnnnnnnnagctcaccgcaacctccaccccctgggttcaagcaattctgcttcagcctcctgagtagctgggattacaggcatgcaccaccatgcccggctaattttgtatttttaatagagacaggctttctccatgttggtcaggctggtcttaaactcccagcctcaggtgatctgcccacctcggcctcccaaagtgctgaaattacaggtgtgagccactgcacccagccccatgccaaaaatttaaatgcagaccagacgtggtggctcctgcacgtaatcccagcactttgggaggctgaggaaggaggatcacttgagctcaggagtttgagtccaccctgggcaacacagcaagatcccatctctacaaaaactttaaaaattagctaagcatagtggcacacacctgtagtcccagctattcgggaagctgaggacagaggattgcttgagcccagcaggttaatgctgcagtaaggcgtgattgttccactgcagtctaatctgggcaatagagcaagaccctgtctcaaaaaaataagtaaataaaaagacttgtttaggaaattccttaatgttgaaaagtcttgaccactggcattaagtatttttgtctctaataaaatattttcactaataatgacttcattaacttttgacatttaaataaaaaggaggccgggcatggtggctcacacctgtaatcccagcactttgggaggccgaggtgggcggacacaaggtcaggagctcgagaccatcctggctaacacggtgaaacctcgtctctactaaaaaatacaaaaaattagccaggcgtggtggcaggcacttgcagtcccagctactcaggaggctgaggcaggaaaatggcgtgaacgcgggaggcggagcttgcagtgagccgagatggcgccactgcactccagtctgggcgacagagcgagactctgtctcaaaaaataaataaataaataaataaataaaaaggagacatgtcttgtttttaagtgttttcttaaaatacatctttcttatttaggaactgatgaatccccagaaccactgccaatccccacatttttgttgggttatgattatgattatctggtgctttctccatttgctcttccttattgggagagacttatgctggaaccctatggatctcaaagagatatagcctatgttgtactgtgtccagaaaatgaagccttgttaaatggagcaaaaagcttttttagagatcttactgcaatatatgaggtaggtgtttaaaaagagatgacattttaaaactaccttacgatttgtattgttgtatatacagcatactgggcagttcagttgattgggacacagtgatgatgtcagattagatgtttatttctcatactagccagttacattctttgctgagtttgacccagtctgttagatgtgtatgccgtgggtcagagtggctatccccctataggaggaagaaacattgagggcatatagatatatatcccttttaatgtggctttttctaaaacaaagggtaacaatgttaaatagccaggaaaaaagttacatttacaaaaattctagtctttattctctaggatttcaggtagtgacactaggcctcactttcctcatatgtaaaataaatctatgctagatatcactaaggtccatttcaggtctgaaattcttgcctcttcttttaagttataattctcacatatccatcaccaggcgcaataattgtaaattataagtgttatgggacataaagtcttactttattattccctcctttttccacaaaggcttcgaaatttagtctttaaattttgattccttatacaatctgaatgttagtgtatgttagtttagcttccttttaaaattttccacataattacaaggtatttgtagtgtgtttttaataaataaacatttcccaaagggtgttatttggaatatcagtccggtaaaatcctctcagagaaaaagttccatagttaaataggcttggggaaacattgtatattatattaccttttagagatttacaattcatattaggtttttaaaggctttgaaattcttacagtaaagaactcttctaagtttgcttaatccaatgttttaaatttatttaacattgggcttctaataacaaaaatcagtgactcacagaactagagggagaaggtgtataaatatatttgtataacaatttttattttgctttgatttagggatatttgtattcataattcatgaattggtgttaatgtatacctaaaatgactgcatttttatgctcacttatgtctgcattctgcaagcttttattcaaacaaaatggttctagtactattgttatctaggtgttttttcattagagatattttaattttgaaaaaaaattaatgaatttctaatgtaaaaatgaaaaagacctatggcaccatttcacccttgatatgtttatttttttggcctacttctaaaaacacccttgatatttttatcataactgttaattgcaaatggttaagcttattttaagtagctttcatggttggttttataatgtgtatctaaatacaataataaatttactaattctgctttctgtatgtatatttgtagtcctgtcgattaggtcaacatagacctgtttctcgactgttaacagatgggatcatgagagttggatctactgcatcaaagaaactatcagaaaagttggtagcagaatggttttctcaggcagctgatggtaacaatgaagcattttctaaactcaagctttatgcacaagtctgcagatatgacctaggtattgaatttgtatttattgtataaggctggtgttagcaaaatgtggcctgctccaccagctgtttttgtagataaaattttattggaacacagccatcctcatttatgtattttctctggctgcttttgtgctacaacattggagctgagtagttttcatagagactgtgtggctgcaaagacaaaaatatttattatctgaccctttacagaacaagtttgctgatccctaatgagggatcccatcaggtaggaagaaattatgggttataaataaattttctgttgcctctgtagggtctgatgttttaataacttgaagattcttcatttgttacagtttagagataaaataatttatagttaatctctaccaaaccaagaaatagttctttgttgtagctaagaaaacgacagctgtttaagacttgcttgttacatactttttttctttcattctacccgtgcctaactgtattgcttataaatactcttgaaaataaagatcagtggacttcctttagacttaatccaaagagatgcagaaccaaaatattgaatctcattagacattcctataatttgaaccccataacattataccattttatattttaattagctgtcaatgtagtcaatatttatttgatttgtgatttagaaaccctttgaatagtttgatgaatattgctagataccttttttacatttaattatacttagaaaatagaattttgttacactttcatagtaatcatttctttaattttgagtgaaaattctggctttttcaattccattttaaatatgtttcttcagtctctaggggaaaatagaaagcaagtgtaggtcacaccattagcaagcaatttcggggctataattaccaagaaaacatcaactggattatgattctgtttacacagtagaatttaaaaaaaccagtcagtgaaataaagaattaaatttcgtacctgtttttattctttaggtccttatcttgcttccctgccattggacagctctctactttcccagccaaatttagttgcccctacaagtcagtctttgattactccacctcagatgacaaatactggaaatgctaatactccatctgccaccttagcatctgcagcgagcagcactatgacagtgacttcaggtgttgccatatctacttcagttgccacagctaattcaactttgaccacagcttcaacttcatcttcatcatcctccaacttgaatagtggagtatcatcaaataaactaccttcgtttccaccctttggcagtatgaacagtaatgctgcaggatccatgtctacacaagcaaatacagttcagagtggtcagctaggagggcaacagacatcagctctacagacagctgggatttctggagaatcatcttcacttcccactcagccgcatcctgatgtgtctgaaaggtacctttaaaaatactgatttttgcagaaatataaaaactatgatgctgcttctttctttttttttcttgagacacagtctcactcttttgcgcaggctgtactgcagtggtgggatctgcactcactgcaacctctgcctcccgagttcaagtgattctcctccctcagcctccctagtagctggaattacaggcatgtgccaccacgcctggctaatttttgtatttttagtagagacagggttttgccatgttgaccaggctggtctcaaacttctgacctcaggtgatccacccaccatggcttcccaaagtgctgggattacagacgtgagccaccacgcccagccatgctgctttttttctaaataagacgttttgaatgagcataaagtgcttttttatcttagtcttgaaattttagtttgtatctttttttaagacaaggtctcactctgtcacccaggctggagtatagtggcgtgatcacggctcactgcagcctcgacctcctgggctcaggtgatcctcccacctcagcctcctgagtagctgggacttacaggcatgcaccaccatgcccagctacttttttgtagagatgtggtttcaccctgttgccctggctggtctggaactcttggactcagcaatctgcctgcctcagcctcccaaagtgctgggattacaggcatgagctatcgcacccggcctagtgttgaatattttatgtataaaattataatgaggactttacttcataaagtatcatagaattctagaatctgagggtgggaattaagagcttgaaaaccatatagtccagatacccatatgacatttgagtcttctgtggcataattgtcaagtagatttgcctgtgcaaatcactctggtgattgagaagtcactattgacccactctatttagaggctttagagttgtactgaggtttgaatctcagctctgccatttacctgctttgtgacttcggggaaactctaactttctgagcatgttttcttatctgtaagatgagagtaatatgatataatatacattaagtactttacacagtgattccaagttatttatagtgacaagaatgattatgacagctctcattccttttttgatgaaggttttgatcttcccttttgatttataggccaagttggccagagcttaattatatctgtcagctacccaggatgcagttgtgcccaaaattatactcatatgtgggtaaaaacaaaccattatcgagattgatacactcatcttgaacatatgaatagatttgaagtgtaaaaaaatcaaatcacccatcaaagaatgaaacttgtacaccattgaagctgtaaagtatgaaataaatgtatatagtctaaaaatgggaccaggtgaagtggctcatgcctgtaatcctagcactttgagaggctaaggcaggagggttgcttgagaccaagagttcaagaccaacctggtcaacatagtgagactcccatctcaaaaaaaagatatatatatacacatatatagagagagagagtctgaaaatgtactagaacattaaataagtctggaaacgtggtttctttctggcctagctctacctgtagccacctttataaatttggtaagctatttgagatagcctcagacaaagagacctatctttgtctcagttttatcccttaaactctaagccatcttttgtatctaatacccttaccctatggttttaagaattttttttcttttctttccttttttttttttttttttttttttttggtaaatttaaggcaagacctcttaaggcaagtgtctttatacactgtgaaattgtatgtacaatgtttatggttcattttggcgagaaagaaatgtccttcatttttagagaggctttctgacacctttcaccaaaaaagagggaggagggggatattaagaacctgcttagatgctaccccaagcatatacagtacaactttttgtctcatttctaccttaaattttagcacgatggatcgggataaagtgggaatccccacagatggtgattcacatgcagtcacgtatccacctgcaattgttgtttatataattgatccttttacatacgaaaatacagacgagagcactaactcttctagtgtgtggacattggggctacttcgatgctttctagaaatggtccagactcttcctcctcatatcaagagtactgtttctgtacaggtaagagtgatagatgttgtgagttaaaattatgtaaaacagtttaatgttgtcagaagtttcagatactacttttctgtattcaaattgattatctaaaagccaagttctattatattgattttactttaatatcataatataaatcttagagaatttataaaagataaactttatagtcatatgacagtaataatacagaataaaaaaattccattaagtacattaaatgtttctcctgtgttacttttataagccaatttttaaattcatgagcctaaatagaaaaatgtagcatgtacctaaacaagacaggttgcaagaaaaggagaaagcaattaaccatattaagttgttagaagaaattttgaatttattttatagacttcaacaggactagtcaatggcattattaatataattgttatatagaaaattttacagttttttgttgttgttttttttctgagacagagtctcgctctgtcgccagactggagtgcagtggcgtgatctcggctcactgcaacctccagctcccaggttcaagagattctcctgcctcagcctcctgagtagctgggactacaggcgcatgccaccacacccagctcatttttgtgtttttagtagagacagggtttcaccatgttggccaggatggtctctatctcttgacctggtgatctgcccacctcggcctcccaaagtgctgggattacaggtgtgagccaccacacctggccagaaagttttataggttttaaatagtcctttaattcagaacccattggtaaaattggctacttattaaaagcctacataatagataagaaaacaatcgttaaattttcatttaaattaggttttgtgtaaattttctagtaaaaagtttttagagttttagacccacagttcctgttattctcttttggaagtttaacatttgtaatatttgcctatacttcttagattattccttgtcagtacctgttgcaacctgtgaagcatgaagatagagaaatctatccccagcatttaaaatccctggctttttcggcctttacccagtgtcggaggccacttccaacatcaaccaatgtgaaaacattgactggctttggtccaggtttagccatggaaactgcccttagaagtcctgatgtaagtatatgtttttcatgaccgaagttcaatgactatacataccttttttttttttttttttttttgagatggagccttgctttgtcacccaggctggagtgcagtggggcaatctcagctcaccacaacctctgcctcctgggttcaagcgattctcctgcctcagcctcctgagtagctgggattacaggcatgcgccaccttgcccagctaattttgtgtgtgggaggagtttcaccatgttggccaggttggtttcgaactcctgacctcaggtgatcgcccacctgtgcttcccaaagtgctgggattacaggcacgagccaccgtgccctgccaacatttttatgatactatgcaaaactaagtgcaatttttggcttagctgtcattttccaattatcttataattgggtagataagaattacattttaaatgcaatatttctctaagattgtatagtatgataataccttaattttttattttatagagaccagagtgtattcgactttatgcacctccttttattctggctccagtgaaggacaaacagacagagctaggagaaacatttggagaagctggacagaaatataatgttctttttgtgggatactgtttatcacatgatcaaaggtggattcttgcatcttgcacagatctatatggagaacttttagaaacttgtatcattaacatcgatgttccaaataggtatttgtatttccctaaatatatcatatcattccatttgtaacattttgtttcatttttaatgaatagaaaaccagtttgaaggttttatatatattaaaatattaagatgtggggttgtgggtgctttttacttttttctttagtgaatgtttatattgtataactaacataattaaaaataattttgattaatctattatatgaacaaaaaagattaaggtcactaacttctgtgtcataaagcttgaggcaattattttagctgaacatttttgaaagatgtaaaaaaatggtctagtaaagtatctatagaacatttaaacttttctcatgtaccatctaagatatagcccctaataaactgagtaagttaacttcatttactaaaattggcgatttaaaattttatcatttaaatgttaggatgtagccgggtgtggtggtggttgcctataatcccagctactcaggaggctgaggcaggagaatcacttgaatctctgggaggcggaggttgcagtgagccaagatcacgccattgcattccagcctgagtgacaagaatgagactctgtctcaaaaaaaaaaaaagtttggttgtcttcagaatatgatgaccattttagaattcttggcagtaaatatcacgcccagttatttacgaaggatataactaataggtcacaacaggtgagcctcattttgagttatcacttaataaacatttcaagcctttagtagagacttgaaacatgttttcaaggctagtgaacgctgtacaggagaacctgaaaagcaaattcgtgaaatgatttttagttttaagatttgggttctggccagacgtggtggctcctgcttgtaatcccagcactttgggaggctgagacaaggcggatcacttgagtccaggagttcgagaccagcctgggcaacatggcgaaaccccgtctctacaaaaatacaaatattagctgggcatagtggcccacctgtagtcacagctactcgggagactgaggcagaaggatcacttgagcccaggaagtcgaggctgcagtgagctgagattgcaccactgcactttaacgtgggcgacagagtaagaccctgtctcaaaaaaaaaaaaaaaaaaaagatttgggttctatcgtttattttcttccttattatataaaagcttgttttttaggtgagaagttaaatatatgcagaaatatctaatgattattaggtctttaatggtgctggggaagcagaagatagaaacattaattttatattattgattataaacattaacaagtatgttaagctttatattataaaccttagaacagtgcttcgtatcttatttccttgatacaattttgatttttttaattggatatttatactgattaagtgaactcgggaaagaatatgctaatctgtgaagtatgagaaagtagagaaaaaaaataccacccttttcattatcaaaatagtattatcattttactaccttgataaagtagaagtgagataatggttaagaggggcaatgatggggctgggcatggtgactcatgcctctaatctcagcactttggaggccaaggcaggtggatcacctgaggtcaggagttcgagaccagcctgactgacatggtgaaaccctgactctactaaaaatactaaaaatacaaaaaaattagccaggcatggtggcatatgcctttaatcccagctacttgggaggctgaggcaggagaatcacttgaacccaggaggcggaggttgcagtgagccgagattgtgctattgcactctagcctgggcatcaagagcgaaagtctgtcttaaagaaaaaaaaaaaagaggggcagtgatggagtcagagagacctgggctcaaatcccaaacctgccactactgaccttggaaaaactacccttatgcagctgagatacagcttacttatctgtaaagtctagaggataattttatttgtctcatagagttgttaggatgaaatgaggtattacatgtaaattgattgggcacaatggatggtacatagtaagtgctcagtaagtcatagccactgttggctgggcacggttgcttatgcctgtaatcccaacactttgggagggcaaggtgggcggatcacctgaggtcaggagtttgagaccagcctggccaacataatgaaaccccgtctatactaaaaatacaaaaattaggcctcgcatggtggctcacgcctgtaatcccagcactttgggaggccaaggtgggcaggtcacgaggtcaagagatcaagaccatcctggccaacatgctgaaaccctgtctctactaaaaatacaaaaattagctgggtgtggtcgtacacgcctgtagtcccagctacttgggaggctgaggcaggagaatcccttgaacccaggaagcgaaggttgcagtgagccgagatcacaccactgcactccagcctggcaacagagcgagactcttgtctcaaaaataaccaaaaaacaaaaattagtggggtgtggtcgcacgcgcctgtagtcccagctactcaggaggctgaggcgggagaatagcttgaacccaggaggtggaaattgccatgagccgagaccataccattgcactctagcctgggtgatagagttagactccgtgtcaaaaaaataataagtaatagccagctgggcgcggtggctcacgcctgtaatcccagcactttgggaggccgaggcgggcggatcacaaggtcaggagatcgagaccatcctggctaacacagtgaaaccccatctctactaaaaatacaaaacattagctgggcgtagtggcgggcgcctgtagtcccagctactcgggaggctgaggcaggagaatggcgtgaaatcaggaggcggaacttgcagtgagctgagatcgcaccactgcactccagcctgagtgacagagtgagactccgtctcaaaagaaaaaaaagtaatagccactgttgctcagccaaagagtgcttatgttgcatatttggctagtgaaggacatgtatgcagaaaacatgtaacaatgttgtttggactgagaagtgtggtgttttggtcagtcttcaacttatagtatagaacagggattgcttactgcagcccatggaccaaatctggctatttccatttgaagtattggctctttaaaaaaagtttgctgggtcaagcagggtggctcacgcctgtaatcctagcactttgtgaggccaaggcgggcggatcacgaggtcaggagttctagaccagcctggccaagatagtgaaaccccatctctactaaaaatacaaaaattagccgggtgtggtggcgggcgcctgtaatcccagctactcgggaagctgaggcaggagaatcacttgaacccaggaggcggaggttgcagtgagcagagatcatgccactgcactctagcctaggcgacagagcaagactccgtctcaaaaaaaaaaataaaaagtttactgggccaggcgcagtggctcatgtctgtaatctcaacactttgggatgctgagacaggatcacctgaggtcgggagttgagaccagcctggccaacatggtgaaaccccctctctgctaaaaatacaaaaattagctagacgtggtggtgtgtgcctgtaatctcagctgctcggaaggctgaggcaggagaatcacttgagcccgggaggcagaggttgcagtgagccgagattgtgccactgcactccagcctgggcgacagagtgagactccatcaaaaaaacaaaaaatccctggcgtagagcagtattgctgatgaattgaggtgttttatagacaaatttttttaaaaatttatatattataatgtgaaatagaaaagcaaactcagatgccaaacctatgattttatgaatattctcgcttaggacttacgtaaaggttttgtgaagcactaaaattaaggagatctgtttttcacaaatttgagctctcttaaaatgtcgggatggcacggtggctcacacctgtaatccagcactttgaggggacgaggcaggcagatcacgaggtcaggagctcgagaccatcctggctaacgcggtgaaaccccgtctctactaaaaatacaaaaaattagctgggtgtgttggcacacacctgtagttgtagctattcatgaggctgaggcaggagaatcacttaaacccgtgaaggtggaggttgcagtgagccgagatcgcaccactgcactccatccagcctgggtgacagagtgagactccatctcaaaaaaacaacaacagcaaaatcatataaattttagaaatatttatgacactctctttattcacacaatagggctcgtcggaaaaaaagttctgctagaaaatttggtctacagaaactttgggagtggtgcttaggacttgtacaaatgagttcattgccatggagagttgtaattggtcgtctaggaaggattggtcatggagaattgaaaggtaaaattgtgcttttattagtatttatatttccgttttatgtaaattcacacacagttctgaccacgtctaggtatatatgttgaataaaatgcaaaggttatcaaataaggaaccacatatgtctaggccacaaatggcttaattcaaattttaaaaagacattttactcttattttaactttaatatcagtcttattactgctgttcttaattgttttctgttttttccactttctgattgttatttaactcatcctctgttgagcagataccaattgaatttggtgtatcctaatattagggggataaagaatgttcagtagcatcagcagtaagaattttggcttgatgatgactcgtgttggaggaatacactaatttaaaagccattaactatttttatattttaactttaacttggttctacaggatattaataatgctgttactttgattttttttttttttttttttttttttactgttgatacccacagattggagctgtttgctgagtcgtcgaaacttgcagtctctaagtaaaaggctcaaagacatgtgtagaatgtgtggtatatctgctgcagactcccctagcattctcagtgcttgcttggtggcaatggagccgcaaggctcttttgttattatgccaggttagctatctttagtttatatcagatttaattctttatgcagttaagtttttaagtattatatacaatttattcttcgtttattaaaagaaaaaatgtctttcattttcagattctgtgtcaactggttctgtatttggaagaagcacgactctaaatatgcagacatctcagctaaataccccacaggatacatcatgtactcatatacttgtgtttcctacttctgcttctgtgcaagtagcttcagctacttataccactgaaaatttggatttagctttcaatcccaacaatggtacgtaatttgttccattttggtagtctgaagaataccccccaaaataaattcatgtccaatacctgaaacgtgtgaatgttaccttgttttaccaaaaaatgattttgcagatgtgataagttaaggatcttgagatggagagattatcctcaattacgcaggtgggcccttaatgcgataacatgtgttcttataagaaggaggcagaaggaggtttgactacatagaagagaagaaagccatgtggtggaaacagtgggaagcaaagtcaaagggagaagatgctatgttgctgactttgaagatggtgaaagagcccatgagccaaagaatatagttctagactctgaaaaagacaaggaaacagattatccctttcagccttgccaacatcctgattgcagtccaacgaaactgatttcagacttctggcctccagaactgtaagaaaataaatatgtgttgtttttaagccaacagtttgtggtaacttattaaagtggcaacaggaaactaatacaatcattctttcaccttgttgatatcagaactggtgctgtgaattatcccataaatctttactttttaaaaattttttgagacagagtctcactcactctgtctcccaagctggagtgcagtggtacgatctcagcctactgtagccttcacctcctgggttcaagcgatgctcgtgcctcagcttctcgagtagctgggattgcaggcacatgccaccatgcctggctaatttttgtatttttggtagagatggggtttcaccatgttggccaggctggtctcaaactcctgacctcaaatgatccacccaccttggcctcccaaagtgcggggattataaacatgagccaccatgcccagccatctttacttattttaaaaggcaatagttggtcacaaaatatttgtataggtttacccttgtgcttttgaggtacctgtacatgaactcattttatatatctcttatgttgatttgccaaaataatgtaatttatataaactgccaaagtagggacgtagcttttccaggtgaatttatagattgcattttagtagaagagaaaataaagaagattttattgttattctgagctaccttaaaaactctcacatctctaaagtcacaagtatggttattatgctctcttgttttcgtgtgttatataataactcgaatattttacttaataaagaacatggtattattcgtaaatacagtaatcctccttatctttggttttgctttacatgatttcagttgcccatgggtacagtacaataagatagtttgaaagagagagagagagaccacattcacataccttttattatagtaccttgctataattgttctaatattctcgttgttaatctcttactgtacctaatttatcattgaaactccatcataggtgtgtacgtaaaggaaaaaccagtatataggatttggtactatccttggtttcaggaatctatgtgggtatgggggtgggtcttgggacatattccccatggataagggggaatactgtagtcccactttaaacacattttcattttgtttgtactatgtttgctttgtattagtttcctattgctgctctaacaaagtactacacatttagtggcttaaaacaacacgcatttattttatcttacagttctggaagtcagaagtccaaaatcagtctcactgggccaaagtcaaaatatcagcaggattgattactttctggaggtcctaagggaaaatgtttccttgcctttgtcagtttctacaggctacttgcattccttggctcatggtcccttcctctatcctggatgccagcagtatagtgtcatcacatctccttcactggctctaaccctactgcctccctcttattaggacccctgtgattacattggacccacccggataatccagaataatctccccatctcaagatccttagcttgatcacatctgcaaagtcttttatggtaacatattcttagattcctgggattaggatgtggacatctttggggggccattattcagactaccacatgcttgtttatgcataattatttgtacggcttttagcacaatacttggcacatggtagacactcagtaaatgttggttaaattaacccattttggttaaaatttcatttattttgaccctttcctgtgaatgaccataggatatggaaaatggagttttaaatttcttttctttctcctgtttagatggagcagatggaatgggtatctttgatttgttagacacaggagatgatcttgaccctgatatcattaatatccttcctgcttctccaactggttctcctgtacattctccaggatctcattacccccatggaggtgatgcgggcaaggtaactgtgttacaagttttagtttttctcggccgggcgcagtggcttacgcctaaaatcccagcactttgggagggcgaagcaggtggatcacgaggtcaggagtttgagaccagcctggccaatatggtgaaaccccatctctactaaaaatgtaaaaaatagccgggtaaggtggcacgcacctgtagtcccagctactcaggaggatgaggcaagagaatcacttgaacctgggaggcagaggttgtagtgagccgagatcatccaattgccattccttaacttagtaatggattaatatatgaaatgcaatactatttttccttggaaattagcaagagttgacattaattaacagtacattcatgcatttctacatcatggacatcagtactttgaattgcacatttttaagagaatctctaaggctctactttccctgaatccgtattttctagaccatttggcattagtcatttttttgtagtttttgtggcagttcaccatagctttttactcagatgtaggatcacagtatctttcagaatcactatatataactctaagagcagccattcatatcagggctgtgacaaggaatataataaaaatattaattttctcataagaccagataaaacactgaccatctactccccctttttatctttagcagttatggaagcaggctgtcttgtccttatatttgaagtaaaaacgaactgggcttcagttaataacacctctctatttgaaattatatatactgggctgggcgcggtggctcacgtctgtaatcccagcactttgggaggctgaggcaggcggatcacgaggtcaggagattgagaccatcctggctaacacagtgaaaccccatctctactaaaaatacaaaacttagccaggtgtggcaggcgtctgtactcccagctactcaggaggctgagacaggagaatggtgtgaacccgggaggtggagcttgcagtgagccgagatcgcaccactgcattccagcctaagcgacagagcgagactccatctcaaaaaaaaagaaaagaaattatatatactggtgatttgattattgtagtatgcataggtataaaatttacccttttaaagtaaggaaggatctttccagtcttactttgcattccttcctcctttttgtaactgcaaagaaattagataggaaatacatataacaaaaagcaccagtaatcccaccaccttaataaaaccatttttacttttaagcaaattatcttctttccacatacgtttatgttgcaattttcaataagtataatgaggttttaaatattgcatttttgctataccctaatttatgtccttcccaaaatattggacatgtaagatttttttttgttatagataatgatgtaatgaacgttttcatgcatattatttttattttatctatttttaaataccaagaaatacattaactaatccaaaggatatgcatgtgacttggtagttgtcccttcatgttgccataataattttcacaacactattaactgcattttatagatagtgctagattaacaaagctaaattgaatccaccttttgattggggtgtggttttcaggacttaaaggaatattagcaaaaaagttaaagatgtcattgaaaattttgtattttttactcatctgtgaagttttacaaactttcccgtgaacttggcataataatacagacttgttaaacagttggcatatcatgcaatccttaaaatatgttctattaatgcttttacttataatactcctaagtacatagaaactggttttttttcaatatccttcagtattttattaaatcgatgtcataagataatgagactgattgctatgagccattctgtgtttatatctggtacttagttacactgagtgaactaatatacttttaattttgtctttttaagggtcagagtactgatcggctactatcaacagaacctcatgaggaagtacctaatattcttcagcaaccattggcccttggttactttgtatcaactgccaaagcaggtccattacctgactggttctggtcagcatgtcctcaagcacaatatcagtgtcccctttttcttaaggtattgccatttctgtcccagttcctaaataattctgattgacagcctaagtcctgagaaatatagaagtggcttttttaagtcttatagcttgtctaagttcttaaatgcactgccatatgtgactctttaaacaagatcacgaaggcacggtggctcacgcctgtaatgccagcactttgagaggccgaggcaggcagattacctcaggtcaggagtttgagaccagcctggccaacatggcgaaacctcgtctctactgaaaatacaagaattagccaggtgtggtggcgggcgcctgtagtcccagctactcgggaggctaaggcaggagaatcgcttgaacctgggaggcagaggttgcagtgagccgagatcgtaccacttcactccagcctgggtgacaatatctgagactctgtctcaaaaaaaaaaaaaacaactagtttttaaatttatatttttagaactttattcctaagtcaaactcctagggcccttgttgttagtgtagattgagtatcccttattcgaaatgcttgggaccagaattgtttccatttttggattttttcaaattggagatgctcaatctgtttcaactgcatatatggaaatttagagctgagagaaactttatattacctctgtctaaccttctcattttctaggtgagcatatttaagttcagaaaaactcacctgtttaaagtcataaattggtaatagactcaagactgaaacctgggtcttttaatgattattatgttattctttgaattacatcatactgcactgctgttatgctgcattattttggggaataaaagatttataatcttgggctgggcgcagtggctcatgcctgtaatcccagcactttgggaggctgaggcaggtggatcacaaagtcagcagttcgagaccagtctggccaacatggtgagaccccgtttctactaaaactacaaaaaaattagccaggcgtggtggcacgtgcaaattagctatttgggagactgaggcaggagaatcacttgaacccggcaggtaaaggttgcagtgagccgagatcgcgccactgcactccagcctgggtgacagagtgagattccatctcaaaacaaacaaacaaaaaaaagatttataatctttgtaatacttgatttttagtttcatttactacttaaaaaagtttttctagctgtgtgtagattgctgtgttaaaaaaaaactgagtggtttttaaatacagtaatgagactctcagattcatcgtgatttattacaacaaactcaggctgggcacagcgattcacccctataatcccagcactttgggtggtcgaggcaggaggatcacttgaggccaggagtttgtgatcagcctggacaacatagtgaaattttgtctctctaaaaagtttttaatattaggcatggtggcatgtgcctatagtcctaataacatgaaaagctggggcaggagggaggatcgcatgagcacaagaggttgaggctgcagtgagccatgatcatgccactgcactccagctaggtgacaggagaccctctctcaaaaaaacaaaaccgaatttgttagtaagcaatgtaacatgaagtggagataagtcacaaaatgagatataaaagccctatacagaattatattactgctgctaatattgttccagaataacaaatttagatgtgactcacttattctttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttttagtagagatggggtttcaccgttttagccgggatggtctcgatctcctgacctcgtgatccgcccgcctnnnnnnnnnnnnnnnnnnnntgtatttttttagtataggtgggctatctccgttctagcaggcaggataaagatctcatgtctttgtgatccgccagctcaggcctcccaaagtgctgggattacaggcgtgagccaccgcgcccggccgtgactcacttattcttatgtaaaaccaccggaagttgactgtttttaatccacaagtcatgctaatttaaatacttgctgccgggtgcagtggctcacacctgtaaacccagcactttgggaggctgaggcaggcagatcacctgaggtcagggattttctatatactagtagtctttggtgtctccacaaaacaaaggattctttggtcctttgggagggtgctacacatgctatctgtcctcttttctagtcataatacatgtatgcacactaaagtctgaaaaacagaggtaaataagatagtttacctagcatttcccaaacttattaatacacaaggaaaggattatttaacacctgttaatagtttattatcttagtgtttcaggggatgtgttcaggaaacacaactttacaaaaagtccaagggactatctagagcttttcctactcagtatttatttgcagaaaggatagtataaagcgggcattcacccttagatacattgtaacaagattaggacttctggttatgaactatcacctaaggcataatttaccatactttttgttcacttttttttttcatatatcttattttagttttatactgtaggcagtaaagccacctggtttgtttctctttgcttggaaatataatgggttgttagctagatccctttttatcataggaatagagtactggtactaattacattttaaaaatttgtagtgatttgcagtgtgagacttgcttataactccataaatcaagagtttgtagacagttgaaacatagctatttttggttatattcctaaatgtactacatgagtttctatatgtattgcagttgcagaggagagaacacctaaatataaaatagtaccttatacagtgtacagaatgagatctaccaagagttactgcagtgaacatcaccattgttttatcatagctttttaatactatattgacttataaaaaaaatgactcatttaattggagtgtggagtagtttattcctttctcccactattcattgccatatctaaatgagtgtgccagtttttacctaccctctattatgaaattgagtgggcaaagcaggcatctgtgcactgtattacttagagtgttctcagttcaaccgaagatagcttgtttaaggtttattgtgctgtaaccaaactatttgcttatgcttattcctgttacttttttcagtgctagacgtaggtatgtctgcgtagtcataaagggtgtcatatatcttaaggacagactactcaggtttaactactcaatttagtgcctccttaaacatttactttgcacatctaggcaaattagacttagcaggtaattagaaattctttttctaaggattattgtatggtctcaaaaacaataaagctaaagaaaaggaaatagattcaaagtaagttttgcacttaaaaatcacttctggctaggcacagtggctcatgcgtgtaatcccagcactttgggaggccaaggcaggaggattgtttgaggccaggagttcaagaccagcctggtcaacagaacaagaacctgcccctacttaaaaaaaaaaaaaaaaacatttctataatgaattagttaaaagagaacaagcatttttatagtggctttcattcataacataggactaaaatgtatttcatcattttataagatatattgggagaataaggtaaaactaaatagcagattattttctgtttggctgactgattgattacctgttaccttcttaggcctctttgcacctccacgtgccttcagtgcaatctgacgagctgcttcacagtaaacactcccacccacttgactcaaatcagacttcagatgtcctcaggtacaactcttttaccattaacagtttgtcactgcaactttaaaagaatataatgttgattcttatatatttttctcatttttggcaagaatttacagttgtgtaccagtggatctctagataaacactgctattctaacttgagtaatctacttttgagaataatttttatggaaattgcttctttcccctcaaggactctctgttacactcttttttaaggtgactttgagtcttaaatgccataattgaaaactgcttccaaaatctaggttggaaataaataaatgacttatgcagtttatttgcttttcaggtttgttttggaacagtacaatgcactctcctggctaacctgtgaccctgcaacccaggacagacgctcatgtctcccaattcattttgtggtgctgaatcagttatataactttattatgaatatgctgtgatcttcatttgatggaactgtgcaagaaaagaacaaggaaaaatggatgtttcgctgcaggattaagttacaattatcttctcagtgaaggtcatttgtgatggggtctaattcttattacttcaacaaatattgttttgacttggggggaggggctataaccctgctatttttcattgactctattgaactctttaggatgatgactgatcatacaaaacgtattataacattttcgtagcaaaattaaccttttttttttccagtcacagtatttgtgaaaagtaatgagccatagtacccagtcatgttaaatgaatattaaaagcatggagaggaaacatgaggaacaatgaatttcaacatatggcttcagaacatgaagatgttcttgtatggattatagtatctagtattcaaaaatgcctgcatctcttctcttatttattgtaagtttttaaatgtataaattgtcttatatttcttaacctcttttataaaaattttcctagaaggtttatactgccttcttgctttaaagcaattggtctaaaatatatgtaatcgtcttaattaaaaagttgcagtagggttgcttttagagtattatttttttgtaagggggtgggtgggacagtaaatttgtattgtctcgatgtacagtttaacggggatagagggggaataatgtccataccattgtgtgtggaggatttacagctaagctgtagttgcagagtacatgtacagtaatgaagttcactgtgtttataaattgaaaaggtaccaggtcttacagcattttatatatcacatctttacagaataacatgatggcaatatacaagtggtattgttaggtggtttaacttagaataaaatgagaattcttcagttatattttgtactatggtttagggctatgactaatatttcaggccatttccggtgaaagaaacttagttttacaagaaaaaccatttgctactgaatgcttaaactaattttagtgtttaatgttacatgcttaaatttttttcagttttaacagtggcatatttaggcatggaaatattattatgaaatttattttcaggatctgctataaggttgaaatttagcccagctctaggcattttacaaattatttttcaagcagtcattcttgattgtttgacttttttttttaaattaaagattgggaatgtatgtgagagtatgcatatgtatgggtgtgtgtgtgtgcgcgcaatcaaactgtggtgtaaatagattctcagtgaattctggtattcagactctattccactagtgaaagaaccattttttaaacttcccttgccttttttatttatttaattttcttggtttggagatgtcagtcccaaacaccagagtctgtacttttctataacacagctcagattaaggtagggcatatgccaaggaggttctcacctccctaaagaagggacttgaattttagggactttaattcacccctccttcaatacaactttcccccttcttgtttgcacatgccaagataactgcttttatgcaggctgtacccccttgaaaaatcctttctacagtgctgctcacaaaagagcccaagttcgcctcctacctgcattgctgacttgaattcacagtcgccgagtctacctagctttcttggaagcagtctagcaaaatttctatttgtacgttcactaattatctacaaggacaaaatcagttgtatttacaaaactctacttcagtgtttgttttagtttttttttttactgaaacttgtttttgtgaatactctgtgcttagaattaaatatcactttcttatgaacaacataacttcttcagattgtgtatatgaaaacattagcaagtcttgttttttctatgaagcaaacacaattggtgacaaaggttgtcaatcatttcttcaaaattataatgcagttctaatggtcagcatattttgatattaaatttaaagatcacctctctgcatttgtttttaaattatgctaatacaccacacattatgttggtatgttttgttctgtactttctttaaaaaaaaaaaaaaaacttgtctgagatttgaaggaaaatgtgcttatttggaatttccataaaaagagtatcctttttatacacttaatagtgactttacaaaataaaagttatattctcagttgtttaaaatcactaacctatgataaccacacctcaatttgaaagtagatttaaaattattccctgacaggttatttaatatggagccataaggagggaacccagtacacaattattttttatttgggaatcagggaatagttcccaaatatacaggatttattgataagattttttttcttcccttcatatatccattcaaactcaatggaaagttattaaataaccattagaaaagctcagtagacttatttgagaaattaagccttgtgcaggatgatggatttgacttactaatgtactgtcacagacaaatatgggtagttttgtttaaataggtaagcaaaatattatactttatagcagtggattaccaacaccttgacttctttgttacagtgctaacatctttttttttgtgcaggtatccatgattattaagcagggtggaagttcagtattttgtcatttaaaaagattagttatataatgtctgcttccagccagtgagaaacatctagccatacctttcttatgcaagccattgagttatcaggactgtgaattaacactgtatgaataaat

SEQ ID NO: 15795 - DNA, 19153 bp, Human
aggccagaggacaggctctccgggccacactcaggggcgactgagccaactcttcacgccattcctttccttccctgcctaggacgaccttacagcccatgatcgcttttcttcttcttcttctttttgttttttcttcctgttttctttttaagtactacagtgaccccttatttattcagcaaagaaatggactactccacagtagtgaattttcaaaataatgcccttcaagcactaaaactttaaacaacacatcttcaaaacagctttgctgaggtataactgacacactataaacggcatggatttaaagtgtacaacttgatatgttttgatatatggacacacccatgaaaccatcaccacaatcaagataatgaacatgtccatcattcccaaaagtttcctcccgcccctccctgcccccttccccaagcaagcactgatctgttttccaaatacgtctttaatgctacaagggctcacacacctccccaccttagaaaatggagtatgatcaacatgattgatcctttccttgattcagcattatcaccaacacgatggaaagtgatctcagatgtcatgaggatgcatgattgtttgccctgatcactaaacggcccattgttgtgctggcatactgggcagtttcaagtttgggagttttctccctcactgctagctgtctcagagcttagttcccagcagacaactcttgctgcctcgaaccctggcacactaaccaccatcctgtgacgttcccactcctcattctgcgacagtggttctttgctgggagagatttttgtctcccaagggacatttggcaatacctggagatctttttggttgtcatcatgggagcgggaatgctactagcagctaatgtttagtgactagggatgcgactgaacatcctgcaatgtagagtgcagtgtcccctacagagaattatccgacccaagatgttgataatgccaaggttgagaaaccctgttcaggatgacaaactgattgaaaactcaacaaggggaccgggcgtggtggctcacgcctaataatcccagcacttagggaggccgaggtgggtgtatcacttaaggtcaggagtgcgagaccagcctggccaacatggcaaaaccccatctctactaaaaatacaaaaaaaaaaaaaaaaaatacgagtggcgtaagcctgtaatcccagctacttgggaggctgaagcatgagaatcgcctgaacccagaaggcagaggttgcagtgagctgtgatcaggccattgcattccagcctgggcaacagagcgagactcttgtctagaaaaaaaaaaaacaaacccataaaacaaacaaacaaaaaaaactatgaggattgagtgattcacatttctgaatcgagagagagaaggatgggcagcaggcttgttgaagctggaaggccagggaggtcgcagactgaggaagaccctggtgtgtcccaggtacctccatgcaaccctactagagaggtggtctctggcttcctatggacaagctctaagggacccagctatggggcaccagagcccagcgttcagcagctgctcaatgaatgtctgccaggcgagactgcacccaaagcatttattaggtacataattgtggcagcactggctggccatggaaggcaaggcagaacacaaggagctggagctggcggaaggaagtcattaagtcagccagtggctgggatgcagcaaagccaggcagaaggtaagtgcagacccaccccaataaatgaggaaaatgagaagggctggctggccatgttaggatccagttccagtgcgaccagatatgtcaccaccacatcacttttagctcctccccccacccacagacaccctgtttgcctgtcatataaagaaggttttcccaaagtggtttagccagaactggaagggccccgccctgtgaagggataggagcctgactgttgcagctgcagtgagtggcggggaagcagcagcggccaggatgaatcccaggtgctctggagctggatggtgaagtatggacatgctttattcgattttgcattgacttaaaggtttaattattttaggagttcttgtagacattcctgaaaaatgcaggtaggcaaaaagaagaaaacaaagatcgcaaatgtgaccctttcattcggagagaacaccaatggaattttgttgtgcacccttctatgcacgtctgaatgttgtgtagacattctgcttacaactaggtgtgggtgctgctgccgaaggctttatttgctgtgcctgaggtggaccagagatttcagagaagactcccagagcaccccaaggagacaacaggagtgcttggagtcaggatgactgggtggatttaggactatgtgattctcaggagcctctctggattagccccaaatcaaggataaagagaggcctagctggactcttcctcccagagccctgctgggaaaatggagcccctttacagcccccacttacccatcaggccctgctcctctcactcatctccagacttctgtcacatgcccaagtcctgctaactgctgtgtaaaactggtaaggtgggatccagaggaccttgggcccctagggccccaggtcaggagacctgggctccagggccagttgagagtgataaagagaacaatacctgcccacaggacttgttgcaatgagataaaggcagaagtcaccagttgtggtcaaatgggatttttttccagagaagtctcacagagagtggctttcaaattctttttagcagcagaattgttgtaaaatacaatctcatgtgaaaccctaaaatgtgagacactctgggtgaagcagagagaggtgctcaactgcccaatcctgtcctcattcctccctctcagggaggcacctctgagaacccactttaaagaattttgccttatgcagattgaagaggcaagctggctggaagaaactgggaagctccacttcccaccgcctctgcctgggtggcagtcatctgagcctaggctagcccctccccctccaaagacccactgcgggctcccctggggccagcctccaggatgggtggggcacctgaagcagcaagtattgctatttttctgggctgacctttcttctaggcctgaggacaagtgggtaggtggggccagccctgtccctgtttcccctcaatggagttctcttgctcacagcctaaggaagaagcgtgagtcacttcctgcctcagtctgactgctggagtattgttctcccaactgtggctggcgctacccagtgtggcccctacaagtcttagttccttggcggaggggaagtccccactttgggacaaggccaactggacttatcttcccgctcaactttgaggacccagcattgttcctccagtttccagttcttgcagtgtttgtaaaggtgcccgaatcgtacctgatcccattcactaaatattatctccattttatagaggggtaaattgaggaagtccctgagaaattaacttgtctaaggtgtcccagcaaaaaatagtgccccagggatttgaaccggtttgctgattgatttttcaccagttgccttaagaattatcatgatttaacctctctgggcctcagtttcctcctctataaaatgcagacagtgatacatcaaaggtacttaaaggaaaatgtactgtacccacctcatggggcatgtggtgaggataaaacgggttgacacaggaaaagagctctcaatggtgcctggctcatagaaaacactcagtggattttttttttcccattacccgggaacctgtgttaaggaggccacaggctgatcctgtgcagccaggttatctcacagggagcgagaagagatgggcacaggctactctgcgaccttggaataacccagcctgggaagctcctggccacattttccttcttttctttctcagctcaagcagcgtcggcctcagccaagtagcacaaacgttttctagggcccagggagggagaggctccggctggtatattgcaagtagcttggattcaggctctgccaaacaccccagtctcttgcaggatctgaggtctgctggttgtgggactttgcgcaaattatttaaacgttgtgcgcctcagtttccttatctgtaaaatgggattaataatctcagcctgaaaggattatgtggattaaatcatgtacataagaaggagataatgtaaagtgactggcctggtgcctggcaagcggttggtgtctaaaaagaaaaaaaagctaaaaatattaaaaggaggtgggctacttctgctcatatatccacctgtctatacaaatgcagacgaagtcgtgactcctctaacagtaggccaagaggaggctggtcctgccgccgtgcagtcctccctcgacctgggagtggaggaccccaggtccgccgtccctgggcacttaacccggtcaggctcaaattcgtcgcccaggagtggggaagcgggggacggagagggccagtcccccaagagtccggctgaggcagggctcggagtgcctcccccaagcctttccctttggttccgagttcgggtctccgcggccgtcttcccggggagctcgcggggcgaagagccgagcccgggggcgggggcacggcagcggggcctgagggacgcgccgggcggccgcgaggactttgggatcgcctgccccacttcctacctgcccctaccaggagccggaggcacgcgggcgccccagaaggccccgcagggcagccgcgcggggccggacgcgctggggcccacggcgctgggaacgcgggcccgcagtcgggcccgggcggcatgggcggcgggcggacgagccggagccggcggtggtggcggcggcggcggccggggaagcgcggaggtggcgccgcgagggggaggggcgcggcggcggaggaggaggtgcccgggccgctgccgccgccgccgccgccgccgctgacagcggcccgagtaaacaagccgcgccgccgcggcccggccgctgcccccgcccgcgccggagctggagcccaggccgagccctgccctggtcgccggccgggccgaggccgcgccgccgcgcctccccgcctccgcgccgtgacgctgccgccgggcgcggggaccgccgccgagcccaggcccccgccgccgggctctccgctcggccgaggggcgcccgagccgccgcggcggtcgcctggaaaagtttccccgccagggctccccagggtaagtagcgagggcgcggggcccggggcccggggaaggcaagcgcgtctgggagccgggcccgaggggagccggccgggccgggccgtggagctctgccccaggagcgggctccgcggcccgggtgctcgggccggggagggtcggggcactggcgccggtgcagccctgacccgggtcccccggggcccggctgcccgccggctttccggaactggccccggggccggccccgagggtggagctgccgggagcagacagggcgctccgcagcccacctgagcgcgccgggcccgtctcggccccccggccgtggctggtacttttccgcgtggggccagggcgagccctctgacctcaggaagcgcctgcggggcccctgctgggggcgggatggggagaaaattccgcaggcgccgggtgctccagcctccccgccgccaccggggctgccgccggctcgcccactccgcggccgaggagggcctgcgttccgcccggggaggggaggagcggccgggggcgaggcgggggctccttcgcttgggcctcgcccccgcccgcacacctgtgcggccaggactcgggtgcgggatccgcgggcgccggcggccggcgcaggtaggtccctgggctgccttctgccgcggcctggccgaggcccctgtgcccccgctgtgtggctggaccaaggggcggcctgcttgccagacaggtctgacggcagtcacttgtctggtcagaacccgctttcccatcatcctctaccccctggcccctggggtgcagaccctcatccaccggagagtgttgggattcctattctgacttgggaagtgcgaggagaacccgggtgatatggcctggtgagggcgggtgctgagcaggtgtggacacagcataggagattagccaagcctgacctcttctcaagcagggcagccctcgttttactatttcctatattgggcttctacggagcatttgatttttaaaaaggattctgtggctttttaaaaagtttgaaagccgctggtccagcagtttttaccaccaaggaaactgaggcccagggagaggaagtgacttgttaagatcatccagcaaatagtgggcagggactgggagcgataaattcacgggagcctcccagggctggtaacaggaccccgcgtggtgtctctgctagagggagagactgattgggtgtccgagtggccctcccgtggcctgctctgtggctgtgtcagagccagacccccagtgtctgggaaacagcagtcggtcctggggtgaggcgcaatttgagtggcccagagtggctctctgtgtcaggaggttctggtgctggagaaaagggctttgcccaagaacacagccaggaagagcacccacagctctctctggccacagcctggaacagagtcccatgtgaaacaagaccatgagaaatacagcaagcctccaggtttgagacaaactgggactagagggtgagtcagagtctgggatgggggtggggagaaacccattcattcattgttttcagttcttactcttttcggggatcctcccttgtcccacatgctgtggcagagccgtctgtgggggtctcattttctggaagccatccccacccctcaccatggctggggttgttggatagagggaggctggccctctttctttggggggactgttcagttgcgcctgacgcctgctttctttccgagtgctgcaaggtaattaaatagttggttaatcacttttaacgccaaacagctgcggctccatctacagtgtgctggaatctgggctagacccagatgaacccagcctcgatttgggggctccagcaggactcacagcacggtggttggtggtggtgggggcaggggggtggttgcatgacatctggacccaagaggcagctgttgtggcagcaagagagaggagagagatgaggccccgttcctatatggctctgctcccagggtcccacatcctctgttaaatgagggacttggggtggggggggcggtccttccatcccctagggctggggcgcctagctgcccagccattgatcaggccagctttctggaaccaaccacccaaagcaccatggggctgtggttccgaggcctgccctggaagtcctgtggagtctgcccgcagggatgtgcaggagctgtattgtagatgtctcctgccatcagctgtcaggttattttggtccaaactgaaaatactccaggaattgtgtgtggagtacccccagcctgcagggtgggactgcagcagtcagggaggccggttgtgtctaagggcagcttctggagaagcaaggagttttctgtggtgagcctgcctctctagctccccagggcctacgtgagctggggtgccttccttttggtatccggcagagtggccttggctatggaagtgctaagggcatccagggccctgctgctgctcagggagcttggcactgatatgggatacccccagcagcactgctgggacctcccctagcttcccccccttcctccagggccttggcttctggctagtcaggggcactatgtggggacagttatgtggccccgggcagagagaggtcccgccgtctgtttgctgaaggaggaaaaacaacactcggactattgattcagtctcaccttggcgctcctggctcagcagccagtgtttgccctggctgcctgggctcggattacgcaaggctggtgggcgtggagcaagcaagggggcagctgggggcctccaggcccaggcagggcagggcttggcggccccagcgttccccaggaaactgtaaaaacgagtctggggccctgactttgctgatagcggccatctcagccatagagggaggtgaagcctctgtgatctccacccccgcaccccctcaggacatggcccctaaaagcaccatcccatttagggtcacccattttcttcctaggagctgtggggctttgcgaataactccctatggctgaatctgctttgctgaactaggaaaccctagtgagttgtatagatgccattcatttaagaaccttgaaaagccaacatcttattcccatgtaaaacatacctaggtgatttggagaatacagtgacacaaagaagaaaataacaattacttgtaattctcaccatcttgagagaaccaccgttaacattttttagcgtgtgtatccttccagatttcgctttagtttgtataaatatacatgtataaatagtttttaaaaaataaaatgggattatgtgtacatactgctttataatgcatcttctttaccttgatcatggtgaacatttattcatttgttgtttctgattttgagtgactcagggcttgatagtcttcatcctgcttcttctgttacacttttttttttttttttttttttgagagggagtatcgttctgtcgcacagactgggaatgcagtggcgcgatcttggctcactgcaacctccacctcctgggctcaagcaattcttgtgcctcagcctcccaagtcgctggcactacaagcacccgccaccacacttggctcatgtttgtatttttagtagagacgaggttgcaccatgttggccaggctggcctcgaactcctgacctcaggtgatccacccgcctcagcctcccaaagtgctggatgacagaagtgagccaccatgcctggcccttctgttacatttcttatattcttgcatggagaaaggattgggggggattgtgagggcatccatctgtccatctatgtggctggccttgggggctagatttcttctggggaggactaatttttttacccttctcccccagatctcatttcaggccccaattgaaacttggggtgggcagggcagctttagtgcgtagcaggggaggaactgaccctctctccccttttcccctcttgttcctctcagggtcggcactcttcaccctcccgagccctgcccgtctcggccccatgcccccaccagtcagccccgggccacaggcagtgagcaggcacctgggagccgaggccctgtgaccaggccaaggagacgggcgctccagggtcccagccacctgtcccccccatggagctgaggccctggttgctatgggtggtagcagcaacaggaaccttggtcctgctagcagctgatgctcagggccagaaggtcttcaccaacacgtgggctgtgcgcatccctggaggcccagcggtggccaacagtgtggcacggaagcatgggttcctcaacctgggccaggtaggtgttcccccacaggacactgccagggggtgggaccagagaagacagggattctgggagcaggagctgttggccttgtttgctcaggggcatctgggtagccggcatgttctgggtggccatgagcaaagcacaggtggttcaggcaagcagcatatcccagtgagagtgagtcctcatggtccccgcattttgctgggtcccggacagggagcagatgccccgcacccccgaccgtggcgagcctcccatgaagccgttgtccacccccgtcccccgcctcccggggactgacagatggaaagcccagctcagtctccctgctctattgcagatcttcggggactattaccacttctggcatcgaggagtgacgaagcggtccctgtcgcctcaccgcccgcggcacagccggctgcagagggagcctcaagtgagtgtggccccagccccctcctgctgccaccctccccctcctgctctcaggagcccctctcgcctcctgctccacccacaccatctctccctcactcccccacaggtacagtggctggaacagcaggtggcaaagcgacggactaaacgggacgtgtaccaggagcccacagaccccaagtttcctcagcagtggtacctggtacgtggccttcttcgctgctgggacctcctccccagatgcaccatccacccactatgagctcttggatggaggaggctgtcttcgaggcctcctctgattcgtttcctttcctcctgctgggcagtctctccttggcccatcctaataagcaagcctgggggtggccctcccagagtcctctacattcccatggagtccagacagccagtggcggcctttcaggagcagggatggtacaggaggaggttttacgggggcaaagggattcttcaagatgctcctagcctcacaaaaccaatcatgtctcataagtgatggggtgggtgtctccacagtctggtgtcactcagcgggacctgaatgtgaaggcggcctgggcgcagggctacacagggcacggcattgtggtctccattctggacgatggcatcgagaagaaccacccggacttggcaggcaattatgtgaggaagtcggggagggaggccgtgatccctgctgaggtgtgtctagaggctgtcttgttctatcagtgaggtcagccttctcctgatggtggccaaatccttcttaggatcctggggccagttttgatgtcaatgaccaggaccctgacccccagcctcggtacacacagatgaatgacaacaggtaagaagtggcaggccccggtctctgcctcccttctcctttcttccactaaggaacagggctgagcctgggtgagatgtgccttgcctaaaaggctgaggcttttcccatagtcctggcccacctggggctctgagggagggctcggtcagagtggagatggccacaggcccagtggagtgtgggagatgggggctgggtactcaggggatgatgggtgtcggatgtgcggatccctcgtgctcctcaggccacatctgccgggccctgttcaccccatttgttctactcatgctacgtgcttggccctggcaggcacggcacacggtgtgcgggggaagtggctgcggtggccaacaacggtgtctgtggtgtaggtgtggcctacaacgcccgcattggaggtgagtgtgggcctgggccaccctgtcttcaggagggcccttcagtggaatttttcccgcccacttcccatctggccaatgcctgccactttcccactgtggatcctttgatcacgtggctgttccatggagggttcccaaagggtcaaagactgaaagagctggacccctgtggagtgagggtttcctagcaggagtctcctgaaatcctcacgacccactgtgagtcctcacgtggcagatccttgatcaccaggctcttttgggaaccagagactctttctagtcctgaatgtgtggttgggggcaggaggtgttctctttttccttctctgggtcttgtctttgaaaggcagaggcaaacaggtagttgggggttcagggtttctcagcatcagcctccacccttcccttactcatcccctggggtgcagggctgggtgtgctccttggggtgggggccctgacagctggacccatgcagcatccctcttcgtgcccccccttcacggccaggggtgcgcatgctggatggcgaggtgacagatgcagtggaggcacgctcgctgggcctgaaccccaaccacatccacatctacagtgccagctggggccccgaggatgacggcaagacagtggatgggccagcccgcctcgccgaggaggccttcttccgtggggttagccaggtgaggtggggatctgtccagcccctgcgggcaggttgggtgctgtcttccgtacctatcttgtgttttttggtttgttttatttattctcatgtttaactttacacaaagcatgtttattgaaacattaagggacagaagaagagtagagtgcatataccacttggacttgcctaattaaaaaacacattttttttagaaatgaggtcttgctgtgttacccaggctggtctcaaactcctggcctcaagcgatcctcccgccttggcctcttggtctgattttttgtgtgcctagatagacatatttggatacatacttgatccaccagggatctcacaggggacaggaggttcccagagaatgaggctccagccttcccagttttccagcagtgtcctcctgccagccctccctcaagtcccaatcttgaatgaccccagcccactctgtccacagggccgaggggggctgggctccatctttgtctgggcctcggggaacgggggccgggaacatgacagctgcaactgcgacggctacaccaacagtatctacacgctgtccatcagcagcgccacgcagtttggcaacgtgccgtggtacagcgaggcctgctcgtccacactggccacgacctacagcagtggcaaccagaatgagaagcagatcgtgagtcttacctgggggtgggggctggggagatggggctgctggctggctctgtccagcaccctcttttggaggctgtctgcctccacccccatgtggctgggtgatagtggctcaggcatcatgcaacatgaactctggggctctgtaggttcttggaggccatggagccatctctgaagactttgaaaagcctagactctctctaaaaacatactttgttcttattcatctccaccctctagttgaacccccttattcctttggaaaatgaggcccaggaggggctcgtcattagcatgtccacggcaagttagcaaggcagcagctgggacctggggttcttggccctggctccccataccatctgtggtgcccagggcctgtatgcagagggagggtaggcaggtggctcctctagccccctccacccatcacaggccccaatatgattctcttcctggcaggtgacgactgacttgcggcagaagtgcacggagtctcacacgggcacctcagcctctgcccccttagcagccggcatcattgctctcaccctggaggccaagtaagtgggtgggggccagcggcaaccctgtccctaccagcactctctgtagggcagcccttagggcagctggagagctgctcccaaaaaagactgatccccagcctctcccttccttctttgcagtaagaacctcacatggcgggacatgcaacacctggtggtacagacctcgaagccagcccacctcaatgccaacgactgggccaccaatggtgtgggccggaaaggtgagggcaggctggcccggcaggctggatgtggagttaggtagaaggcactctgtgcctgacagctgaccctaccttccctgtccccacagtgagccactcatatggctacgggcttttggacgcaggcgccatggtggccctggcccagaattggaccacagtggccccccagcggaagtgcatcatcgacatcctcaccgagcccaagtgagggctggacccaggctgggagggggccagtgggacctgagagtcgcagggggtgcccgctggtccctctgggccaggctgaccatcatggtgctctcctgcacagagacatcgggaaacggctcgaggtgcggaagaccgtgaccgcgtgcctgggcgagcccaaccacatcactcggctggagcacgctcaggcgcggctcaccctgtcctataatcgccgtggcgacctggccatccacctggtcagccccatgggcacccgctccaccctgctggcagccaggtgcttgctctgtccctgcccgccctgcccagcgccgccgcctctcacagcccgcgtgcttgcctttgctcgctcacacggcccagggggcactgagtgctactcagtggggcactcttggcattttgggagggacaattttgtcctgtgggactgtcccatgttgcaggaatccctggcttgcaaccatttaatgtcagtagtgtgccccaccttgtgcggtgcctgtgtacctttctagaatcccccagttgagcacgtctggctcactgagaaacagccaagccagcaggcacttctggccccatggggttggtctgcgtgggggaagggtgtgtggcccatgtgctgtgggttagatgtccctggcttggggtcccgcagaggcctcagggctgtgtgcactcccctccccaggccacatgactactccgcagatgggtttaatgactgggccttcatgacaactcattcctgggatgaggatccctctggcgagtgggtcctagagattgaaaacaccagcgaagccaacaactatggtactgggggcacttgaggggtaggggtacgaggtggagggctggcaggatctcgagcactgggtgtggtgccagcactgtcttaactcttgcctcctccccgctctggaacagggacgctgaccaagttcaccctcgtactctatggcaccgcccctgaggggctgcccgtacctccagaaagcagtggctgcaagaccctcacgtccagtcaggcctgtgtgggtcagtagtgggtgctgttgggctttgggggcctgagtctgggggtaaggcgggtgcctgtcctgaagcccagctctaacagaaaaaagtctcaagagacctagggcccctggggctcttgggatgaccacagtcctggggctggaggatcctggggatgtggtgacttggcttggggctgctgtggtcctggggctacagtctgtttagctgacacacacttgccctctctcccacgccggcagtgtgcgaggaaggcttctccctgcaccagaagagctgtgtccagcactgccctccaggcttcgccccccaagtcctcgatacgcactatagcaccgagaatgacgtggagaccatccgggccagcgtctgcgccccctgccacgcctcatgtgccacatgccaggggccggccctgacagactgcctcagctgccccagccacgcctccttggaccctgtggagcagacttgctcccggcaaagccagagcagccgagagtccccgccacagcagcagccacctcggctgcccccggaggtggaggcggggcaacggctgcgggcagggctgctgccctcacacctgcctgaggtggtggccggcctcagctgcgccttcatcgtgctggtcttcgtcactgtcttcctggtcctgcagctgcgctctggctttagttttcggggggtgaaggtgtacaccatggaccgtggcctcatctcctacaaggggctgccccctgaagcctggcaggaggagtgcccgtctgactcagaagaggacgagggccggggcgagaggaccgcctttatcaaagaccagagcgccctctgatgagcccactgcccaccccctcaagccaatcccctccttgggcactttttaattcaccaaagtatttttttatcttgggactgggtttggaccccagctgggaggcaagaggggtggagactgcttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggccagcccggctggttttgtaagatactgggttggtgcacagtgatttttttcttgtaatttaaacaggcccagcattgctggttctatttaatggacatgagataatgttagaggttttaaagtgattaaacgtgcagactatgcaaaccaggcccagtctccagtgtggtaccgttgctcctgcatcgcagctgaggatagggggccagttaggcctacacagtggcctgcctgcctggatgtgggcccaagtcagaaggccaaagtcctccaaggggcgggaggatgcgccagcccctagtggaggagctggtgcccctggggtggggctggtgacccctggtcctcaggagctgagcactaaactcccaaagtcctggtttccagcagtgtgaagaactgggcctattgtgtcttcctgggctgaagtgatctggtcgccacaggctatagggctgaggcctaaggtggagggaggcctgactgaatcaagatgacttcttgtggggagcctgagtcccaaatggaaaactccacgcctgtccgctccccaacccctgccccttgatttccccaggtctcccttgggacaggaagcccctgcctgggggtaggaggatggggacaaaaccactaggatctgtatccgagaagcagtctctgttcgggatatttacttggaaattttattcaaatggaagctggcgcctgagcctctccttagggaattccgtgaggtggggagggctgggaccagggttccctctttctcttctgcggtggccctggcctggtgctaggactgcgcgcctcccctcagtacccgcggacaccctgggcttccctgggcccagcatctgcctggggcctcgccctgggctccccctcctgacccccaccttgcgccccttcccggtgttcccggggcgctgccgggccctggggcctgcggggcgcgggcggctcttggctgggccattctttcccggccccctcctcccttccgtttccgtggccgtgcggccggctagaggctgcggcccagcgcggagcaggggggctggcaggcgtcgggacggtcgggccggtcccgcccgccccttcccctccacaggcccgccccggggcctgggccaactgaaaccgcgggaggaggaagcgcggaatcaggaactggccggggtccgcaccgggcctgagtcggtccgaggccgtcccaggagcagctgcccgtgcgggtacctctagccccggggcctggaggagcggtgggagctgggggcgcggcaggcaggggcagagcaggcgttccgagggccagagacccacccaggtcggggtaggggccgcggaagggcggggatggccgcaggggcagggctcaggctgtgggcgcctgaggcttcagctggggcaggcttggcctgtcgaggacctgggcaagggtgtccctgtaaggggtggtgggtggaagggcctggggagggaggctccaggttggctcctgttcccgaacgtgcggaggagaccctgacgctaaggaagcaatgagggccagtccccaggccaggctgctgctgggtacccatggctgcgtgtgagcgaggcaggaccccacctcctccccgtctgcagtccatcctgaccctacagtccccagcctcctcgtcccatgcctccgtctccagctgctgccttgcctccagggatggccccttttctgtccccagaacagcactatgggcttctcttctgagctgtgcagcccccagggccacggggtcctgcagcaaatgcaggaggccgagcttcgtctactggagggcatgagaaagtggatggcccagcgggtcaagagtgacagggagtatgcaggactgcttcaccacatgtccctgcaggacagtgggggccagagccgggccatcagccctgacagccccatcagtcaggtgggtctctatgggactctggtgggtgctggcgtatctgccttctccttcctctcctgggggccctctggggcagtggctggagatctggcaggccaatgcttgggagccattgtgcccccctccctgcctcccccatctgtgctgtatagtcctgggctgagatcaccagccaaactgagggcctgagccgcttgctg

SEQ ID NO: 15796 - DNA, 41106 bp, Human
tgtttataattattttattaatgaaggtactatcctagtaacaactctggcagcagaactaaattattgagattacaacctgtattattttattctgaaagtacaattcatacataccttttggctttctattttaagtgtggtggcttagaagtctgactcatttcccagattgtttaagctaaatatatgttatttagggcactgtggatcagaataaacacttgtgtctcctggttttgccctcagctgtgttacttaacctctctctctgccttattttactctgttaaaagcagatagtagtagtaactcatgataaggttgtgaggattaaaagcttagattggtgcctgctgtatactaagtgctcaataaatggtaggtttgatgattactatttgtgagcagctatgaagtgggaaagtaaatcaaatgatttatgtttttactggcttttgggcttgaccttctttttgtgtaggatgctctttttgcataaaaagtagtatttttctgtattgtctgtaacttgagttatgaccagcagcacaatttattacccgtgtatttggatatatcagatgatggaggtaatagtgcagtggttaagagcatgggctttggagttaaatagacacaggtttggatcctgtctccacaacttactattgggtgtgaacttgtgcaaggtaatttcctcatttgtaaaaaggggactccagctgacctcatacacagtttaaaaatcaaatgaaataagcatgtgaaatgtttgatgcaatgcctcacgtataaatacatacatatttttcagacagggcctcgctctgtcgcccaaggaatgcagtgtcacgatcagggctcactgcagcctcaacttcctaggctcaagtgatcctcccacttcaacctcccaagtagctgggactacaagcatgcgccactatgcctggctaatttttattttttatttttttttttgagacggagtcttgctccgtagccaggctggagtgcagtggcgccatctcggctcaccgcaacttccgcctcccgaggtcaagggattcccttgcctcagcctcccgagtggctgggactacagatgcgcgcccggctaattttgtgtttttagtagagacggggtttcaccatgttggccaggatgctctcggtctcctgacctcgtcatccgttggcctcagcctcccaaagtgctaggattacaggtgtgggccaccgcgcccggccttttaaaaaatttttcgtagagacagggtctagttatgttgaccaggctggtctccaactcctgggttcaggtgatcttcccaccttggcctcccaaagtgttgcaattataggcgtgagccaccgcacctggcatgtatatatgtatatgtatatatatatattcaccctcctcccccaggcctataaatattaacttttttttttccaaaggcaaatcgaggaccagatgctgatccaatcgtacctgaactactgatgttatttcttccacaccaaattcaaggtctcccccggacaagtgtaaccatgggcacaatgtcagactctttgagggctgtgtatcactcagcaactaaaataaacaactatagcaagatatgtaacctctaccaaacacgttaccgtctcccctttttaactatgtcaattgtggtgttaggactttgcctatggaaaccaaaatgtcgacctccgggagccgggggcgggggggggcggggggggcgggggggggtctaactcgatcatgtgacgcaccccatcccaccttttctcgcagttgcatcagccaagttagagccgccttcccaggaatccactaatgaacggattcgtcctcagtttgactggcatgttggttgaccaataatatctcatgaggtaaggcgcggcggggcactttccgtcggcgcgctctgattggacggagcgtggcgggttgtggtaggtcgtggtctgaggccggtacagctgcgcgtctgcgggaataggtgcagcgggcccttggcgggggactctgagggaggagctggggacggcgaccctaggagaggtaggccgccctcggagagctctgcggtgctaggagagcggctgggcccgcagactggggggaaagctccgcagccgcagtgggccccaggatcaggccccgcgtggcctggagaagcccagtctgggctggagcgggagctggacagtgtggccttgcgttcgcccccgggagcgctgcgagtgtcgcggcctcgggtggatttgctgagcaccaatacctcacggttgccaacctggggttttagctcccttggttttaatcccctaggggcgggtgggggcacgggaggaaggatgggccagctgggtgcaatcctgctgtaagccagccattccttgatttcttaaaattaactaaacagctgatgccggtccaggcgcaccgagaccgtcatcttaagctgttctgtaaaacagtttgtatttctcggtgtgctttgaagcatgtgagttaattccgaacttggtgttaaaggattagtatacctgatcacgaaatacgtatttagcagccactgtactagatgctgaggatgtgctgtaatagcccagggccaggcgcggaggctcacgcctgtaatcccagcgctttgggaggtcgaggcgggcggatcacctgaggtcaggggttcgagactagcctggccaacatggtgaaaccccgtctttactaaaaatacaaaaattagccgagcgtggcggcgcgcgcctgtactctcagccactccggaggctgaggcatgagaatcgcttgaacccggcaggcggaggttgcagtgagctgagatcacaccattgcactccagcctgggtgacagagggagactccgtttcaaaaaaaaaaaaaaaaaaagagcccagaacagtcgttgctgctgggatggaactgacagcctgatgggggaggcgcacattaaacaatccatgaagcgcgtatggaaattatgaagggaaacacttgaggctgtgagacagtaaaagagggggagccttatcaagaaggggaaggcggccgggcgcggtggctcacgcctgtaatcccagcacttggggaggccgaggtgggcagatcacgaggtcaggagattgagaccatcctggctaacacggtgaaaccccatctctaccaaatatacaaaaatagccgggcgtggtgactggcgcccgtagtcccagtagtcccagctactcgggaggctgaggcaggagaatggcgtgaacccgggaggcggagcttgcagtgagctgagatcgcgccactgcactccagcctgcgcaacagagcgagactccgtctcaaaaaaaaaaaaaaaaaaaaaagaagaaggggaaggctgtcttaaataagtgtcttggccgggcgcggtagctcacccctgtaatcccagcactttgggaggccgaggcgggcagatcgcctgaggtcaggaggtcgagaccagcctgaccaacatggagaaaccccgtctctactaaaaatacaaaattagctaggtgtggtggcacatgcctgtattcccagctactcaggaggctgaggcaggagaatcgcttgaagccgggaggtggagattgcggtgagccgaggttgcgcaccattgcactccagcctgggctacaagagcgaaacaccgtctcaaaaaaaagaaaaagtgtctttacgtttgttgttgtttgagtcagggtctcaccctgttacctaggctggaatgttttggtgtgaccatagctcactgcagcctcaaacttatgtgctcaagcgaccctttggactcagcctcccgagtagctgggtctgcaggtgcacaccaccacacctggccaattaaaaaaaaaattgacctcccaggctcaggtgttcccatgttgcccaggctggtcttgaattcctggcctcaagcaatcctcctgtttcagcctcccaaagtgacagagcgagacctgtgtgtaaagcctgggtgacagagcgagacctgcctcaaaaaaaaagttgaaacaggtctcgctttgtcacccaggctggagtgcaatggcatgatctcggctcgctgcagccaccgcctcccaggttcaagcaattctcctgactcagcctcccaagtagctgggattacaggcgcccgctaccatgcccagctaatttttttttttttttttttttttttgagacggagtctcgctctgtcgcccaggctggagtgcagtggcgcgatctcggctcactgcaagctccgcctcccgggttcacgccattctcctgcctcagcctcccgagtagctagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctaatttttgtatttttagtagagatggggtttcaccatgttggccaggctgttctcgaactcctgacctcaggtgatccacccgcctcggccccccaaagtgctgggattacaggcgtgagccactgtacccggctgaaaattttctgttgcccaggctggagtgcagttgatcttggctcattgcaacctctgcctcccaggttcaagcgattctcctgcctcagcctcccaagtagctgggattataggtgcgtgccaccacaccccgctaattttttgttgtgttgtatttttagtagagacagggtttcaccgtgttagccaggatggtcttgatctcctgaccttgtgatccacccgcctcgacctcccaaagtactgggattataggcgtgagccaccctacccggcctcaaaaattttttttaaatacaaaaaaattagtcgggtttggtggcacatgcctgtagtcctagctactccggaggctgaggtgggaggaacacctgagcctggaaggccaagtgattgcaccattgcctgcgctccagcctgggtgacagagagggagaccctgtctcaaaaaaaaaaaaaaaaaaaaaaaattcctgtggagtggctggagccacagcgtgatttaaggcacccaagacctttacagctcctgttagtaagtgaaacctgaggttctgcctttgtgctacctctgtatcccatatagccctccagtgaataaatcaatgagtttatgttgaataaatatattgaatttatatcgaataaatataaatttagattgaataaataaatgggggtaaacaaatgaatgtggggatacagcttttaatagtttcagccttcatagactcatagttaatatattcagtccttttacacaatactgcagttaattctgcatatgatagtctcctcaggaaggacataggctgtcattcattttgattcttggcacatagtatgcattcattatggtgaattagtaagcaaaaatgggaaattcatgtgtcttttggaaagtagctggagtcaggatctcctgttcactttgtacatctctattgtattttcctcataaggagaaaactttggctgggcatggtggctcatgccatcccaacaccttgggagattgaggccaggagttcgagaccagcgtgggcagcatggcaatactccatttataacaaaaacagaaattagctgggcgcggtggctcatgcctgtaatcctagcactttgggaggctgaggctggcagatcacctgaggtcaggagttcgagaccaggctgaggaacatggtgaaaccctgtctctattaaaaatacaaacattagctgggtgtggtggcacttacctgtaatccaggttacccaggaggctgaggcaggagaattgcaggaacttgggaggtggaagctgcagtgagctgagattgcgccacagcgctccagcctgggcgacagagtgagactctgtctcaaaaaagaaaaaaaaagaaattaactgggcatgctggtgtgcaactgtagtcccagttacttgggaggctgaggcaggaggattacttgagcctcggagtttaaggctgcttaagtgattgtcccactgcactccagtctggacagaaccagaaaaaaagaagaaaactttcagctaaacaacttaaaagtaatattatccattctgttccttcaaggttttcctttttttttttttttagacggagtctccctcagccacccaggctggagtgcagtggcgcaatttcggcttactgcaaccactatttcccaggttcaagcgattctcccatctcagccttctgagtagctgggattacaggcactcgccatcattcccggctaatttttgtattttagtagagatggggtttcaccatattggccaggctggtcttcaactcctgacctcaggtgatccacccaccttggcctcccaaagtgctgggattacaggtgtgagccaccgcacgtggcgtaacgttttccattttatagattgcttccaaatacagtatagcttttgatcctcacaacacctcagttgagtaggcagggtagatactgcttttttacagaaaaggaactgaactcaggcaaaagtgaattaaggttacggttgggtctggaattccagagactttttgataataatgataatattgtgaataagatggttctcatttttctagacacagcagtttgtggcactacagcaccatgccagtgatcagcactctcaccaaagcctgtcacttctccccagcctacctctcagggaaatcgtaatatctgtgaaagagctgtttttgtttttgtttgtttgttgacacaaggtctctgtcgcccaggctggagtgcagtggcatgatcttggctcactgcaagctccgcctcctgggttcacgccattctcctgcctcagctttccgagtaactgggactacaggcgcctgccaccatgcccggattattttttgtatttttagtagagacggggtttcaccatgttagccaagatagtcttgatctcctgacctcgtgatccgcctgcctcggcctctcaaagtgctgggattacaggcgtgagccaccgcgcccggccatttttgttttttttgagacggagtcttgctctgtcacccaggctggagtgcagtggcgcgatctcggctgactgcaacctccacctcctgggttcgtgccattctcctgcctcagccttgtgagtagctgggactacaggcgcctgccaccacgcccggctaattttttgtattttttttctagtagagacagagtttcaccatgttagccaggatgttctggatctcctgacctcgtgatccacccacctggctaatttttttactatttgtactgacaagatcttgctatgttgcccagggtggtctcaaactccagggctcaagcaattctgccacctcggtctcccaaagtgctgggattacaggcgtgagccaccgcgcccaacttgtgaaagagctttgaagtcataaagttttttctctctccaccagttcccttgtactttcactttcagtaagctgtgcctccaaagtggggctacagcatccccactccctggtaatctaatggctggaaggcagccgtttgctgttagggttcttgggggatgtaggctacatagaggtaggtacattcctgctacatacaggtggtcccttgtacagataggcccatccccaggactattgctgctgacagccgcctcaccatgacatcaggccaaacctagagaccctgactttggggctagtggaactttgcagttctaggcgtgtacattaacacagagctgaagggatctttagagataatctcatatggacccctcctttttttggtgaagtgactccctcaggacttgaagctagaactcaaaccccggtctcctgagcctctctccctcttccccagttggactaaactgagggtttttctccccctttttttctttttttttttccttctttttttgtttttttgagacggagtctctctctgtcgccaggctggagtgcagtggtgtggtcttggctcactgcaacctccacctcctgggttcaagcgattctcctgcctcagtctcgcaagtagctgggattacaggcacgcaccaccatgcccagttactttttgtatttttagtagagatgggatttcaccatgttggccaggctggtcttgaactcctgaccttgtgatctgcccaccttgccctcccaaagtgttgggattacaggcgtgagccatcgtgcctggctgtccctctttttttctaattcctagtctcgggcctgacacagagcagatgctcgatacatatttgtttaatgaacaaacatccagcagcagtgtgcttggtgtgctggggtgttgaacctcttgaggttggcatgggaaggaagaacagatggggctgctgtctgctggtgatgatgattttagccttggacattacaacatagaggttttaggatcaaacagctcacctgagtcgtgctttgacttggcttgagaagccagaagtcttgtgtaatgtgtactttgactttcaattcccttaattttccttcatttttttttctttgattagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccaggtaagggtttttccttttttcttggcttttggttcacataagaggcagcagagcccagataaaagcacagccctggggtcagaccgattctggttctgtcactccctgtgtgatcttgtgaaactttatgtgatgggcctcagtttctttgcaaaatgaggaataatattgcgggcctgtaggtattagtgagaagcgaataagataacacatacaaaatgtttagcacggtatttcgcacatagtacgtaggtactcaaacattagctttttttttttttttttttttcctgagacggagtctcgctctgtcatccaggctggagtgcagtggtgcaatctcggctcactgcaagttctgccttctggattcacgccattctcctgccccagcctcccgagtagctgggactacaggtgcccgccaccatgcctggcaaatttttttgtattatcattatttttttttgagacggagtcttgctctgtcgcccaggctggagtgcagtggcgtgatctgtgctcactgcaagctccgccccccaggttcatgccattctcctgcctcagcctcccaagtagctgggactacaggtgcccaccaccaagtacagctaatttttttgtatttttagtagagatggggtttcaccgtgttagccaggatggtctcaatctcctgaccttgtgatccatccgcctcggcctctcaaagcgctgggattacaggcatgagccaccacgcccggccagctattattattttttagagagagggtctcactctgtcacccttgctggagtgcagtggcatgatcctagcatgctgtagcctcagactcctgggcttaagtgatcctcttatgtcagccttccaagtagctaggactacaggcatgctctaccatgtcagcttttaaaattattttatttattttttaatttatttattgttttgagacagagtctcgctgtcgtccagactggagtgcagtggcacgatcttggctcactgcaatctctgcctcccgagttcaagcgattctcctgccttggcctccgaagtagctggaactacaagcgtgcgccaccacacctggctaattgttgtatttttagtagagacggggtttcaccatgttggccaggttgttctcgaactcctgacctcaggtgatccacccacctcagcctcccaaagtgctgggattatagacgtgagccaccttgcctggcctaaatttatttatttatatgcagagatgggggtctcaccaagttgttcaggctggtctcgagctcatggcctcaagtaatcctcctgccttagctgcccaaagtggtgtgattacaggtgtgagctaccacgcccagcccacctaatgcctttcttgaaattattgccaccagtgccattttggatccattgctgaagaaaatttattagttagtacggtttatttggggaagttgaattaaaaatatatttgaggctgggcgcagtggctcacacttgtaatcccaacactctgggaggccgaggcagataggtcacttgaatccagaagttcgagaccagcctaggcaacatggtgaaaccctgtctcttattaaaaatacaaaaaattagccaggtgtggtggtgcatgcctgtagtcccagcttctggggaggctgaggcgggacgattgcttgagcctgggaggtcaaggctatggtgatccctgatcataccactgcacttcagcctgcacaacagagtgagaccctgtctcaaaaaaggaaagaaaagaaaaagacatttgaaaggtttatcgtgagagaaaagggttaactcttaaaatgatgaaagcatgacaagtttataaaggagtttaagaggagtttgtcagcatgtctgtgacactaaacagtacttcccaggctggtcgtggctgaagggggttcaggttagatggtgctctcagcgctttcctgtgatggttctcttggagccctgctcccccggggcatctgcagcccttaggatgcttctcactctgggatgagttgacattttcttttctcttaggtgtcttttctggcatggaaagttagaaacaatggggacatattctgcctcttataatattaactataaaattatgaaacatggggcacagtgcgcctgtaattacatctactcaggaggctgagacgggaggatcacttgatcctggaattacaaaccagcttgggcaacacagtgagactggtctcccaaaaaaattatgctacttgggaggctgaggcaggagaatcgctggaacctgggaggcagaggttgcagtgagccgagatcacgccactgcactccagcctgggcaacagagtgagactccgtctcaaaaaagagaaaattatgggccaggcacagtggttcatgcctgtaattccagcattttgggaggccaaagtaagaggattgcttgagcccaagagttggagaggagcctgggcaacataggaagaccctgtctgaaaggaaaagagaaaaattaaagaaaaattaaagcaaaagaaaaattgaaaaattagctggtggtggctcacacctgtagttccagcctcttgggaggctgaggtgggagtattgcttgagcccaggagttgaggtgagccgtgatcgtgccactggactccaggcagggtgacagagcaagaccctgtctcaaaatggaaaaaaaagaaaaatattttcagttatgtgtgagtcctatgcatatacctagaattggaggcattaattttaggtggtctcattcaacgggataggcttttggaacactggaaagctactgtttctattcagacatacctgggtgcaagctttgtcaccttccacatgagccgcctgaacaagaaccagggagtacagtgtttgtaaacttttctttttttttttttttttttgtttttttttgagacagagttttgctcttgttgcccaggctggagtgcaatggtgaaatctcggctcactgcagcctacgcctcctggattcaagcgattctcctgcttcaccctcccgagtggctaggattataggtgtctgccaccacacctggctaatttttatatttttagtagagacagggtttcgccacgttggccaggctggtctggaactcctggcctcaggtgatccgcacatctcggcctcccaaagtgctgggattacaggtgtgagccaccgcacctggcccttttttttttttttttttttttttttgagatgaagttttgccctgtcaccccagctggaattcagtgacgcaatctcagctcactgcaacctctgcctcccaggttcaagcagttctcctgcctcagcctcccaagtagctgggactacaggcacccccccaccatgcctgtctaatttttatatttttagtagagatggggtttcaccatcttagccaggctggtctcgaactcctgaccttgtgatctgcctggttcggccccacaaagtgctgggattacaggcgtgagccaccacgcccggccttgtaaacattttcttattgacagtagctgtcagcctgcatgcagcacttactgtgtgccaggcgctgctctgtgtccttcgcgtacaataactcatttacgccgaactctgttgccatccctactgaggcactgagatctcaagtcagttgtccatgctcacatagtcggtaagtgccagtgtggacttgaacccagatagtcacttccttaacctttgtgccatattgcctcttgatcagcaaataccttgccttttttttttcccccaatttgaaatgatattaggcacccagctaggtgccgaagatacagagatgagtgagagagtgtttgcttttaaggagtttgtgatctaatacgggactgtccagtagaattttctgcagtgacagaaatgttctcctcaacatggcagccgtcagtcgtgtgattattgagctagtgtgactgaggaacagaatttctaatttttttctttctctcttgcttttttttttttttggagacagagtctcactctgtagcccaggctggagtagagtggcacgatcttggctcactgcaacctctgcctcccgggttcaagtgattctcttgcctcagcctcctgagtagctggaattacaggcgtgcaccaccatggctggctaattttgcatttttagtggagacagggtttctccatgttggtcaggctggtctcgaactcccgacctcaggtgatccgcccacctcagcctcctgaagtgctggggattacaggcatgagccactgcgcccagctgagaatttctaatttttaaaaatattaattactaattatttaattttagttttttatttttataaaaatagagaaggggtctccttatgtttcccaggctggtcttgaactctgggctcgaaggaatcctcccttcttggcctcccaaagtggtgggattacaggtgtgagccaccttgcccagcctaattttaattcagttttacatggtcacaagtgtctaatggtaagacctggcgcagtcattcatgcctgtaatcccagcactttaggaggctgaggcgggcaaatcacttggggttaggtgttcgagaccagcctggccaacatgacgaaaccctgtctctactaaaaatacaaaaattagccaggtgtacctgtacgtgcctgtaatctcagctacttgggaggctgaggcaagagaatcgcttgaacccgggagatggaggttgcagtgacctgagattgtgccactgtactccagcctgggcgacagtgacccatctcaaaaaaaaaaaaaaaaagtgtctagtggctaccaaattggatagcagtgaattgaacagatctagtgggaaaaataaaacaaagttaacaaataacaatgatacatcaaagcatgacctgatacatcctcagagcaaggccgtcccagctagacgactgatacatccaatcattcatcagtgtgctgatattattcccttaatatgtgtcagtttttttttcttcttcctcacatttactgccaagtgaacataccaattttcaggataagttcttccagaaagatggtataagccctgaacttcagagactggtgaagaagcccacgttttaccacatcaacctgtggctgttagatctggcaggcctttcccctctgcaggtggtgtcactcgtggtggtggggactgttagggagctaggttcaaggagaaactgctccatgagaggctaccctctgctttggctccaccaggccacctgttctgacaagtgtctatattccaggcatgttaatcatgaactgcacagttagtgtgtggtcgtctcttcctgctagtgtgtggccacctgacatcacttgcaccctttaaaagttgaactgctgtccttctcttttagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggtaagttcagagcagaagaaccactagggttttgaggaaaatggtcttttccacactgggaactgggttctaattttgcatgttttaaaatatgaaatatcatctaggtgattcaggaatgaatggcatttattaattctaagacttcctggaagtagtacctataatttggtgatttcagtatatatttggatttcttacataaactgatcttgaatttgaatttagagtgaacatgttgtgattttgtatctgtgttcctagcatctggtctcatactaaatagattttggtttggcaatgttccatatctttctctctgttctttttgtaggaattggcatgtaagatggctctggaactcctcacccaagagtttggcattcccattgaaagactttatgttacttactttggcggggatgaagcagctggcttagaagcagatctggaatgcaaacagatctggcaaaatttggggtaagaatgcacatcacttcttgagagtatggaggagtgaaatgacactcagtgccagagtggggttttatgacctggaatatgtggtcattttgcatctcagggttccttttgagatgcacatggggaggagtgaggctagagaatcgcttgaacccaggaggtggaggttgcagtgacctgagatcactccactgcactccagcctgggcgacagagtaattatctttagatgcattaatatctttatttatttatttatttatttttttgagacagagcttgctctgtcagctaggctggagtgcagtggcacgacctcggctcactgcaacctctgtctcctgggcttaagcaattctcctgcctcagcctcccaagtagctgggattacaggcgtgtgccaccatgcccagctaacttttgtattttttttagtagagacggggtttcatcatgttggccaggctggtctcgaactcctgacctcaggtaatccaccgtgcccggccgcattcatatggtttttttttttttttttttttttttgagatggagtcttgctctgtctcccagactggagtgcagtggcgtgatctcagttcactgcaaactctgcttcctgggttcatgccattctccttcctcagcctcctgagtagctgggactgcagatgcctgccaccacacccagctaatatatatatatttttgttgttgttgttgttggagtctcgctctgtcacccaggctggagtgcagtggcgcgatctcagctcactgcaagctccgcctcccaggttcacgccattctcctgcctcagcctcccgagtagctgggactacaggcgcccaccaccacgcccggctaattttttgtattttttagtagagacggggtttcaccgtgttagccagggtggtctcgatctcctgacctcgtgatccgcctgcctcggcctcccaaagtgctgggattacaggcgtgaggaaccatgcccggccaattgtttttttatatatatatattttttagtagagactgggtttcaccgtgttagccaggatgatctcgatctcctgacctcgtgatctgcccgccgtggcctcccaaagtgctgggattacaggcatgagtcaccacgcctggcccatatctttagatccattcgttgcttcttaatatgttcaataattctgttgtttatgtttgtttgtttgtttttgagacagagtctcagtctgtcacctaggctggagtgcactggtgcgatcttggctcactgtaacctctgcctcccgggttaaggcgattcttctgcctcagcctcctgagtagctgggactacaggtgcgcgccaccacacctggctaatttttgtatttttagtagagatgggatttcaccatgttagccaggctagtctcaaactcctgacttcaggtgatccacccgctttggcctcccaaagtgctaggattacagatgtgagccactgtgcccagccaatcattctgttgttgaaagccaaaacaagtctttttttttttactttatatagttttaaaagttacacgtgtgttgtaaaaattcaaaccttatagaaatgtagaaaatagaaagtggaagttccctcaatcatcattaatagtttaatatcccatatctagtcttcctggccttgttcatagttctgtaaccttgtgtgtatgtgtgtatcttttccttccccacccccactccactcccccacccccgccgagatggaatctcgctctgtcgcccagagctggagtgcaatgacgcgatctcagctcactgcaacctctgcctcctgggttcaagcaattctcctgcctcagcctcccgagtacctgggattataggcacacactaccacgcctggctaatttttgtatttttagtagagatggggtttcatcatgttggccaggctggtcttgaactcctgacctggtgatccacacgcctcggcctcccaaagtgctgggattacaggtgtgagccaccgtgcccagccatgtctgtctttttcaacagagttgtattcttcatatgaaacagtttgtttcttatggaaatgaaatagactaggagaaaggaaatttttttttctttttttgagatggagtttcgctcttgttgcccaggctggagtgtgatggtgcgatcttggctcaccgcaacctccgtctcccggattcaagcaattctcctgtctcagcctcccgagtagctgggattacaggcacgtgccaccacacccagctaattttttttttttttttcttagtagagacgggtttctccatgttggtcaggctggtctcgaactcctgacctcaggtgattcacccacctcggcctcccaaagtgctgggattacaggcatgagccaccacaccaagctggaaaaaggaatttttttgtttcgtttttttgagacagggtctcactctcacccaggctggagtgcagtggcataatcatagtttactgcctgagctcaggcgatcgtcccacctcagcctcccgagtaactaggactagaagcattcgccacctgcctggctaatttttttttttttttttttttttttggagacggagtcccgctctgtcgcccatgctggagtgcagtggcgcgatcttggctcactgcaagctccgcctcccgggttcatgccattctcctgcctcagcctcctgagtagctgggactacaggcgcccaccaccacgcccggctaattttttgtattttttagtagagacggggtttcaccgtgtcagccaggatggtctcgatctcatgacctcatgatcggcctgccttggcctcccaaagtgctgggattacaggcgtgagccactgcgcccggccctgtctggctaatttttgtattttttgtagggacagggttttgctatgttgcccaggctgatcttgaactcctgagctcaagcgatctacctgccttgacctttcaaattgctgggattacagatatgagccactgtgcctagccagtttttttggcataatgtaattctaaagtataatcacatagtataaaagctaagacagtaggtgagctatatgtgttctgtgctgtgaacttggtcgaatttgtgaagtgctgcatcaaggagaatctgaacatggggtgtgtgccctctgtagacagctgggctgtccatgatgtgtttgcctcattttcttgttccttttacttaattctttcatcctttagtgcatagctttttactatacttggaaacagggctgcttctctttttttaattacttttactctagatatattattccaacccaacttccccttttacttgatctaaaactcctattcggttgactctgtagtctaagtgtagttggaattttgggtagtgacacctgtaaaaattaaatattaatcttgacgctggtttttaaaatcctcttttaccttgacttcatgtactgtatatctacactttaaaagtgtagcttttaaaagataagcaagcacaatcttttgtgtgtgtgtgtgtgtgtgtgtgtgtgtgtgtgtcacccaggctggagtgcagtggcatgatcacagctcactgcagcctcaacttcctgggctcaagtgatcctctcccgagtagctgggactacaggtatgcatcacccccccagctaatttttttttgtattttttagagagtcggggtttcgcaatgttgcccaggctggtctcgaactcctgagctcaagcaatgcgcgtggccagcgttttcattattatgtgttcctttctaggccttactcatgtccttgtgtattttcattgagtttcgagcatatcatgtgtatattttgtactgtcttctattgtaggcactcttgagaagagtcatgtgctgtttctttagcgggtttttttttttttttttttttttttttttgagatggagttttgctctcgttgcccaggctggagtgcaatggcgcgatcccggctcatcgcagcctctgcctcctgggttctagtgattctcctgcctcagcctcccgagtagctgggattacaggcatgcgccaccacacccagctaattttttgtatttttagtagagacaaggtttctccatgttgatgaggctggtctcaaactcccaacctcaggtgatccgcccgcctcggcctcccaaaatgctgggattacaggcatgagccaccacgcccagcttctttagcaggtttaatgtgcaggcttagcattagtacttgctgaaggttggaacttcttcattaaaaattctaagaattttttttttttcttttttgagacagagtctcgctctgttgtctaggctggagtgcagtaacatgagccactgtgcccggccaatcctaagaatttcttttgcggtggttgcaagtctgggcagaactcttgtcaggggctgtaactggacttatctttactcctttgtcaggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacaggtagccttgggttcctactccattcctttccttgagctgagcaggggaggaggaactcggagctgtgtagctctcttctcagctaaaagctcatttctttatttctcagattacctgtctgatctctggaacaaggatgggcctattctttcatgaactaaaccttatcgcacataatagcttcttgcgagctattcctataatgtcatgcttgctgtacttcgggctgctgttttttttttttgtttttttgagacagagttttcctcttgttacccaggctggagtgcaatggtgtgatcttggcttactgcaacatctgtgccctgggttcaagcgattctcctgcctcagccttccgagtagctgggattacaggcatgtgccaccacgcccggctaattttgtatttttagtggagacggggtttctccatgttggtcaggctggtctcgaactcccaacctcaggtgatccgcccgcctcagcctcccaaagtgctgggattataggtgtgagccaccgtgccagaactggactgctgttttaaagcctatttccttgaagcttgcctcagttttgtttttgtttttgtttttgtttttggagatggagtcttgctctgtcacccaggctggagtgcagtggcaagatctcagcccactgcaacctttgcctgctgggttcaagcgattctcctgcctcagcctgctgagttctcctgcctcagcctcctgagtagctagggttacaggtgcatgccaccatgccaggctaatttttaaaatatttttggcagggatggggtttcatcatgttggccaggctggtctcgaactcctgacctcaagtgattcccccgcctcggcctcccaaaatgctggtattacaggcgtgagccaccatgcccagtctttttcttttcttttttttttttttttttgagatggagttttgctcttgttgcccaggctgtagtgcaatggtgaaatctcagctcaccacaacctccgcctcctgggttcaagcgattctcctgcttcagcctcccgagtagctgggattacaggcatgtgccaccatgctcggctaattttgtatttttagtagagatggggtttcttcatgttgagcaggctggtctcgagctcctgacctcagatggtccaccacctcggcctcccaaagtgctgggattacaggcatgagccactgcgcctggcctttcctcactcttaaatgaaccccagagttcatttaagaatgaactcttcctttctccttcctttctccctccacttccctcttcccaccaaaccgggcaaatggcagatggtcacagcctgcaaactgttctgtaaatgaattttaaccagcagggactggagaggtggcagcttgagtctctgcttcaacctcctcttcttctggatcatacagggaagctgatggcattctgaaacctcttcccaagaaaagcattgacacagggatgggcctggaacgactggtatctgtgctgcagaataagatgtccaactatgacactgacctttttgtcccttactttgaagccattcagaaggtactggtgctattgcaaacattgtaaacttctgtggagttttccaggctgtactcttaacagtgctgtcaaagaaaaaatgaccatatgctttgccagccaagggtacccatttccatctgcctacttcattgttaataatgtgaggctccacaaattggtgttctaaatgtcttaagaacctaattaaatagctgactacaaaaaaaaaataataatgtgaggctctagacctgagacagtataatttttgagtgtaggggctggctggagtctctctacttccccaatgtcacgttcttggggttataggatctggcaagaccggcatcctttctgctaatgctcctcaatcctccaggaacctccttgggcaaggtagcgccagaaagtctgcttcctaaagggctgcctcctgattcttatctatagggcacaggtgcccgaccatacactgggaaagttggtgctgaggatgccgatgggattgacatggcctaccgggtgctggctgaccacgctcggaccatcactgtggcactggctgatggtggccggcctgacaacacagggcgtgggtaagtatgctgcacactgggtggtgtttggagcggcaccacgtgtgctatgtgtgactctttatgaaacttttctttgtgtgtgagattgagtgttgctctgttgcccaggctggagtacaatggcgtgatcttgcctcactgcaacctctgcctgctgggttcaagtgattctgcctcagcctcccacgtagctgggattataggtgcacaccaccacgcctggctaatttttgtacttttagtagagacggttgttttttttttttttttttttttttctgagacagaattttgcttttgttgcccgggctagagtgcaatggcccgatcttggctcaccgcaacctccacctcctgagttcaagcaattcttttccctcagcctcccgaatagatgggattacaggcatgagccaccatgcctagttttgtatttttagtaaagatggggttccttccatgttggtcaggctggtctcaaactcccaacctcaggtgatccgcccgcctcggcctcccacagtgctgggattacaggcgtgagccaccgtgcccggccagaggtggggttttgccatgttggccaggctggtctcgaactcctgacctcagatgatccacctgctacgacctcccaaagtgatgggattacaggtgtgagccaccatgcccggcctctttatgaaacttaaagccatctttcgttattgtttccttgtcttgggcaggtggaagaatcccccaccccttttttaagggatgaagggagtttcagctagtgtcacagagttgccactatattaaatctctgctgctgagtacagatgataaggattgtattcaaagttgcctgataggagattggcaggggcagggtgagggtaggtattgaccagccctgggaatctctcttactgacaggcaggacctgggatcacaggcatcaagtacacatctggtctgtccatctttcctccctctatgggtaactgaatgtgaaaggaaaacaaaccagcgtttaccctagggaagccttgacgggtatttgtgggtatgttactgagtcttgtgctaaaattaatgaccttggggaatgcgaaagaagcaggcttaggataaaagaaagttcctgaaagaggtgttgctttgggtaggattccaagggactcaagacaaaaccctcagctgggaacgttggggactagtttttgcctcttacagatatgtgttgagacggattctccgccgagctgtccgatacgcccatgaaaagctcaatgccagcaggggcttctttgctacgttagtggatgttgtcgtccagtccctggtaggtttatttctctgcttacccttctgtgctaaagcagtccgttaagagggatggagtgggagagggcatactgttaagcagctttttgttgctgttttttgagacggagtctcactctgtcacccacgctggagtgcaatagagtgatcttggctcactgcaacctctgtctcctgggttcaagcgattctcctgtctcagccttccgaatagctgggattacaggtgcacaccgccaagcctggctaatcttttctgttttagtagagacagggtttcaccgtgttgcccaggctggtcttgaactcctgagctcaggcaatccacctgcctcggcttcccaaagtggtaggattacaggcgtgagccactgcacccagctaaggagcttttttaagacggggcagggaacagtctctggcttcatccagcccctcatcttgcttcccctttgtcagggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggtaggtaccagtttttgcccttctccatcctggccgtttgatctttctgggaaagacaagccctttctgacagactgactgtgggctctcatgtctctgaggctgaacatagcttgattgaattgcttttggtgcaaactggaatttatagtaaaatggtaaaagtaatgcatcattgtggccaaagtattcaaacaatacagaatacaaaagtgttcagaaaatgaaaatcctcttttccacactcatttctcagagggaacaactcttaatggtttggtgtagaactcttcaggattcttctctgtttgcatgcaaatacatgtagatatttgtgtgtgtgtatttttcaagcaaaagtgggaatatttggtatgtactgttttgcaatttggggaaaattaattccaaagattttctccccagtttccaaagattctttattgaagtataatgaacaagggaaaagcttgatgaattttcacaaattgaacacacattcagatcaagaaatagatttgtcagctgggtgtggtggctcacacctgtaatcctagcactttgggatgccgaggcgggcggatcacgaggtcatgagttcaagaccagcctgcccaacatggcaaaaccccgtctctactaaaaatacaaaaaattagctgggtgtggtggcatgcgcctgtaatcccagctacttgggaggctgagacaggagaattgcttgaaccggggaggcggaggttgcattgagccaaaatcatgccactgcactccagcctgggcaacaagagcgaaacaccatctcaaaaagaaaaagaaaaagaaatagatgtgtaaggctgggcacagtggctcacacctttaatcccatcactttgggaggctgaggcaggcagatcacctgaggtcaggaatttgagaccagcctggccaacatggtaaaaccccatctctactaaaaatgcaaaaattagccatgcatgatggcgggcacccataatcccagctactcgggagactgaagcaggagaatcgcttgaatcctggagctggagagtgcaatgagccgagatcacaccagtacactccagcctgggcaacagagtgagactctcaaaaaaaaagaaatagaaaattgtccaggtgaggttgtttttgtttttgagatggagtctcactctgttgcccaggctggagtgcagtggtgtgatctcagctcactgcaagctccgcctcccagggtcatgccattctcctgcctcagcctctctagtagctgggactacaggtgtccgccaccgcgcctggcaatttttttatttatttttttttattttttatttttgagacagagtcttgctctgtcgcccaggctggagtgcagtggcgctatctcggctcactgcaagctccacctcccgggttcacgccattctcctgcctcagcctcccgagtagctgggactacaggcgcccgccaccatgcccggctaatttttttgtatttttagtagagacagggtttcaccgtattggccaagatggtctcgatctcctgacctcctgatccgcccgcctcggcctcccaaagtgctgggattacaggcgtgagccacagcgcctggccaaattttttgtatttttcctagagacggggtttcaccatgttagtcaggatggtctcaatctcctgacctcatgatccgcccgcctcggcctctcaaagtgctgggattacaggcgcgagccacggtgcccagcccaggtgaggtttaaaaaacaaaacaaaacaaaacagaattgtatcaggacatccattgtgcttcccccaggttaactgaaaaagatgtgctggattttctgatgggcacacagggccgatactgatagccttgtgtctttaattccttctgccagtcccagcatccttttggagggcttggcatggaaaaggggctgtctgttttttttgacacacctcctttgtgctgtgtaggagacactgcttggctcctctatgacacctatgggtttccagtggatctgactggactgattgctgaagagaagggcctggtggtagacatggatggctttgaagaggagaggaaactggcccaggtaaagaacttggagagtgaacaggaaacccaacaccttccaacccagcaccacttggctgcagactgagcatgagtttccttccattaaagtctttgaagtgctttttcccctagatcagtggttctcaagtgggggcgagtctgccttccagggagtaattggcgataatgtctgaagacatttttgattttcacaactaggggcagatcctgctgtcacgtacttggtagaggccagggtgcccctcagcatcccacactgcaagagaagtttccacaacagagaatgatctggccccaaatgtcagtagtgccaggattgaaaaaccctgttctggcagtttatgctgggcatagtttagcaagttccagtcctttggagtcccttttctcctactttacggtaacttatgcttgtttctcttgctgacagctgaaatcacagggcaagggagctggtggggaagacctcattatgctggacatttacgctatcgaagagctccgggcacggggtctggaggtcacagatgattccccaaagtacaattaccatttggactccagtggtagctatggtatgttgctgtgctccttccacatctgagcattctgccccgtatctggggggtatttgaaagattgtttctcaagattagctctccagcagactgctgacagcctctcctggagtgccgtacagtcacgctatgcacttttatacacataggcacccttggctggaggttttcttaactctattttgaaataattattgtcacaggaagttgtaaaaaaaaaaaatttgtaggaagggtctcacacccttttatccagtttcccctaattgtaacatcatgcaggaaactgggcaattgacattgatacaatccacagtgactatcagaatgctattaggggcctggcgctgtgcctcacacctgtaatcccaacactttgggaggccggggcaggtggatcacctaaggtcaggagtttgagaccagcctgaccaacatgatgaaaccccatctctactaaaaatacggaaattagccgggcgtggtggcgtgcccctgtaatcccagctactcgggaggctgaggcaggagaatcgcctgaacctgggaggcagaggttgcagtgagccaagatcatgccattgcactccagcctggacaacaagagtgaaattccgtctcggggaaaaagaaaaagaatgctattaggattctattatcctaatgctgttagaatgctattatcctaatagcattcttttttttttctgagatggaatctccctctgttgcccaggctggagtgcaatagtgtgatctcggctcactgcaacctccacctcctgggttcaagcgattctccggcctcagcctcccaagtagctgggattacagccacgcaccaccacacccggctgatttttgtgtttttagtagagacagggtttcaccatgtttgccaggcaggtctcaaactcctgacctcatgatctgcctgccttggcctcccaaagtgctgggattacaggcgtaagccatctcgcccgaccggataatagtattctaaagttaagaaacaaagccagtgcaatgactcatgcctgtaatcccagcacttcgggatgccagggtgggctgatcagttgagctctggtgtttgagaccagtctgggcaacatggcgaaaccctgtctctaccagaaatacaaaaattagctaggtgtggtggcgcatgcctgtagtcccagctatttgtggggctgaggcaggaggatcacttgagcctgggagattgagaggctgcagtcagccatatttgtgccactgcactccagcctgggctacagagtgagaccctgtctcaaaaaaaacataaaaataaattggcaatacatgtttttgcagcttttttgccctggtagagaacaatcttttttttttttttgagatggagtttcgctctgtcacccaggctggagtgcagtggcgcattctcggctcactgcaacttctgcctcccagcttgaagtgattctcctgcctcagcctcccaattaactgggattacaggcatgtgccaccacacctggctaatttttgtattgtagtggacacggggtttcaccgtgttggccaggctggtctcaaactgctgagctcaggttatccacccgtctcagcctcacaaagtgccaggatgacaggtgtgagccaccgtgcccggctgagaacaatcttacacctaaatctattcaagcaagcctacaaaatgagtacattctttgtgagttgaccttggactagggaatttattactactcttaaagatctactaatctgatgcaccaagtttctgttcagtagctcagagttagggtaacccattgtcccagttttaacactgaagcctgcatcccaggaaacccctcagtcctaaaaattgggacagttggtcacccgacagagtgttgcattctttgatggaaagccagcatgcgaagccctttgttgttgttgtttttttttttttttttttttttttttttttgagaccgagtcttgctttgtcacccaggctggagtggagtggcacaatctcggctcactgcaagctccgcctcctgggttcacgccattcttctgcctcagcctcctgagtagctgggactacaggtgcccgccaccacacccggctaatgttttgtatttttggtagagacagggtttcagcgtgttagccaggatggtctcgatctcttgaccccgtgatccgcctgcctcgacctcccaaagtgctgggattatagggggagccaccgcgcccggccgcgaagccctttcatattgtctaatgagtttgcttccaaaatacaattggacaattaggagctaagaagagtttgcgaaagagaatccagcaaaagtcagccaagaaggagtgaaaaggtcattgaccccactgtcccctttctatgcatttcccttgagcagtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagatgtgagccaacagttcttccttgttagccgaggagggccaggcgtggagccggggagctgcttttgccccacagtgctccaggccttgggagcagacctgacacacctttgggttgggttccatggtatttctgaagccgagggagctgttgcttgtacctgttgctttcctggccatcgggtaccctcgtaggagtatttttgcagccagggtacaagtttcctacaagctttgcacattaaaaaggagaggcagctctctgaaggggagatgtccttgtagaaaactcagcctcgagctctgccgctgctgaatgagttactttgtctccctaggcttcaggttccttatggaggcttttagatactcaaagatgcggctgggtgtggtggctcatgactataatcctagcactttgggaggccaaggcgggtggatcgcctgaggtcaggagttcaagaccagcctggccaacatggtgaaaccctgtctctactgacatacaaaaattagccaggtatggtggtggatgcctgtaatcccacctgctcgggaagctgagaggggagaatcgcttgaacccaggagagggtggttgcagtgagccgagattgcgccactgcactccagcttgggtggctgagcgagactctgtctcaaaaaaaaaaaaaaaattctaagatgctccttaatattggttatgtctgtgtgtgtgcacaaatatatttaattttttttttttttttttgagatggagtctcgctctgtagccaaggctggagtgcagtggcatgatcttggctcactgtaacctctgccttccgggttcaagcgattctcctgcctctgcctcctgagtaggtggaattataggcacttgccttcacgcctggctaatttttgtatttttttagtagagatgggatttcaccatgttggccaagctggtctcgaactcctggcctcaggtgatctactcacctgagcctcccaaagtgctgggattacagtcatgagccactgcacctggcctatttaatcatatttaatgatattaagggagtatgtgtgtgtgtgcaatttacatatgtaaagagaagttatatacacgagtttatattgaaaatataagaaaatttgtatgtttttaaggatttatttattggtctcttccttgacccctcttagaaaacagagtttacagtgaagaatgctcaggtccgaggagggtatgtgctacacattggaaccatctacggtgacctgaaagtgggggatcaggtctggctgtttattgatgaggtgagttgggttactgtggcccccattggatctggttagtaattatcttctcctctggctttaaattgtcctgtcactgttgggccgggtgtggtggctcacacttgtaatcccagcactttgggaggccgaggcgggtggatcatgaggtcaggagatcgagaccatcctggctaacacggtgaaaccccgtctctactaaaaatataaaaaatgagctgggcgtggtggcaggcgcctatagtcccagctactcgggaggctgaggcaggagaatggcgtgaacccgggagggggagcttgcagtgagccaagatcccgccactgcacaccagcctgggcaacagagcgagactccgcctcaaaaaaaaaattgtcctgtcactgttatcactccctagtgtaagtagaccgcaggggttaatttaggtgcatttggtggattgtgagggatgcaactaagagttaatctatatgttcccaagtcagtgatttcaccagtgatttcagttaagatcccgtggacttgttttcacggattgcttttctaacgtcacctacttctttgggagccaaggatgctgaagaatgaagaggtaggctctggcatgtgacagagctccagagtaagagtagcttaaaaccaggatagcagtgtatgttctaaaaagctcaagctgatacggaggctctgccccacagtcagagggcctggtttctcctcacctgtcactccaccttctttcctggggcattgcctttgatttcctggttcagaggatagctatcagatccattgtctaggccaggggttggcaaactttgtgtaaataactggatactaaatatttttggctttgctgaccacatgttcctggtgatgagtactcagctctatagttggagtgttcaagcagccattgaccatatgtaaatgaacaggtgtggctgtgttccaataaacctgtttatggctgggcacagtggctcatgcctgtaatcccggcactttgggaggccgaggcgagcagatcacctgaggtcgggagttcgagaccagcctgaccaacatggagaaaccctgtctctactaaaaatacaaaattagccgggtgtggtggtgcatgcctgtaatcccagctactcaggaggctgaggcaggagaatcgcttgaactcgggagatggaggctgcagtgagccgagatcatgccatagcactccagactgggcaacaagagcgaaactccttataaaaaaaaaaaactgtttataaaaatttataaacacatacatttggggaggctgaggtgggaggattgcttgaggccaagagtttgagacccagcctgggcaacaacatgagaccccatctctacaaaaaaataaaaaatattagttgggggtagtggtgtgtgcctgtagtcccagctacttgggaggctgaggcaagaggatcacttgagcccaggagtttgaggtggcactgagctacaatcgcgccgctgtactctatcctgggtgacagagcaagaccctgtctctaaaaatgaaaagacagatgacaggctagatttagccatcggccgtcatttggcaattcctgttctaggcggtggaaaagaaatgggaggacctgccccatccctttaatggtagacatcacttctgttcaaaaccttttgacccgaacttagtcacatggacacacttagccatagggaagctgggaaatgtaacctttattctgcacagccatatttccaactaaaaattgtagcactcgggggagcagataacgaggagataactagcagtctattacagacctctccatgagcccctctgccctttccagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggtaggatgggcgacggctgaatgccccccctccccacaccgtcactgtctgtccacagtcttagcagtgcggtgctctcactctgttgtatcagattcgtcctgcacgtagatttgcttaaagcaggctgggcacggtggctcacgcctgtaatcccagcactttgggaggccgaggcgggcggatcacgaggtcaggagattgagaccatcctggctaaccctgtctctactaaaaatagaaaaaattagccgggcgtggtggcgggcacctgtagtcccagctactcaggaggctgaggcaggagaatggtgtgaacccgggaggtggagcttgcagtgagccgagattgcgccattgcactctagcctgggaaacagagcgagactccgtctcaaaaaaaaaaaaagtttgtttaaagcagtgattctccatctgtgcttttgccgggggcagtggtggtggttggtggaggggagagggagaggcatttgtcccaccccaccttgggagaaccagagctgttctagttaagtctgttcacatatgagatttggtccacagtttaacaaaatagttggaaattcccatactgatgcccttgactttgcacgtggcgtgtgattgaggaagctcatggcacgtgctaggccaagccaggttggaacccgagtcctgcctgcaggaccatgctttcctgcctcgtcgtaccgcacctccagggatctcttccagctcttttctgtcttcttggtctggcaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgtgagtactgcagaggggcagagtagacaggtcatctaccttcatcctctgaggatgtaggtcttaggctggaccaactcttgtctgtctaaggttgaagtgaagtcctcagaaatgccgttgctaaatagcgttcccaagaatctcagcatcctagcatgctcattagatccctgtatctgaaggtaacatttcctgacgaaacattcccaggaggaaaagggggaaaacattgtattcacattaccacacagttgcttgctgttgtttgctgggctgaaactagcaagaaggcttgtgtgaatttgggattcagcaaggcctggagtgcttgttgagctcttgatgtgggcctagcccttcccattcctggtatctcacctaatttcctttgacagcttgggcggcatctggggaatgtagctccattgtctcagagcccccgagcaggccacgtggttgactcagctcagtttggcttgggatagccacttctgccaatttggattcctctgtatctctctgggcctttttgggaaggtcatggtggcctggaaagtttctgcttccaaatgaagccttgtgaaaagaattgtggttttttttgtttgtttttttgaagtggagtcttgctctgtcccgcagggtggagtgtagtggcacagtctcggctcattgcaacctctacctcctggcttcgattctcatgcctcagcctcccaagtagctgggactataggcatgtgcccccatgcccagccatgaagagaacattctttttttttttttgagacggagtttcattgcccaggctggagtgcaatggcgcaatcttggctaactgcaacctccacctccagggttcaagcgagtctcctgcctcagcctcctgagtagctgggactacaggcacacaccaccacgcccagctaattttttgtatttttagtagagatggggtttcaccctgttagccaggatggtctccatcttctgacctcgtgagccacccacctcagcctcccaaagtgctgggattacaggtgtgagccaccgtgcctggcctaattttgtatttttagtagagagggggtttctccacgttggtcaggctggtcttgaactcctgatctcaggtgacccacccgcctcagcctcccaaagtgctgagattacaggtgtgagccaccacgcccggctgaaaagaacattcttaatgtcatggttgagaccctccagggtctcctgcaggcctctggcaggcagggagcaagtaggatgtgcagagagtaggataggggcctgggggattgagttcaaggcttttctgcccagctgaattgggccttcaaacgagtcccactttgcctgattacctgtttgctcataccctttagactacaggaaacagctttcaaaaactttataccaagggttgggtatgttgcctcatgcctttaatcccagcacttagggaggctgaggcaggcagatcacttgaggtcaggagttcaagaccagcctgtgcaacatggtgaaaacctgtctgtactaaaaatacaaaaattaggagtggtggcgggcacctgtatccaagctacttgggtggctgaggcaagagaatcatttgaaactgggaggcagaggttgtggtgagccaagatcacaccattgcactccagcctgaacaacagaacaggactctgtctcaaaacaaacaaacaaaaaaaactatactatcttcaaagaatgaggatgaattaatgaacatttgaggttctctgaactgagaaataaagcctgtttaaggggttgtggtaagattttaaaagtaatcctccaaaattgtcacctagtgagcagaatacaaaaatggagcttaagttccactacaagaccaaaactgtcacgtagagcctaagggtaagactgtattggatattagggaccacaaagcactttcatgtttacctcatttgattttcacagcaactgtgtggggagaatcatccccatttgagaactgagaacactcaggctcagcgagctggtgtcccgcttggtgtcagaatactctcaagcccaggctttccctgactgtcaacccattcctgcttctcttgtccgctagtgtgaccccccagccaagggctgccagggcctctttcactatggactttgtgttctgccattcaggcacctgcggaactcgagtcatgcaggagcttttgtgatcgtgacggaagaagccattgccaagggtatccggaggattgtggctgtcacaggtgccgaggcccagaaggtgagcaggtcaggctggtttgtggcttatctgaagaaggcaagaggagcccagtctgcgaatccatagagcaaacactgctctgcgtggctgctgcagtcagagtgaaagtacaggctgggccactccccctgccccagtgtcctacccctgagtggcagaagaaacctgccaccacacaagatctcctagctttcctatgtttagtcttttaaaatatatgtgaatcaggccggacgcagtggctcacgcctgtaatcccagcactttgggaggccgaggcgggtggatcactaggtcaagagttcgagaccagcctgaccaacatactgaaaccctgtctctactaaaaatacaaaaattagctgggtgtagtggcgcgcgtctgtaatcccagctacttgggaggctggggcaggagaatcacttgaacctgggaggcagaggttgcagtgagccgagatcgcaccactgcgttccagcttgggtgacggggcgagactccgtctccaaaaaaaaaaaaaaaaaaaaaatgtgaatctggccatctaccccctcctgtctccatgtggaggagggtaagacatagattcgctgtggcatcggggcccccagcgctgatccatgtactcctaggggcgtgcttagtctgaggccgtgcagtagaggatgggtgctctttcatgggaactggtgtgtctgacttgtgctaaagccccaggggtggccacttcctgggggaaggggctcctgattctcgagcttgatcacccctgagtctgagttgggtgcagcctttgccaatgggcctgtgagcactgtgctccttgctggggcctggggctgccagcacctactccccacagacacttttggggtgttggggtatgttgctgcaaggcctaccgccggggcttccgcagctgctcagacacaggatagtgagtctgactcagacctcctgcttggggttgacccggtgtcccctcccaggccctcaggaaagcagagagcttgaagaaatgtctctctgtcatggaagccaaagtgaaggctcagactgctccaaacaaggatgtgcagagggagatcgctgaccttggagaggtaggggcggcttccctccctccgtcctcagggcctggtgcatgaaacatgccccgtcttcaggaaatcatctgtagtcagtcaggccctggttcttggtggaatgggcctttgggctgacttctgttgtcctgtagccttgtagcagggaccccatggatcctgtccttggaccctggacattccctgctgctcccagtgctgctagcaggagagctcttcccaagcatgtatgggcactggggtggagggatttggggaatgggctaaggctggcccctgcttccaagcctgcctggtatttatttgcatttcaagctgccaggaagcttatcacaggctgttcccagcctggtaaggaccgggcctgatttgggagcccagctttctgctgctcctttctctctagccctgcttgtttcacctgccacagctgctcctaaagggactggtctcaaagctttccttgctttcctttccaggacactagtcagggaggacttgggttcgggtggggtgggctggaccctgacatcccagcaagttgtggcccagattgagatggtcgtctattggttccaggccctggccactgcagtcatcccccagtggcagaaggatgaattgcgggagactctcaaatccctaaagaaggtcatggatgacttggaccgagccagcaaagccgatgtccagaaacgagtgagtcctggcagcaccagtggccagagtgtttcctaggcaaaggctggcagaacagccaggggttcggggcctgggcttttggtctgagctgctgttctggacttttttcttgcaggtgttagagaagacgaagcagttcatcgacagcaaccccaaccagcctcttgtcatcctggagatggagagcggcgcctcagccaaggcaacccaggggccagggtcccctcccctagggctcatcagctctctggtggctgacatgtggcctctgtggctctgagcgaagtggttgcctaagggcccacggtctgggattgagattgggaggagcagcagctccctgcatgtgggaggcatacctgggccagggtaggggcagggcccggcgctggggtcctccccacaggccctgggcacagcccctgctctgggaaggggtaggggtgggtggcaggccttctgagggctgcaaatgctcacactagtgagggtccctgctccagcaccgtggcctgagccaggtcctccccacaggccctgaatgaagccttgaagctcttcaagatgcactcccctcagacttctgccatgctcttcacggtggacaatgaggctggcaagatcacgtgcctgtgtcaagttccccaggtcagcaccacctcgcaccagtgggaagtgttaggtcttaaggttgttggctgaggcctgtgtgtgtacagcctgcattcgaaacagcctttctgcccaccggttggttacctttgccagtaccccttacccaggccttcttattggtgaagacatctggttgatacctggctttgccactctgtcctgtcctggcagtggccatggccgccccctgtaccagccgtaaagtctgtctcggcctccagcagtatcacccagggcaaggagtgggtgatggctcctccatcctttctttccctgcattcctccctcaatcccatcttctgtgctgactcccccttcccttcctgtcttctagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgcaatacttaatgccgcatgatctctatccctcttcccaataggggctggctcttttgacagcctttggcgtctgtagaataaatgctgtggctcctgctggctgctgtggtgttcacctagtccagccccagaacccaaaattttgggaacagcccctagggctgcctcaaacgtctgtggaggtggaggccaaataggtggggtgacttggagcaaggcgttcataattcagtagatgaggggtggaggtagttggaagcagagaagcctttcttggagctgctctcccccctcccttccagcaagatggatggatccggctaccctgcacaactgggaccgggccgttctccctccgggcctccaggggcgctgtagtgcctcccgccgctctctcgacagcccatgcgcagccgcgcgtctttaaacaacggaagaaccagtggatgcggcagggcgttgggcggaaggggttcgcacgccaagaaccgccatgcctggggatcaccgccgcatccgcggccctgaagaatcgcagccgccgcagctgtacgcggccgacgaggaggaggcgcccggcacccgcgacccaacgcggctacggcccgtgtacgcgcgcgccgggctgctgagccaggccaagggctcggcctacctggaggcgggaggcaccaaggtgctgtgtgccgtgtcgggcccgcgacaggccgagggcggcgagcgcggcggcggcccggccggagcaggcggcgaggccccggccgcgctgcgcggtcagcctgctctgcgacttccgccgcgcacccttcgcgggccgccggcgccgcgctcccccgggcggctgcgaggagcgtgacgtggcgctggcgctgcaggaggcgctggagccggctgtgcgcctgggccgctacccgcgcgcgcagctcgaggtgtcggcgctgctgctggaggacggtggctcggccctggccgccgcgctcaccgccgccgcgctcgccctggccgacgcgggcgtggagatgtacgacctggtggtgggctgcggcctcagcctcgcgccggggcccgcgcccacctggctcctggaccccacgcggctcgaggaagagcgcgccgccgccggcctcaccgtggcgctcatgcctgtgctgaatcaggtggccgggctgctgggcagcggcgagggcggcctgacagagagctgggcggaggccgtacgcctgggcctcgagggctgccagcgcctctaccccgtgctgcagcagagcctggtgcgggccgcccgccgcaggggcgccgccgcccagccctgaaccagaagcctgagcaactacggacgcaagccgaggaccgtgctgccgccgtccacgaaaagacccgcgccatcggcctccagtttgcgtcgagaattcctggaagggccctgatatgactgtggttggactgacctgactgccagatggtgggacttggtctggagcagggactacttggaatgataaaggcaaaactcaacagcccctggagctgcgcttgtggtggagctggaccctgaaattacctggaccttttttttagagacagggtttctttctgcagtctcaaactcctagccttgattgatcctcctgccttggcctcccaaagtgctgggactacaggtgcatgcaaccacacctggctaattttcttttcttctttctttcttttttttttttttttttttttgatggagtcttgttctgttgcccaggctggagtgcaatggtgcaatcttggctcactgcaacctctgcctcctgggttcaatccattctcctgcctcagcctcccaagtagctgggattacaggcacatgcctccataccgggctaatttttgtatttttagtagagatggggtttcgccatgtgggccaggctgttctcgaatgcctgacctcaggtgatccacccgccttggcctcccaaagtgctggaattacaggtgtgagccactgtg

SEQ ID NO: 15797 - DNA, 34725 bp, Human
ggtctcaaactcctgacctcaggtgatccacctgcctcggcctcccaaagtgctggggttacaggcatgagccaccgcgcccggccttttgccacaatttataaacaagaatgaattctaacgttcatattaattgaagctaacatgacacacatagcataaacaggtgtctaagcggccaggcgcggtggctcacgcctatgatcccagcactttgggaggccgaggcaggtggatcacttgaggtcaggagtttgagaccaggcctgaccaacatggtgaaacccagcctctactgaaaacacaaaaattagccaggcgtggtggcacgtgcctgtaatcccagctacttgggaggctgaggccggagaattgcttgaacctgggaggcagaggttgcagtgagccgagattgcgccattgcattccagcctgggagacagagcgagacaccatctaaaaaaaaaaaaaaaaaaaaagtgactaagcgaggggtatggtggggtgtggcgtggtgggatgggcctggcttttatgcctagaccaacgtgcggcctgggcaattatctaattatcggttgtctaattgcccagcgtcacacatttctcacctgtaaaatgggtatgacagtctctgccctcccactgcccggggttgctgtacggcctgcgagagcgggtttgggaaagctctttgtcaactgctgtgcggaattgatggggtggccacacttcaatgccttgactcaggggtcagagctttcaagcgaccccaggcagggctatgagggcctccctggcagtggctgcttattccaggctgggcctgccctacggcttgttggcgtcccgcaggcagctgctaggatggtttttgcagggcatttgggccgcagcctggatgcatacctagacctcactgtttttctcagccagggtctgggagagaatgaaacctattgttctagttatctgctgtatgtgactctctcctgtgcgtttctctcttgtgggtcttctctcctgtgcatttagggtggtatgaagtgaagagagaaaatagacacttgtggccgggcgcagtggctcacgcctggaatcccagcactttgggaggccgaggcaggtggatgacgaggtcaggagttcaagaccggcctggccaacatggcgaaaccctgactctactaaaaatacaacaattagctgggcgcaatggcaggtgcctgcaattgcagctattcgggaggctgaggcaggagaatcgcttaaacctgggaggtggaggttgcagtgagctgagatcgcgccattgcactccagcctggacgacagagtaagactctgtctcaaaaaaaaaaaaaaaaaaaggaaatgacactgatagttatctgtgttttgtggttccctgaggaacccccagttgagaagaaaggctgggacctggctgacccagaagaccccctcgacgccaacccctactccaggtttggggacccaggaacgagaggcctaagagagttagggactagttcaaggttgctcggactctcaaaacaagtccctaatgccaggccagtactgtgtggcgggcagcacgaccctccattccctctttattttgaaaacggaacagttacaggacgctagttttgacgtcgctggttgtgaatgtcatttgtggagccgtttcccagacctccgggggcaggagccacaggtttgagaggccgagcagcgccctcctttcctgagagctgaggttgcagctctggctggctctggtaagtgctctgcagccctggcatggctggaggaggggcagcagctaagtggtttctgaaaaagggcaaaaatgatgggaaaagctttgggatcctctgggaatcagagccgcagcaaaggcagctgcttgcatcgctggaagcgttttttccttgagtgccgaagggcgtccacagcgactcctgctagtgcagggcagctgctgccagggccgggcccgggaccccacggaggcggggagaccactcttctcccacacgagcccagctctcccttcgagtagcaaccgccttcaagctcacaagcacccgtgggcctggggtgtgcctgcgtctagctggtgagtccctttctttgtctgatggccaatgcagacattagcttttaagatggcatagtgagtggccaaaagccgggccctgtcacttcccagctgtgcgactgtgggcaggtccactcacctctctgtgccccagttaccttatctgaaaacggggggtagtaagagtggctgcctcaaaggtggtcgtgagcctgaagcgaacttgtggtgccctcagcctggctccttggaagcacctgggaggtgagagtggaggttgttgttactggggtttgttcttgttgctcctgcatcagccgtcctcgggggaggaggctgcagctgctgctgagattgctggtgtgtggccggaggttttcagcgtgtcgccctctctgtggagtggacgagcgcagggctgggaagcaggcacactgggtccttgtgctgctgtcctatctctttgttcttcacccctgggttgggaagcccgcagcctactgcctccctttgacagaagggactactgagaataatctggctgggtcctgggccagcgttctcccagcttccagaaagtccccagtggcgagcgggaggtgctcccaagaacttggatggatggatggatggatggatgctttgggcagagagaggagcaggggagccacaccccatgttgtctcacttgcattggggagagaagggatccttcccccagagggtaggcagtatctgttctggctttggagttgagaaagactcagatcataccacgtctctgtgggcagaatcgattcttttaggattgtcctttagtccagattgatgagtttgtgagtcttgtgtaaaccagaatcaccatctccatcacacagccaacactcgtttgcctaaatcacggtagaagttcccctgatcactgtagaatgttttgcggtgacaggtgcatcaccacgggcttaggtgcagggtacactccaggcctggcagtggagggctgtcctgaccctgttccccggcccagcccagggcacatgacccctcagttcctgtcccaccccgttccctggaagaagcttggtttccagtagggaatcaggtgcagagtgtgcagtatagattcagcgtttgtcgactgactgaatgatagcacaatccaggctgcttcctgttggctgggtttggttggactgggacccgtcagaggaaaaggcaacgccgctgacaaagaacattgccgaaaggttcatgggaggctccggctaacaggtgctctcttgctgggctgcctaacgagcagcccctattcttattcttagcttattcttggagaccatagacatccctgggacagccaggcatgggtatgacctgggtcttattcacactgcattttggggttcctgagctgcttgtttgagcgagaggtgcttcaggttcaggtcttatgcctagccccttgggtgagagggcctattctgattggcccccaggccctgctgtggagtctgggtctgagttgaactgctgagaaagagccccagacctccagcatcgtggtggagcactggagatgctctggagccagcctgcctggggtcaagtccgggttccatctctgactgtgtgacctcggggacgtgccataactgctctgtgcctcggtctcctcatcggtgaagtatttccctcttagggatgttgtgggaatgaagtgggtgaaggaatgcgagtcctgagaaccgtgtctgctttgtgcacgtgctcagacgcatcaacgattctgcttctcattcgcttctggtgccttttaagtgctgccagggctgtccgcactgtgaacggtccttgacggggtgttatcttcagaaagggaagactagcacccggccccccaggcttccaaagcatcatccatgcaaccatgttggctttcaattccttggagttaaggctgacggccatctggttctaacccggcctcctgtcttcctgtcccactgacttcccgttcttcagctgctctaggcttccctgtctgtctccagaccctagcccacctctgttcccttcccaggctcagctcatccatcaccaactgccatggacccctcttcagcaccctgccccctcctgcagtccctccgcccagccagtacctggtttctgtctcagcggggagctgactcctctctgtgcccccagcgcagggctggactctgaggaggaggactcagtagataggtattgagtgatgagatgagggaatcggctttctgtggccgggaacactcctgctgcagggggtccacctgatgggtgagtcagagaaagactcaggcctgttgaaagtggatcaacaggcaggcagggagatggccagtagccagccgtccgtcctgttcacagcctgcggagtggtgaggctgcctctgtgttttcatggatctgagattcagaacgtagctggtttacagccatggcccagttgtgtgctctggagtttcactgcctgaattttaacttgaaaatgtaggacttgggagtctctctgagccattctggcttgggagattgcctgattatatatttcaaaaaaaaaaaaaaagaaaatgcaggacttgagaagcctctcatttcttctgcggctgttttccggaatgtagccactgctggaacagtaatctccctaacttcctatggaaatggcaattagaagggtctgattgctcttatttccccatgtgtgcagctgctgctgctgctgctgctgctgcttctttttttttttttttttttttttttgagacagagtttcactctgttgcccaggctggagtgcagtggcacagtctcagctcactgtaacctctacatcctgggttcaagcgattctcctgcctcagcctcccgagtagctgggattacaggcgcccgacaccacgcccggctaatttttgtattttttttagtagagatgggatttcaccatgttggccaggctggtctcgaactcctgacctcaggtgatccacctgccttggcctcccaaagtgctgggattacaggcgtgagccacgcgcccaggccagtacagcttcttcataaggagatggaccaggaaaggtccctgcccaggaggaggtcacagggtgcgggagagataaatcagtgacagatagcaattgctggaccacatggtaggctgtgtgggacaggcggtcagtgggctgggccactgtgtggaggacagcggggagcatgagcagggcagggatctgggggcttcatggaggaggcggcatcagtgctggatcctgaggggaagtagcatctgagtggtgataggacttgtgcaagggtagacagaggaaaaagcccttaggtggagacccgatgggaatagaggctatgggagggatgtatgggccacccctgggtgccagggagtggggatgcccagccagagggaggggaagcatggggatggggcaggatgggagtggaaaatagcatcagctcatgtgtccaactacacatgctgctgccagcggccagctgatctctaggtgtttaggcctagaagaccaaccagctccaaatcacttaaagcctaaacgttccctgtctctactaaaaatacaaacattagccacgcatggtggcgggcgcctgtaatcccagctacttgggaggctgagggaggagaatcgcttgaacctgggaggtggaggttgcagtgaacagagattgccccattgcactctagtctgggcgacagagtgagacacacacacacacacacacacacacacgcctaaacattcaaggccaggatgcttgacagatgttgattcataaaaatgacaaaaagcacaaaatccaaaatctcgtataaggctcagtggctgtggcagcgaggttgaagagcaaaggcaggccgggcacctggctgatgatgtgtggacccgttgcacagcagggccccgcagtgcggtgtgggtgtgggtgggccagtctctgccgctcaccctattccagggacacagtctgcttggctcttctggactgagccatcctcatcaccgagatcctccctgaattcagcccacgacagccaccccggccgttttccttgttctgtgtggggagggaggcagcgcggtggttatcaacctcaccctgcagaggaggcacctgaggcccagagacgaggagggatgggtctaacccagaaccacagatggctctgagccgggggcctgtccaccctcccaggccgacgtcagtggccgcaggactgcctgggccctgctaggcctgctcacctctgaggcctctggggtgagaggttcagtcctggaaacacttcagttctagggggctgggggcagcagcaagttggagttttggggtaccctgcttcacagggcccttggcaaggagggcaggtggggtctaaggacaagcagtccttactttgggagtcaaccccggcgtggtggctgctgcaggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggtaagtccgcgtctggagcccccctccctgctgggagcccagctggccatggagatgccacagggtggtctggcttctgggctaaatgtcacaaagccagggggctggagagccttaggggtggtctggtccagcgtccttcctcacgtgacctcgtgggatgtgcagtcacgggggctggtgtctgtgctgggtctaggtgtccacgcccgcaatgcctaccagccacagacacttggacttgaagtctaaaagctcaagggcaggaggcttttggagagcacagcacagctccagtgagctgcaaggcagggcagggagggccacaggctggctgacttctggggagtgtgaggccaccttttcccttagaggggctgtctacacccctgcctccacctccctccgtccccaccaggctcctgcctcccgagctcccgagcaggcagagaagccagtggtctgggagtaggagggtgactttctagatggtgtctatagacagggtggggacagaatggggacacatgccctccactgtccctgttacattgcttttctggacagtcacctagactgaggggcagcttttatatcatttttcccctttttggtttgccttgggatttagtcgtgttcccttgacaagctccgaaggcctcagggccgaggggaggccagggtatgagacgagcgtgttttctggcccacaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaaggtggccccagcgctgggctcggggagggccccagccctggcctgccctgaccctcccttatgtctttcagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggtgaggagggcggcggggccgggcatggctcagcccgcagcaccgggaagcaggggggcatggttgtccctgggcctccttgcttctctgggatccttactccctgtcccagccactgcgttggtggctcctaatcctagggggtccctgcctctcccatctgctggcttgatttctcctggtcctgggggtctctgcctccccgatctgatgtctcctctcttgaccctgagaagtccctgcctccccctgctgactggatggtccctgtccctggaagtcacagcctctggcctttctctctgctgctgttccttgcccccggggcaattttgactcctctggcttccaacccgttatttcctgttcccaggggtctcctgtctcaggaccttgctgggaccccttgggggaccctggcctggcctcctgcagtgggggggtcctccaggcactttctgcccagttcctcctgcagcagctgctgcctgcccagagcccttccccagcacctgtcccggcagccccacaggaccgtgaccacgaagccaaccgtgcgcgtcctctgtaggccagacagcactgcacatcgccatcgagagacgcaacatggccctggtgaccctcctggtggagaacggagcagacgtccaggctgcggcccatggggacttctttaagaaaaccaaagggcggcctggattctacttcggtagggagacagcgtggcagaccctgatctttttggcttttgctaaggggaggtttgggcagagacagagggagtttggaggccggtggttcaggggccagctggatctcactcctgaggcccacctgggccctgtgttcatgcaggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatcctgggggccaaactgcacccgacgctgaagctggaggagctcaccaacaagaagggaatgacgccgctggctctggcagctgggaccgggaagatcggggtaagagggggcttcggctcaggctggtgcggtgcggggctgatggcatgggagaggactgcctgactcactgcgggagcctggcgtcgctatctgtgtgtgcgggactctgattctgtcataccagcctgtagggctgttagaataagtctgagaaattgggagccacagggcagaaccctgcaatggccaacgtgccattttgaatttccagctctgagtatcagcaacaagacatggggtggggtagggtgctgggcaatggaggagggactgcctagggtggaacagaagaatagctgttgggctgggcacggtgactcactcttgtaatcccagcattttgggaggccgacgtgggtggatcacctgaggttaggagttcgagaccagcctgaccaacctggtgaaacctctactaaatatacaaaaattagccaggcatggtggcaggtgcctacaattccagctactcaggaggctgaggcacaaacatcacttgaacttgggaggcggaggtggcagtgagccaagattttgccaccgcactctagcctgtgtgacagagcaagactctgtctcaaaaaaaaaaaaaaaaggaaaaagaaaaaagctgttggtgtttttccatggcaggcaggagcatggcaggcaggagctttaggtaacaaggctgatggctccagctcccagctccagctggtggctcctggtgacaggcctccagctcttggcctcaagtgatcctcccacctcagcctcccaagtagctgggattacaggcatgagccaccccatctggctctcatttcttgcattctctttctttctttctggcttgaggttatcgagaatggaccaccgctgtccttcatggtgagatggtagagctggggcctcgccgtgaggggattgtgggcctgatatggtgcaggtagtatctgaggcagctggctggttgacgtttgtgtgttttgttttgttttttttttttagatgaggtttcgctcttgttgcccaggctggagagcagtggcacaatctcggctcactgcaacctctgcctatcaggttcaagtgattctcctgtctcggcctcccaagtagccgggattacaggaacacgccaccatgcccggctaattttttttttgtattttcagtaaaaacaggattttgccatgttggccaggctggtctcaaaatcctgacctcaggtgatccacccgcctcagcctcccaaagtgctgggattacaggcatgagccacccgtgcccggccggctggttgatctcagtggtggtcaggagtgggtggggactcgcctggggcttaggtggggccaccagctgggctgggaagcagagctggttgttgaggtactgtctgaggctgagcctggggctggcctctgacgggctcttgctccccgggggcaggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctgtgagtggctggggcacagccagggagggcctcagggcctctgcacccaagccccaatcccagcccctggtccagctccagctggcttctcaggagggaaagcctgctgcgcccgggcccaggccctgcagcctcacgttccccactcatgcccactgaattttccctaagcatagcaaccatacgtgattatcatcccataaaaacagaaacgtttcagaggaacatggacaaaaggaccctccttttatactatttaaaaatgcacagtttcattttgtttacataaatgagatcagactatacacaatgtacaacaaccttttttttttttcacttgatggcagggcgtgtagatttttctttttttttttgagacgaagttttgctcttgttacccaggctggagtgaaatggtgccatcccggctcactgcaacctctatctcccgggttcaagcgattctcctcgaatcccaagtagctgggattacaggcatgcgccaccaggccctgctaattttttgtatttaatagagacaggatttctccatgttggtcagggtggtctcgaactcttgacctcaggtgatccaccctccttggcttcccaaagtgctgggatcacaggtgtgaaccactgcgccaggccaagaacttatttttgtgtaggtgtgaagtaggcatcttacttaaatattttggctccaaatgaatgtcttagtgttacgtagtgagtaatccatcctgccacgctgtttggaaaggccaccttatctgtcccttctttctaaggtgatgctctgagctcctaaggcagacttgggggctagagtctgtgccatcagcagtgaggggcttccacgacatctcacaggtcagaggttgcgtttacaggagcagagtccggggctgggaaaggcctggtctgctctgcctcccctgggctgccatgctgaacctgggcctccaactcagagtgctggatacaagtgttcccagaggagaggtccagataggaggtggcctcaacaaggactgcagtatttgacctgggggagaggctctgggaccaccactgacatcttcatgtctctaaaggctctcagggacaaggagtgtggacttgtcctggggaccctagggcagagccaggaccactagtggaaagtagagaagaccaaagaagaggtattccctacaggcagtgagtctccataggcctcttgaggcagtaaggagtttcccattcccaaaggcattcaagaagacactgatcaggaacctctttgagggagcttaagtttggggtgggggttggactcgatggcctgagggaggctgggatgatctgattttggctcatcagtctcagggatacttgaacttatttttattttattttattttatattttgagacagagtcttgctctgtcacccaggttggagtgcaatggcgtgatctcagctcactgcaacttctgcttcctggggttcaagcagttctcccacctcagcctcccaagtagctgggattacaggcacccaccaccatgcctggctaatttttgtatttttgtagagaaggagtttcaccacgttggccaagctggtcttgaactccagacttcaagtgatccacctgcctcggcctcccagagtgctgggattacaggcgtgagccactacacccggcctatttgaactttatcaaagtctctggatatgagacatttgccccaaagcatacttgtaatgatggcatgaggcactgggccctcctggggcaggaagggcctcctagttccctgcctccctgccgccctgcctgacccagggctggaaacgtgagaagtgaggacccagaggctctttcctgcctgccctgagcccctcatgcccaggctctgcctaagccaactacttcccattactgtgggctctcgggagggagttattagacacagcgggcagtgcggtgggccattaagtgagcacttaagagcttgtccagtttcaccccattcactgcacctctggggacactgaggccaagagggcaggtccctccgtgagccgcggcagtgctgggaccagccccaggctatggctgccggctggctcagacctcccatctcacctgctccgtgggctgaggactgtgcgggccacatggctgtgaggggcaccacgggctggtgtgggcgtgcgaggagttcctgctgcaggagggaacctcacttctctccccaccccctagaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttggtgcggccagaggctcaggcctcgtgggcgagggtgtgggtggtggggaaggggtgtggacatttcgggagacctccccgaccccaggcccaggctctgccctggactccttcccagcttgcgggagcgatggatggagaacgtggagaacctcgtatccctgcgcccatctcccctgcctcaggctgtacaggagacccgcccccttcccgcttctcagttcctctcctttaaccttgaggtcctgtggggctgagtgtgtggtgactcaggtccctgattgtagacggggtgtactcggttagaaagcatgcaggggccgggcatggtggctcatgcctgtaatcccagcactttgggaggctgaggtgggcagatcacctgaggtctggagtttgagaccagcctgaccaacatggtgaaaccccgtctctactaaaaacaccaaattaactgggtgtggtggagcctgcctgtaatcccacctactcagggaggctgagacaggagaatcgcttaaaccttggaggcagaggttgtgatgagctgagatggcaccactgcactccaggctggtcaacaagagtgaaactctgtctcaaaaaaaaaaaaagaaaaatcacgcaggaatttgggctcgggacagggctcacccctggcctgggggtccccagggatgtgggctggtgtctaagcccagagcccaccatcatcctgcttgcctgccctctttcattcactcacttgctcattattcattccctggatttagacttttgagcagctctgtgccaggccctgggccatccatcaaatcagcctaagaccagcctttttcctctgccaagagccaagacttcatcaaacttctggacttagtccttcgtgtctgatacccaggacacttaatttgctgcttttgtttccagggcactttacaagtttacttacttacttaatttttgtttttttgagatggagtctcgctctatcacccaggctggagtgcagtggcgcaatctctgctcactgcaacctccacctcccgggttcaagtgactcttctgcctcggcctcccgaatagctgggactacaggcgcccaccaacatgccaagcttatttttatatttttagtagagatgggatttcaccgtattggccaggctagtcttgaactcctgacctcaagtgatcgcctgcctcggcctcccaaagtgcttggattacaggtgtgagccaccgtgcccggctgcacatttactttaaaaactcaacttcataattgcatgaaacccgatttctgtccacctattaaggccacataatgacttccttttttttttttttttttgagacagagtctctctctgttttccaggctggagtgcagtggtgtgatctcagctcactgcaagctctgcctcctgggttcacgccattctcctgcctcagcctccctctttttttttgttttttgttttttgttttttgagacagagtctcgctctgttgcccaggctggagtgcagtggcgccaccttggctcaccgcaacctctggctccggggttcaagtgattcttctgtctcccaagtagctgggattacagccatgagctaccacgcctggctaattttgtatttttagtagagatggggtttctccatgttggtcaggctggtctcgaactctcgacctcaggtgatccgcccgcctcggcctcccaaagtgctgggattacaggcgtgagccactgcacccggccagtgacttctttttaagagaaaaatgtgctggtaaggcaagctgatgaactagtgcttaggaaatgtggatggtgacccactccaggaaatggccactgaaacacaagggtgacacccacaagtgtgtgtggcacagtctctccctccatggtcagtgggagtccctgacactcgtgggagactggccatgggctggggtggcagcgggatgtgtatggcgtggggtccatgagagtgcttccacctctccatcaccctgctgtccatcactctgctcccagccaggaggagctctgggcctgccgggacattgcttgggaggcggcacagcattgtaagatgctccgcttggcacctgcaggctgccactttggggaatcaggcccacagaggggcctccttgcgggcgctcccctaataacacactgtctttgtgtgtccttcccctgatggaggctgtgcctcctgggcagggactatggcttcatggacctggtccatgtttgttgaatgaacgaatgagtaaatggagttaccaacttctctgcatctcacagcctccctttaagatggaaaaaactggagactatttccgagttactggagagatcctgtctgtgttaggaggagtctacttctttttccgaggggtaagcgttccttcccacattgtgagtttccattatcaccaaaacaaaaagccaagaagatccctcagcgctcactcactttttaattcatcagacacatcatagccctacttggggagctgagagacgcagaggtgaagatgagagcccttcagtcagtcaccgcggggcgggagggtgctcagggcgtctccacaggcccaaggcaggcaagcttgaaagtagacactccagccactccacggaacggagtatttgattacaggggcagagtggaggcctcttaagtgataggatcatgactggtagttttttaattaaaccaatctgttaaagctctgagcagtgaaggaaatctccttgcatactggaatcttttttttttttttttgaggtggagtttcgctttgtcatctaggctggaggctagtggcacgatctcggctcactgcaacctccgcctcttgggttcaaaaaattctcctgagtagctgggattacaggcgcctgccaccacagccggctaatttttttgtatttttagtagaggtggggtttcaccatgttggccaggctggtctcgaactcctgacctcaggtgatccacctgcctcagcctcccaaagtgctgggattacaggcgtgagccaccacaccagcaaggaattgttttatttttaacctgaaactcaaacatgtgcaatccttggccattttttttttttaatgcaggagtaatcttttctttgaatgtgggactcactgtttcagattttacatcacctttcttgcaaaaaccatatttatataatctaagatttctagtttcagcttctttaaagaagagtgagaacttagctgcgtacaaaaaagtctgaatgtagaatttgagatgatcattggtttttgtttttgttttttttgactctggaaacccttgtagtattttaattttaatttttataagatggggtcttgctgtgtcacccaggctggagtgcagtggcgtgatcatggctcacttcaacctctgtctcctgggctcaagcaatcctcccacctcagcctctggagtagctggaactacaggaagccatcaccatgcccaggctccactgtgattttttttttttttttttttttttttttttttttttttgagatggagtctcactctttcgcccaggctggagtgcagtggcacaatctccactcactgcaagctccgcctcccgggttcatgccattctcctgcctcagcctcccgagtagctgggactacaggcacccaccaccacgcccggctaattttttgtatttttagtagagacggggtttcaccatcttagccaggatggtctcaatttcctgacctcgtgatccgcccaccttggcctcccaaagtgctgggattacaggtgtgagccactgtgcccggccccattgtgattttttttttttctgagatggagtctcgctcagttgcccaggctggagtgcagtggtgtgatcttggctcactgcaacctccacctcctgggttcaagcgattctcctgcctcagcctcccgagtagctgggactacgcgcgtgtaccaccacgcccggctaatttttgtatttttagtagagacggggtttcaccatgttagccaggatggtctcggtctcctgacctcgtgatccgcccgcctcggcctcccaaagtgctgggattacaggcgtgagccactgtgcccagccttctattgtgatttttatcccctagtcttttttggtataagctctatccagttttttttttcagtcactcacctttatggaattgttctgtcattgaacttcgtcttcacagagacaactgtctttcttttcacactcatggtttacattacagtaaagtacagtgccacagtagcaagtgtggctggaatggcaaaagcaggattggcctgtgggagggagcagaagggtggtggtgtcttggacaggactcatggctgacagtggcggcttgttacaagaatttttattttaacgcttacttaaaattaagaaaaaaatatgctcggcatgtgaaaaattaagaaaaaggtggctcacgcttgtaatcccagctacttgggaggctgaggccaggagtttgagaccagcttgggcaacatagtgagactctgatctcttaaaaaaaaattaggaaaaagctccaattagaagaaaacaatttgcccaattcaatacagcaactgataacattttaatgattttccttcttgtctgtacttctgggtatagttgtaaatccactgtgtaatttttttttttttttttgagatggagtctcgctgtcacccaggctggagtgcaatggcctgatcttggctcactgcagcctctgcctcctgggttcaagcgattttcttgcctcagcctcatgagtagctgggattacaggtgcccgccaccacgcgcagctaattgttttgtatttttagtagagacgggatttcaccatgttggccaggctggtctcgaactcctgacctcaggtgatccacccgccttggcctcccaaagtgctgggatgacaggcgtgagccaccatgcccggcttccactgtgtatttttaaccatctctactgactgggccacctagtgtcaccccattggcctgacccttgctgttctgctcttttcacaatctgtgctttcacacattcgaccaccccatcatggtgccatttaggaagcatctgagtgctcaccatttagccacatcgagcattgcctgggatcttactctctctgtttacctgcagattcagtatttcctgcagaggcggccgtcgatgaagaccctgtttgtggacagctacagtgagatgcttttgtaagtgacactttgactcattcccagtccagtccccaggtgaccgcaatcagttctcacttgaggtctcactcacgccgggcctggcacatagtgggacctcagtgaacatgctgagggaatgacggaaggcactgaatacatactcgggggatgaatgaatactgagggcctgctctgtgccaggggccagggatcgagaaactgccgtgacttacagtccgagtgagacggaccttgttcaccttcccactcattgtccatccatctgccgttcgaggggttggccctggaatactggatgaaacagacatggcgcccgcctttggggagtttcctatctttaacggggggttgtgcgaccttggcactgttgatattttggactgggtagtgcttagttgtggtggttggggggcggggcggggcgggggctgccctgtgcatcgtagagtatatagcagcatcaccggcctctactcgcagctgcctggagctccccatcccccagtcgcctggagcttccccatcccccagtcttgacaatcaagaacatttccagatatggccaaaggcccctcacttgttttggggggtggtgccggaatcactcccggttgagaaccaccgctttaggaggaagcagatgagtgaaagcacagttatagaacagtttggatggccgggcgcagtggctcacgcctgtaatcccagcactttgggaggctgaggcgggtggatcacttgaggtcatgagttcaagaccagactggccaacatggtgaaaccccgtctctactaaaaatacaaaaattaggcaggcatggtggcacgcacctgtaatcccagctactcgggaggctgaggtgggagaattgtttgtacccgggagacagaggttgcagtgagcccagatcgcgccattgcattccagcctaggtaacagagcgagattccatctctaaataaataaatagaacattgtggatgtggcaggaaacctccttccttcagaaagtaagccagagcctcaagccccagtgtgcaccgagggccttccaggacctgtctcctgggatctcggctcacagtccccgtcctgatctcttccttcctggaagaacaaggaataatttcaaatcctcttgcagctagcttgtccgtacgactcacaaaccgcatcctttaacccaatttttttttttggacaagtaaaactagaattagctttatttaacatgattgtgaaaggaacacttattttaatttttttaaaagaatttagatttcagggtacttgtgcaggtttgttaggtgggtatattgtatgatgctgaggtctgggggtctaatgatctggtcacccaagtagtgaacatagtacctgataggtagtttttcaacccttgtccccctcccggcttccccacttttggaatcctaagtgtttgttgttcccgtctttgtgcttgtgggtgcccagtgttttgctccacttataagtaagaacatgtgggatttggttttctgtttctgtgttaatttgcttaggataatggcctccagctacatccatgttgctgcaaaggacgtgatttcattcttttttatggctgcatagtattccatggtatatacgtaccactttttgattatccagtctaccattgatgggcacctggattgattccatgctttgctattgtgaatagtgctttgataaacacaggagtgcaggcatctttttggtagaatgggttcttttcctctgttttccccctaatcttgagatacctatactttagccccgaaaggcaaactcaagaggcaaggtctgtaggtttaccacactgatttacctgcctaagagaagcagttttctacatagcattgtgattctcctgcctcagtgtccccagtagctgggattagaggggtgcaccttgcccaggtaattttcatatttttagtagagacagggtttcactgtgttggccaggctggtcttgaactcctgacctcaagtgatctgcctcccaaagttctgggatgacaggtgtgagccatcacgcctggccactatatatccttttatgtactttttatttatttatttgtttatttatttgtttatttatttatttgagacggagtctcgctctgtctcccaggctggagtgcagtggcatgatcttggctcactgtaacctccgcctcccgggttcaggtgattctcctgcctcagcctcctgagtagctgggattacaggcgtgcaccaccatgcctggctaaatttttttttgtatttttagtagaggtggggcttcaccatgttggtcaggctggcctcgaactcctgaccttgtgctccgcatgcctcagcctcccaaagagctgggattaaaggcgtgagctactgcgcctggcctttaggtactatatttatatctgtgctttatacataaagagtgagattttgcacagctcctcaccaagccaatttctgctccttggggacgatgctgcttccacggagaacgcctgggctgaaagagtcaggacagcccaaccctagctcctattgcggcctgcagtctggacctctgagcggcctgtgaccttttgttctgggggtgccaggcctcctgggttcccgtagacggagctttctgcccctccacccgcagctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaaggtgggttccctgggccccagtgggtctcctcagagcccgcttacctcgtggtcatgtgagatggggccaagaactccgcccatcctctctgtcgtgcctgggaaggggctggtttaccccccagcctattttccaagaatcaagcaatctggccctgacccaggtatgtgtaggggggtcccctgaaacctgaccccccctgcacaccaggcctccatctcccgaccagaacaaaggctatgggggaagggtgggtgactccctcatgacccctgagctgagaaccagcaaagcaaaccgccctgcacgttctcaagacgcatccccaggccgatgcggcccggcccttccctcagctcctcctgggcctggcctcggctctgatgagcctgctgtctcctgcagatgatcctgagagacctgtgccgtttcatgtttgtctacatcgtcttcttgttcgggttttccacaggtaatgagcttggtcagcgctgggggagggcaggggtcctgcttggctgagccttctgaagactctgccaggagctgaatgagaaggcactgggtaggcaggtgcatgtctgcaggtgactgagagggtggacagaggacacactgaaatgagctccaggacttggccacgtgttatataaaatgctttaagaattttccaggctggaagtgctgtggctgccacatagcattttggctcagttgttttttcaacttttttttttttttttttttttgagatggagtctcactctgtcgccaaggctggagtgcagtggcacgaccttggctcactgcaacctctgcctcctgggttcaagcaattctcctacctcagcctcccaagtagctgggattacaggcgcccaccaccatgcccggctagtttttatgcatatatatatatacatatatatatatatatttttttttttttctcatacagagtctagctctcttgcccaggctggcgtgcagtggcgcgatctcggctcactggaggctccgcctcccgggttcacgccattctcctgcctcagcctcccgagtacctgggactacaagtgcctgctaccacgcctggctaattttttgtatttttagtagagatggggtttcaccatgttagccaggatggtctcgatctcctgacctcgtgatccgcctgcctcggcctcccaaagtgctgggattacaggcatgagccactgcacctggctagttgttatatttttaatagagatggggttttaccatattggccaggctggtctcaaactcctgacctgaggtgatccacccaccttggcctcccaaagtgctgggattacaggcatgagccacagtgcctggccattaattattttttgagacagagtctcatgctgttgcccaggctggagtgcagtggcgccatctcagctcactacaacctccacttccagggttcaagtgattcttgtgcctcagcctccccagtagctgggattacagatgcccgccaccacacctggctattttttttttttgtatttttagtagagacggggttttgtcatgttggtcttgagctcctgacctcaagtgatctgcccgcctcggctcccaaagtgctaggatgacagggtgagccaccgcgcctgaccttagtcttctttaatccagggcacttcctgcatcattccttgtcatttgcgacctcagaatttgtaatgagtagaggccagtggttttgacaatgtttctcaatttgggtgtgtctgatgtttcctcacgattatagccaggcatgcatttttggccagaatatcaagaagccatgtgtgtcttctgctgtgtgttttattgggagtcacatgatgtccgtctcacttctggtgacgttagctttgatgacttggttttggtggatctgccagacttttccactgtaaagctactatatttacctttgtgatggatacttttcaaggagatgctttgaaactatgtgactagcctgtttctcatcagactttcaccaggagttctagcatccgttgatgagtcttacctgaatcacttcatcctgtgatggtggccaaatgatgatttttttttttttcttgagaaggagtctctgtctgtcgcccaggctggcatgcagtggtgccatctctgctcactgcaacctcggcctcccaggttcaagcaattctcctgcctcagccttccgggtagctgggatcacagctgcccatcatcacgcccggctaatttttatatttttagtacagatggggttttaccatgttactcaggctggtctcaaactcctgacctcaggtgatccgcctgccttggcctcccgaagtgctgggattacaggcgtgagccaccacacccagagaagatgatcttctaactccatcattgcttctgcatttattacctggcattctgttatagagaagagctaaccattccccatttctatgtatttgtttgtatcagaatggcctcatggagtcttttgttttcatggattctcactttgttaaatgggttataatccttactatcctcttttattttaatactcaaattgtctgagattagtcactggagtcccttccagctggctcctgtgctcttttcacatgtccacatcttttttttttttttttttttttgagatagagtctcgttctgtcgcccaggctggagtgcagtggcgcgatctgcaaactctgcctcccaggttcaagcaattctcctgcctcagcctcccaagtagctaggataatcccaacctggctatttttagtagagacgggtttcaccctgttggccaggctggtctcaaactcctgacctcaggtgatccgcctgcctcagcctcccaaagtgctgggattacaggcgtgagccaccatgcccggcctccacatcattttttgagcactggactctgctttgatgctcatccgagtcccacagttacgtggttcacatggtgcaccctccctgtccccaccctgccgtttgcgttggaatccctggctgggagggatgggcacctgtgactaagaaagacctaataggtgtgggctctggcacctggatctgaaggccctgcatttcagtaggtacaggaagggactaggccgggggggtttgtggatactgataggcagcaaccacgatgcacagctgctgcagaggctctcaggctctgggccacacttcccacagaagcaggcagcatgtggggagaggtcattctgctctgagcggctcagtgctcatggagcaaaatggacctctgagggatgcaggccaacagggtgtgatggacaaagcaggtgtggggccagagctgacacgtatggttaagcaggttgtgcactgtacaaaggtggctgtattcacattgcacatagagacttatatatttatttatttttctagcagatgatgataaagttcttaaaaatatactatgaaaatttttttgatagttttaaagaagggatgctttaaaaataacttgtcacaaagttatttgagactgactgagcaggagggtgtatgtcaggggacttgggatattggcttctatccagtggcaccccgccctccctgtgccctgtagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcaggtgggtgggtggagttggggggtggtgagtggcgcggagagtgtgggcggctctgtctgctgtcttacacagctggctgcaggtgggtgggtgggggggggcggtgtgtggccaggagggtatgggcctctctatccgctgccttacccagctgggcacatgagccctgcaggatttgaggagggagcagaaagcccggccaggcccggggatccagcctcagcacctccctcagtggacttccagcaagttcccctgcccagcacctgctcaggggcagatgagctcagctggtgtttatagacaccgtgcttggctgtggtctgggtggtcctggagggaagaagggggagggctcagcccgacagggtgtccacctcagaggagcctggtgtaaggtgggcaccagaggccagactcaggggagcagctaccatgaggcagggccctgacagctacatttctggccccgtgggccacatctgcatccccaactactaataataagtttcgttcttatgaagaagcactttctctgtgatagggactgtactaagtgtctgtctcacctgatctcatttaatcctcacaacagtcctgtgaagtggattctattactgttcctttttttttttttttttttttctgagatggagtctcactctgtcacccaggctggagtgcattggcatgatcttggctgactgcaacctctgcctcccggcttcaagcagttcttctgcctcaacctccctagtagctgggattgcaggcacccaccaccacacccagctaatttttgtatttttagtagagatggggtttcaccatgttggccaggctggttttgaactcctgacctcaggtgatctgcctgccttggcctcccaaagtgctgggatcacaggcgtgagccactgtgcctggctatactgttctgtttttgaatgaggcactgaggcgtagtgaagttaggtatctgtgctcaaggccacatggctggtaagtggcagagccaggacctggcccaggcagtctcactcgtggccctgctctcagccctaccctatgttgccccttgtgagctcctcagggcagggtctggggcctccgtatcactcccggggctgccctgcccaggcccggcaggcaccagtggcacctggacaggtctgggctggctgggctgtgccccttgtatacagtgtacccccgccaggctacagaaacaaagctagcgtggagggcactggacaaccaccctggaggcatctaggcctgggagagcccctggggagctggatactggcagccagggtggccccgggatgcaccctctgcccctcagctcctctacccttggtgtcttcctgcagagagccatcaccatcctggacacggagaagagcttccttaagtgcatgaggaaggccttccgctcaggcaagctgctgcaggtggggtacacacctgatggcaaggacgactaccggtggtgcttcaggtaatgcccaagctccacctgaatcagggcttgggagctttggggctcccctgtggacacagagcctgcctcagggcctccatgaggggctggtcatgagcacagggggctctcccaatgccagctgtagggattggggccgtcctgagctcagctgtgggcgtgcacaggggaccatcttagatctcatctggtggggcccagacactaaattctggaaaattcgaggtgtccagaaggggccgtctagtgagcagcgtcagagcctggcatccaatatgtgaagtccccctgggcctcacagtgtgctcagagatcacatctttgaggatggtgtccaaaaatcaagtcctctctgccctccccgacccaccacatctccatcctgatgggtgggcttcttgggcttggcctgtgggcagagcccttggcccgggaagctgggcacagctctcaggctctcccgaccccttaccctgcagggtggacgaggtgaactggaccacctggaacaccaacgtgggcatcatcaacgaagacccgggcaactgtgagggcgtcaagcgcaccctgagcttctccctgcggtcaagcagaggtgaggcgtgagggccggtgcttggcgcctccttggctggtggcctgatgttgggcagggggagctttgcaggttccccacgccttgccgggttcctcatccccccaggacccgggcgctgtggcagctcctgacgtcggccatgagcacatagtcacgggctgacttgagcacctcactcatgctgtcacggctgacggctgatggctgacggctcactgggcccgtgcaggcggctgtgccagcacctccagcccaggcacctgtcctcagcgccccaggggacgcagcccagccccgccctgcctccttgtatgggctgccctgcctcctcagccctgttcctcactctgcacgtgtgcatgcgacgtcctagctctgagaggctgtgcggacacaaacaggcagacgggaacacttgtcactcatggacacatctgggcaggtggagaagaggggagggtgagaagaagaaaggggatgccttgagcagaaaaaccccaaggaggccgggcacagtggctcacgcctgtcatcccagcactttgggaggctgagacgggtggatcacctgaggccgggagtttgagaccagcttggccaacatcgtgaaaccccatctctactaaaaaaaatacaaaaattagccaggcatggtggcaggcacctgtaatcccagctactcgggaggctgaagcaggagaatcggttgaacctgggaggcggaggttgcagtgagccgagatcgcaccactacactccagccggggcaacagaacgagactctgtctcaaaaaaaagaacaaatagaaaaaccctgagaaaaattactaccagaaagaaagctgtttaacagttactggtaaacatttaatagaaaacattaaataaatgtctaattgaggacgtttacctagaaatgaaagaggcatagtttatagtggacaaattttgagttataattacaaccctgaacactttgtttttgaattactttgtatttaattgtaaaaaattgtggtaaaatatctatctcctaaaacttgccatttaaatccttttgaagtgtacagtttagtgtcattaagtacatttacattattgtacaacactcaccactatctatttccagaactttttttttttttttcctgagatggagtctcactctgttgcccaggctggagtgcagtggcgtgatctgggtttactgcaccctccgcctcccgggttcaagcgattctcctgcctcagtctcccgagtagctgggattacaggtgcctgccaccacgcccggctcatttttgtatttttatagtagaaacgggttttcaccatgttggccaggttggtctcctgacctcaggtcatcccaaagtgctgggatgacaggtgtgagccaccatgccgggcctttttccagaacattttaatcatcccacacggaaactctgtgcccttaaaacaactccatgacccctccttcctgaccgcttggcccctcctccctgaccgcttggcccctcctccctgaccgcttggcccctcctccctgaccccttggcccctcctccctgaccccttggcccctcctccctgaccacttggcccctggcccctaaccccttggcccctattctgttttctatctttatgaaagtgggacagagacgttaaaggttgagtagtactgggggcctcagaggcccagagaccttcttaacaccctttaaatactctgagccactctctgatcaccctcatgcagtcacaccatgagctagcacagctcagctcttagcaaggacctgtggggaactcatctgccccaaagacttctgggcttccacccccatgaatccttcctcctcttcccctgtgctctgatccacagattctagctgcttccgctgcccagcttttgatttcttcttctttaactcagaggcaattccatgctcttcttagactgcagctcaccgcgttgtagttggggaaatgtccctaggcagaaagttagggagatcacagggctccccttgtgaatttcacttctcttgggaattgcagtttttatttattttattttatttttgagatggagtcttgctgtgttgcccaggctggagtgcagtggcacgatcttggctcactgcaacctccgccttctgggttcaagtgatcctcccacctcagcctcctgagtacctgggactacaggcgcctgccactatacccggctaatttttttttttattatactttaagttctagggtacatgtgcacaacgtgcaggtttgttacatatgtatacatgtgccatgttggtgtgctgcacccattaactcgtcatttacattaggtatatcttctaatgctgtccctccccactcccccaaccccacaacaggccccggtgtgtgatgtcccccttcctgtgtctgagtgttctcattgttcaattcccacctatgagtgagaacatgtggtgtttcgttttttgtccttgcaatagtttgctgagaatgatggtttccagcttcacccatgtccctacaaaggacatgaactcatcattttgttatggctgcatagtattccacggtgtatatgtgtacacctggctaatttttatatttttagtagagacagggcttcaccgtgttggccaggctggtctcgaactcctgatctcaggtgatctgcgcaccttggtctcccaaagtgttgggatgacaggtgcgagccaccgtgccttgcctttttttaatgtttaattttaaaaaatctttagctgctaagttggtgttatttgagggactgccgtttttcactgcctgatgtcctatctctgaaaaacgtttgctgcctgtatgttgcctattttgtgatcgttgacagcacgatggctagcccagtactagatactccattatagctggaagcgaaaatctattttatcaaaggctcatttttagaaaactgctcgagggttccattggtttttccacaggcctcctgcgatcgtgtgattttcctgtgagtttagttggaagcaatccctgcatcctgtaataatgcttattgatgatctctttgtcagttgttaactggtctaactttgccagagagctattgaaagatagctttgcgtgtgatttgagtagtttttcttttcttttcttttttttttttttttgagacggagtctggctctgtcacccaggctggagtgcagtggcgcaatcttggctcactgcaagctccacctcccgggttcacgccattctcctgcttcagcctcccgagtagctgggactacaggcgcccgccactacgcccggctaattttttgtatttttagtagagacggggtttcaccatgttagccaggatggtctcgatctcctgacctcgtgatccgcccgcctcggcctcccacagtgctgggattacaggcgtgagccaccgcgcccggccttgagtagtttttcaatgtcactcttgttgatttagtgacatcctacatctttgacaagatttgctatttcacttggcagttgatttgtattatgtttgcatgacagtgttggcggtttacaacactgcacattcactgtgatatttataaagacattgacccagtggcaggggtatacacacccatgttaactggggcagggatgggggatggttggaggttgcctgatgtcacctttataatttttttcttttttttttttttgagacagaatcttgttctgtcgcccaggctgtcacccagtgggcctggaccccagatcctgcctctttggctggtgctcgtcacccagagctgccctggtgttgagccactcacaggacaggcctcggcgttgctctgtggagaccctctctccctcccgctggggcagggaggagatggaggccgagaggggcaggcgatgggctctcctgaggctgcaagcaagtcggggtgggatggaggaagagaatttaaggaacagcgagagtgcatgaggctctttgagtagttgagggaggaggacattgcaccgatccaggtgcctcaggaagcactcgcatgcctgggcctcgttttttctttctttctttcttcttcttcttctttttttttttttttttttttgagacggagttttgctcttttcgcccaggctggagtgcagtggcacgatctcggctcactgcagcctgtgcctcccaggttcaagtgattctcctgcctcagcctcccaagtactggggttacaggcatgtgccactatgcccggccaatttttttttttttttttgtatttttagtagagatggggtttcaccatgttgtccgggctggtcttgaactcctgacctcaggtgatccacctgcctcggcctcccaaagtgctgggattacaggcatgagccatcgtgcctgtcttggacctccttttatctggagacttgggaggccaagaagtgaatgtttgttttgttgcatccaaggtagtaatagtgttacccttcagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtttggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacctctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacatatatatcgtgtcaagtgtaaagtttgtggcaggaaatgggctggcatagctaattggctctgtgtaggctgcttgtggatgcgtgtgtatacacatgggggtgtgtgtgtgggtgtgtgcatgcatgcatgtttgtgtgtgtgtgtgtacgtgtgtgtacattcctatggttgcattcctgctataatgcagaagggaatagttgcaacagagaccaaatagtttgcaaagcctaaaatataagcttacctaaaatataaaaagcttacctaaaatataaaaaacatactatctggccctttacagaagagtttgctgactcttcctttgtagaatagagcttaagaaacagatactctgctctccctctccctctccctctccctctccctctccccatggtctccctctcccgatggtctccctctcccgatggtctccctctccctctctttccacggtctccctctcatgccgagccgaagctggactgtactgctgccatctcggctcactgcaacctccctgcctgattctcctgcctcagcctgcccagtgcctgcgattgcaggcgcgcgccgccacgcctgactggttttcgtatttttttggtggagacgggtttcgctgtgttggccgggctggtctccagctcctaaccgcgagtgatccgccagcctcggcctcccgaggtgccgggattgcagacggtgtctggttcactcagtgctcaatggtgcccaggctggagtgcagtggcgtgatctcggctcactacaacctccacctcccagccgcctgccttggcctcccaaagtgcaaagcttgcagcctctgcctggccgcccatcgtctgggatgtgaggagcccctctgcctggctgccccgtctggaaagtgaggactgtctccgcccggccgcccatcgtctgagatgtggggagcgcctctgccccgccgccccatctgggatgtgaggagcgcctctgcccggccacgaccccgtctgggaggtgaggagcgtctctgcccagccgccccgtctgagaagtgaggagcccctccgcccggcagctgcccctactgggaagtgaggagcgtctccgcccggcagccaccccgtccaggaaggaggtgggggtcacccaccgccaggccagccgccccgtccgggagg

SEQ ID NO: 15798 - DNA, 16374 bp, Human; identical to SEQ ID NO: 14792

SEQ ID NO: 15799 - DNA, 16374 bp, Human; identical to SEQ ID NO: 14792

SEQ ID NO: 15800 - DNA, 16374 bp, Human; identical to SEQ ID NO: 14792

SEQ ID NO: 15801 - DNA, 16374 bp, Human; identical to SEQ ID NO: 14792

SEQ ID NO: 15802 - DNA, 16374 bp, Human; identical to SEQ ID NO: 14792

SEQ ID NO: 15803 - DNA, 16374 bp, Human; identical to SEQ ID NO: 14792

SEQ ID NO: 15804 - DNA, 13117 bp, Human
  misc_feature (1)...(13117): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcccgccttccccgagcgcccggctccgatcccgcctgctgtccgctggccttcagggtggacccgttcaccgactacggctcctcgctcaccgtcacgctgccgcccgagctgcaggcgcaccagcccttccaggtcatcctgcggtacacctcgaccgacgcccccgccgtgagtccggggcgggcgccggggctgcgggccggtccgcagggcgctgctagcggcctctcgccgcacggccaggctgagggacgcgaatctgcgccctacaggtgcccccctccccccaccccggtgattcccagctgttgcctgtgagcccttaggaccctcggatagaagccggagtcctgcggggacacgggacagcatgtcactccgggaagcctcccgttcaggtgtctggtccctgcctggggacatgagcagcttctgtcacccaccgaggtgtacatctgcaggatcctggcaccaagggttgggctggagtgtcagctgcggaagggcctccatgtgaccagtgcgtgcagatgagtccaagccagaggcagaggaaagggccatggagattgtgatgctcggtttggggcttccttggccagcactggtggagtgttgagaccagtgggccccgcgaccccaacatagacacacataggctctgcagggcttgcacactgggtacccaccactccagagactctgcaagaaaggccaggtggctgaggctggcgctgtggctgcagcaccccctccacctccaccagtggggatgtgtacaggatggagcagggcctttcctgcctacagcatgggggttcatactgcatccctaggtggtatggacggcacacatgtgacacccgacatatgcaagacacacacagctgtggaggcgctgggaagtccagctgtcactggtcacggcacataaatggacagggtggtggagaggtggtcgagaggcttcaggccacaaagagccaaggtgacatctgggcaggaagaacccagaccagtgcacccctatgggcttcctgtacatttcccaggagccctaagcaggacctgccacctcacctttttcccagaacccctgtgggtgtgcaggccgctggctagccggccccgcccctgctgtggtattccagggctctgaccggtggcaagtatgcctcccagtatgacaggtgagaactgagggatgggcttctccttggccttgatccgtgtttggagcccacgtgtctggtccgcccaacactggcctgcagagtggccggaccagggccctcagcaggctgctgtgaacggggcccagtgagcaagggtggccattgtctcttggcttcctatggcctactgggtggcccttgggtactctgggcagggagagtggcatagtcccccaagtctgcgtggtgtcagggttggcaggctgtggacagggggcctagcgtcacctggcctatgagccgccctacttgcagaaggcagagtattcgactctaacctcaggcatgcacctttgtatgtgagcgccatggggctggggccacacgtagagtccccttctcttcctgcatgttccagggactcaggcccaaatccctaagcctgtccctgtgccagggaggatgcagcggaagctccctgggaggccctgccagtgggccccaggcccccagaggctttttggaggtgctgcagatgcttgggcccattcccgcacccccaccccaccccagcaagaacagcgttcttcctgccctgcagcgtctggagcccttcagccttgttccttttccaccagcccatcagcacctgtgcccgggtgccctgacggggattggtgccccatctgtggggcagggcctgtcctgtctgggggtctgccccagcccctcacttcagggcaagtggggagctgtgggccctgctggtatctgggaagacacccaggctactgaggctgtggggtggacatggggcagtagggagaggtgtgagtgggcagagcctgagaagggcctcaggagggtgaggcaaggccacaggagaggagtagttgtgagggggccgtgcaggctgaagggttggggagactcctgcagggaggttccttcatacagattcccaggtcccagccccccccaagggggaggctgcgtttgtgaatggctccccaggtgggccctgaacaccctggcagcccagggctcagcaggaatgggagacgcctgtgctaccttgctgcccagcagggccagggcaccaacaggaagtttggaagagatctgagaatgctggcaggggtctggccgggactgcgggggaggcagccctcctggtctgggatcctccaggcctcagctgtggattccacttgtccagtcttagaagcatgttgggggcaccttctactcatggtcatgggagggcctctgcacgaagagcaattcagtttgccttgactatctcattccggcagaggggagggtggatacgacgtgcagggctgacttgggacgaaggtgatgtggctgtggttggaagagggtccccctcccagactctgagctgccctcactggagaggtcagaattcctggaaggaagatgagacgggtgcagcaggatagtggcaggagggccccgggtgtgcaggcttctcagtggggctggggcctggcctcggcatctaggggtgaggaaagcctcaacagctttggtgcagatgagaggtttgccgggggggtgaccttaggtgggtagcagctgctgtgagcgcacccattccacagcactcaccgcagcccccggcctccaggcagcggccccagccatccttcccttggccgctcctgtcccctgccagcagggtcctctggcctggcctccactccctgcttgctgtcccctggcttggagcctgtctcttgcagggtccctccaggcgaggctgcctgggctcagggtggctctgggcccgggcgtgctgcctgctagtgcgtagccatcaggaggctctggcttcccaggttccacatcccagcctccttttcctgaccatgaccaaatcaactgctgggaatttggactgagtgtgtccctactgtgcctcagtttccctatggaagctaagataatgcaatgatgggctattcccttttttcgccttggcgttagctgggagatgcccccatcggctacctgacacagggcctcctgcctgggttggggtctggccctgatgacacagtgcaggccacaccctgggtcacctgccctggatgtctccctgcccaggcaggcaagtgaaggctaaggggtggctattggccctcgaacccagcaagataatctggccattgtcccctcccagagcctcctgccttctctcaggctgctgcccagtggctagggcccagcaccctagctgggtggccgtctgctgatgggccatcctgcccacagatctggtggctggacccagagctgacctatggctgcgccaagcccttcgtcttcacccagggccactccgtgtgcaaccgctccttcttcccgtgcttcgacacacctgccgtgaagtgcacctactctgccgtcgtcaaggtcaggggccgccagctgccgtcaccttgctcccaggacagcccagtggcctggccacgccgcctcccacttgctcctacctgcctgggctgtggccccagctgccagcaggccacagtgctagcaggagcccaccctccctactctatgggaggagccgctttgcagggaacgggggaagccgggctgcctccaacgggcctgaggggtcggggtcctggacccggggtgagtccccagtggcactgcagggtccccagacaaggggtctcccgacagagctgctgatctccagtggggtctgtgggtcaccgggcccgaacttggcagcaccctctgtgctgggacgaggtttgcaggctgggagctaggggttccgaatggagggtggcagttcttcggagagaagttctctgacagaaacgttccctgatggggatgtagggtttcctgctacgaatatggggctgcctgacaggctccccggcctgggctatgggtgtgctgacggtggggccacccggtctcagtccggcctccttacaggcgccatcgggggtgcaggtgctgatgagtgccacccggagtgcatacatggaggaagaaggcgtcttccacttccacatggagcaccccgtgcccgcctacctcgtggccctggtggccggagacctcaagccggcagacatcgggcccaggtagggcctcctgctggggccttctggggctgcgcaggcctcggggagagccccaccgggggtctgtggcctgtgtccacggctgccctgctgaggacccccactggcctctgggtgctctgggccagccctgcccctgccttggtgccaccgccagggccctgccacccatgtgccctcagacccggcagcctggcccacccagtgcctgccctgcaaactggtccttcctgccaaggcccccgcacagcctggcaccctcataccttcgttggtcccttcagcccagagataaaatgagctaagtggcccctggaatgcagctctgccctgctgtgggaagggccagggtggctgcccatccagtgaggcagggcgggctgtaggctggggtggtcagccaggctgggtgaggtgtgggtgttactggagccccagggcagtgggagagcctggtggggtgagcggggctggggctgctcggcctcagctcaccctctctgcatgcaccaggagccgcgtgtgggccgagccatgcctcctgcccacggccaccagcaagctgtcgggcgcagtggagcagtggctgagtgcagctgagcggctgtatgggccctacatgtggggcaggtaggccccggggacctgtggacctggctggctggaaggaggagtcagagggggagcccctcgtctgacccctggggtgtcctgtccccatctcctggggaggaagcggagctcaccgcaggggctgggctgatccctgctgggtggaaggtggggtgcgggtgtgcagggtgggagtctgagccccgaggtctgccaccctcaccgccctcccggtgcaggtacgacattgtcttcctgccaccctccttccccatcgtggccatggagaacccctgcctcaccttcatcatctcctccatcctggagagcgatgagttcctggtcatcgatgtcatccacgaggtggcccacagttggttcggcaacgctgtcaccaacgccacgtgggaagagatgtggctgagcgagggcctggccacctatgcccagcgccgtatcaccaccgagacctacggtgcggccagggccggggagggcagccacggggggccctgggcactggtccaggggcagagagcctagcctggcccccctgccatgctgcaggtgcccacacctcctgcttcccccgacgacccctacaccccctcacctctcctctgtctccggaccccatccaggtgctgccttcacctgcctggagactgccttccgcctggacgccctgcaccggcagatgaagcttctgggagaggacagcccggtcagcaaactgcaggtcaagctggagccaggtacctgctcctcaggacccgctcccacaactggggatgtcacccctcaaggcctccttgcctgcccttcgtgtgttctggctgtggcttctctgtcctgcactgtgcctggacccctgccaaggccaagctgggagcccctggccagggcaaggcctccccaggctcccacagccaccgccgcttccctggctctgagcagcagtcacagtggtgtgtgagtcctcagtcttccccgaggccctgccgctgcacgcccagggcatcagtacacatctggacatgtgagggacagtggcgcttggcccttgctgctcctcggagcctgaccactgcccctccctattccacgggacactggtggtttcggacgccagcccaggtgggtgttcaccttgcaggagtgaatcccagccacctgatgaacctgttcacctacgagaagggctactgcttcgtgtactacctgtcccagctctgcggagacccacagcgctttgatgactttctccgagtgagcagccccctgcccgggacggccctgctgccatctgcccccagcccctccccggctcacagggctgcctgctcttgcggcagttggggtggaactggcaggggcctgtgagcctggctgggacctagtctgcctttctttgtggggagtgcctgggttgccacctccccttctgccaccctgtttgctcccttggcagggcctgcgtgccaagtgctggctccgcagtgcccactagctgcccctgtgcccagcacgtaccttggcgcacgccctgcagtgccctgcaggcctctggtggggctgcctgtgccccacccttccaggcctgctgaggccccacctctgccacacaggcctatgtggagaagtacaagttcaccagcgtggtggcccaggacctgctggactccttcctgagcttcttcccggagctgaaggagcagagcgtggactgccgggcaggtgaggctgacccccaaccctgcagccagggagccgtgggtatgatggcaggcggggcctctgctgcctgaggggccactccacctggaggaaagccctgtcagttcactgtctgtccttcagccaacccttgctggaccatgtgggccccaggctggtatgctatgagaacagggctggggttgggggcctccctggggccggtggcacaggctaagcaggccgagtcaggcactcccaggaagcgggccatggaaaccaggtgtgcaaagggcctggtgcaggaagggcgggtgacgggggtgtcctggagctggagaacagcagccagccctgtttatgtgtcacttgtaaaggtgtccctgagggtctgagggcttggggcccaggaaggcactgcagggttcagacattgagggagaggccagaattgctggagggtggtgaggtgccactgggagggctgtgcatggtgacaccaagttttggaaggtacagcaagtgcatcaagagctttttgtgggtagggaatgggcactgccctttaagagcaggaatatcatcttaagagcctgttgcccccatcccgcccctgctggttcatggcgcaggtggcctccaccagcactgaggttgggtttagactacttcattgtcttccacccaggagaggcgtggagtgggtgcgagtcccttggtcaccaacccaagtctctgcttccctgtaccccttcacagaagccccttcagtggcttcaagtggcagtgctggctggagctgactccgccttcctgaacagcccacgtccctggaacaggccacctgcctggaacacactcagggtctggggtctcctgggcagattgctcaggcagccccttcctagcctgggcagggaccccagggtcacttctcccctctagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcagggtgagtccctgcagctgatgggggcggcccaggggctggggtgcaacagcggcccagccctgacctgccccctgcgctgcagaggtggtgatgagcctgtccaagtgctactcctccctgctggactcgatgaacgctgagatccgcatccgctggctgcagattgtggtccgcaacgactactatcctgacctccacagggtgcggcgcttcctggagagccaggtgcggtcacctgcccagggggccagcctggaacggcctagccgtgcggactgggagtcccacccgactccctagtctgagcccttggggcaggccaggcacattctggagaatggggcggggaagacgtaggggtctgttgggagtgggggcatgcaccgggtgcaggtaccagagggcagcctggactccaccagttcttggagaagctgtggaagggaccagctgggagcaggagtttagggtccaggccaccacagcctgctgggccctgggccttcagcgtcctggtctgggcagaggggacgtcccagctcctcagagggaggccagagccctcaggcccgtgggccctggctgccctgctccctgtatgtgctccctccagcccaggttccctggagatggggcctccatggttggcctggaagggcagggtggaggtgggaggctaatggtaggcctcctggccaccggagtccaggccacagccctaatgatgaagctgggaagccaggggcaggagggccgcctggccgggctggcagggtgggctggctcgaggggcctggggagcccaccagtgtgaccgagtgcccctcctgcagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctagccctgttggcgggctgaccctcgacctcccagacaccacaattgtgccttctgtgggccaggcctgccatgactgcgtctcggctctggccatgagctctgcccaggcccacaagcccctcccctgggctctcccaggcagggagaatggggagagggacctccttgtgtctggcagagacctgtggacctggcctccccactcccagctctcttgcactgcaggccctggggccagcccgcacacaccatgcctcctgtctcaacactgacagctgtgcctagccccggatgccagcacctgccaggtgccgccccggggcaagggccccagcagccctatggtgaccgccacactgtgccttaatgtctgccgggggcccaggctgtgctgtccctgcagcacgcctccttgcagggatctgagccaccctccccgcacagccctgcaccccgcccctagggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgcaaacctgatctcctgcgctctttctcgcgactcttgtcctctgcatcttcctggctgtgtagggtgggctggcctgccgggacttggggcctggagctggtcaggagctgggtgtggccccctcctctgatacataagcccgagagcaggctccccgaatcctgcccagccccttggctggaccccctgggcctgagtagcctctggatgtcacaggaaagccatgtgtcaccttcactctgggccttcacctgtggcttaagccaaatcccggcctcagtggtgatcctttcccaagatgggtacaaggtgacaggcatgttttgttttggagaactgagatttccattttcccaggcgataggtgtcgctgcccttcacagtccccaaggatgtggcgccaccatctcagtgccacgcacacctggccaacatgccgtggcccagaagcagcacgtctcttctcccaacccgctggccaggcccagtcacagccccactccacacatggcagccaggaagtggggagggcaggaggtgctgggcaaataaccctgataccatcactgtccagtccccagtcaccaaatgtcccactcaccctccttcctgttctggatgccccgcccctcccctcccctcccaaggacatatgagtcccctccagtggcggtggcaactctggtctagggtctggggccgtctctacatgtgttgcttcatgtaccttcttcacatcaggtctgggggaggcgccaccccatccagagacctaggaactagaagactgccactgcccctcacacccagggataggatgactgcagtaacccctgtgaaagcgggtgtggagggcacctggcagcccctgctgcatggccatctaaagtcttgccaggcaggcacagctagggcccctgcctgggagtggacaccccactcccccaagtcgtgttctctgtggcctggggctccagccttgggaggacccctttcctgtttcttaaccatgcttgatggtgtcctcaaaggagccctgctcagtggcagaactgctttctcagcctcttccccgccaaggttgttttcaagtcccagcagtcacagactttcatcctgggctcttctttcttttgcaattcagctctcgaaatgactctgtggtctgcgggtgactccactccacgtgcctacagccacgcccacagcgccacctccggacgctgctgagctgcgcacctgtgcctgacacctggctttgggaaactcagcagcagtgcccagcgtcatgaccctgggggcaggagggcatctggatccaggatggcaccctcaccacaatctgtcttggctctgtgcccgcccgtggggtacacaggagggctctttcag

SEQ ID NO: 15805 - DNA, 19091 bp, Human
gaccccgtttctactaaaaatacaaaaaaaattagctgggcgtggtggcggacgcctgtagtcccagctactcaggaggctgaggcaggagaatggcgtgaacctgggaggcggagcttgcagtgagccgagatcgcgccactgcactccagcctgggcaacacagcaagactccatctcaaaaaaagaaaaaaaaagagcgagactccgtctcataaaaataaaaataaaaataaataaaaaatagcaaaagactgaataggcactttataaaagaagacatacaaatggccaatcagcacatgaaacatggtcaatatcattgatctccagacaaatgcaaatcaaattgcaatgatgtgcccacaacacccattaaatggccaacgctaaagactgacaatatccaacgttggccatgccatggaataactggaaccaccatacactgattttggaaatctagaatggaaaaaccatttagaaaaaaatcgtttggcagtttcttataagttaaacacacactgatatgatcgaacaactccactccctagttacccaagataaaggaaaactatccacgcaaacttacaggaatgtttacaggagctaaaacaatgggcaaaactagaaacccacatgtatatcaaaagagaaaaataaatctgctttttaaaaaagattgaaatatcttgtattttaatacccgaaaaaattttatttccccctagactgccaattccagctgagcaggctctctaaccatcttatttactaccatactctcaatttctggcacggagtaagcgcgcaataaatgtttggtgaatgaatgaaagaatgcccgctttcatacactaatgggtttgtagccaccacccctcaggccttttacgccctcattccttccaggtacaaacgctatctgggctaggccaaatgtggctcgcagcgggtccgggagcggggcacctaccggcagctcccgcagcggaggcgcgtcccccgggcgccgaggcagcgcccgcggctggaggggcccggggcgggcgccgagcccgagggatgcgcgcagcgcggggtgccccgggaggcagcggccgggcacgctgggaccgacggcgcgggacgccccgacgccgggcagcacttacccgccgcaccgagagagctacgcggccccgcggccctgcagggcacagggcggccccctgcccggggctctcggtggcgcactgggcggcggggcgggccgagggcagcgggggcgggacaggacagacgagaatcccgcggaggtgaggccgggggccgccccgcccccgagggcaggccctgagccccggccccgcctcggccggccccgcctcggccggggcgtgggctccggctgcagctccggtctgctctcttggctccggaacccccgcgggcgctggctccgtctgccagggtgagggggccgggaaggggcgcgcgggggtcccgggtctcggaaatcgggcggggacggaacgggctcgggctgcggggcctccagactcagtcgcacgctcagatttcgggatttctacccccggctgggatcgcgtaacttcctcattcccgcctggacccctgcccccggcccgcctggcctggcgtgagccccgtagccgcgcgctctccggaccacccagggccgcttccccgcgcagctgctgcgccgccccaggtcggagccttccgggcctggctgggtgttccccggggctctggttacgggacggggcggggggcggggggcgggactgggattgtggatgaaggactaaggtaggggatgggggctcgaaggggtcggtggggcgttgcaaactggtcaggcgtcatccgcgggcggtcaggaggccgtgggggaagaggaggatctggaagagatggaggacctgcgggagttaggatggggggcgggttctgcaggacagctcgcctccctgaggcttcccaatgttcctaggatgacggcgacccctgagagcctcttccccactggggacgaactggactccagccagctccagatggagtccgatgaggtggacaccctgaaggagggagaggacccaggtacacagggaagatggatggccctcagggaggagaggcgttcgggagccagggggctggggcctgttgtggtctacactcctcgactttctttcctcccagccgaccggatgcacccgtttctggccatctatgagcttcagtctctgaaagtgcaccccttggtgttcgcacctggggtccctgtcacagcccaggtggtgggcaccgaaagatataccagcggatccaaggtggccagactggccccagggagggggaaagggagggcggcccggaatggatccaaggtggctgggctggccccagggaaggggcaaaaggagggctggccagagtggggaggcggggacccacgcaggggacatccattcagttcctcatacccctaggtgggaacctgcactctgtattctgtccgcttgactcacggcgacttttcctggacaaccaagaagaaataccgtcattttcaggagctgcatcgggacctcctgagacacaaagtcttgatgagtctgctccctctggctcggtgagggcgaccggactgcttcctgtagagggcaggtgctccccaccctcctttctgtctgtctcaccccggggccacaacctttcctccctgcaactctggccactgtgctgcctcccctgaccccagttaccaggaaactttccctgctcagctttccctgtccatggttctgtgccagcatctcagctgggcgggatgcccaaaatgctcttggcagcctcacccttttctagtctccattcccagggtagggggcctccgttttgccagcctctaggccttttgtttgttttttgtttttgttttgtacaaggtctccctctgtcacccaggctagagtgcagtggtatgatcttggctcatggcaacctcctgggctcaagcagtcctcccatctcagcctccagagtagctaggaccacagccaccacacccaactaatttttgtatattttgtagagatggggtgctgctgtgttgcccaggctggtcttaaattcctgagctcaagtgatccacctgctgcggcctccccaagtgctgggattccaggcgtgagccaccacgcctggccacctccaggcctcttcttttcctccgagccccatctccagtgttttcaggaaccagagcacccagcctcccagctcttacctgaccttcatccatcctttccacagatttgccgttgcctattctccagcccgagatgcaggcaacagagagatgccctctctaccccgggcaggtcctgagggctccaccagacatgcagccagcaaacaggtgggaccagatgccaggtcctccgggaaggcattggaggtgcaaatggctcggtcccatctgtctctctctctctctcatctccacttcagaaatacctggagaattacctcaaccgtctcttgaccatgtctttctatcgcaactaccatgccatggtaaggtccaggggccgattttagatgtggagcaggattatcagaccctcggggaggagggccaggggccccagggtctgaggggctgaaagccaggtgtctcctccgggcttttgttttcctctgcagacagagttcctggaagtcagtcagctgtcctttatcccggacttgggccgcaaaggactgtgagtgtctggcccccttcacccaggcatccgtagacatcactcttaatttctccctgcctgagattggggcaagcagtgcagggtgggctgggggtctggagtcctcatcccgcctctcttcctgattgtcccacagggaggggatgatccggaagcgctcaggtggccaccgtgttcctggcctcacctgctgtggccgagaccaagtttgttatcgctggtccaagaggtacgggctatggccaagcagctgggcagtgggtgggggtgaggaagaaaattttgagggcagagaggaacacacggagcccttctgctctaggtggctggtggtgaaggactccttcctgctgtacatgtgcctcgagacaggtgccatctcatttgttcagctctttgaccctggctttgaggtgcaagtggggaaaaggagcacggaggcacggcacggcgtgcggatcgatacctcccacaggtgaggcctccctggggtgagagacaccagctgagtggtgagcccacccacggccttgctgggagttgagaaagagagaccacaggagagaggaaggcttttccacctccctggatcgggacatagttttgaaccaggaactggtctagccagatgcttgggactgctcttagactgggcccagagaaaggggattagtagaagcctgggaagggaactgctgacataaacgaaattccatttgttcatttgttcattcaacaaacccgagtgcctggtacaatactggttgctgatgcaatactaggatccaactatgagtaaggtggatatggccgggcgcggtggctcacacctacaatcccagcactttgggaggccgaggcgggtggatcacctgaggtcaggagttcgagaccagcccagccaacatgctaaaaccttgtctctactaaaaatacaaaaattagccgggcgtggtggtgcgtgcctgtaatcccagctatttgggaggctgaggcaggagaatcgcttgaagctggggtgcagaggttgcagtgagcagagatcgcaccactgcactccagcctgggggacaagagctaaactctgtctcaaaaataaataaataaataaggcagatacatacacgccctatccctgtgcagttgtgattagggactaagggaggaagtgggaaaggggaggtctctaggcaagatcacaggtatggagggcgaggatttatggacatctcatcgttcccatccaggtccttgattctcaagtgcagcagctaccggcaggcacggtggtgggcccaagagatcactgagctggcacagggcccaggcagagacttcctacagctgcaccggcatgacagctacgccccaccccggcctgggaccttggcccggtggtgagacactgacatcccttctgagcttgtctgtggctttcttgaccccctgtgtaatctctgagtccttcatcctctcttttctcatctgaaccctcctgacctcaatgacccgccccgtgacttctttaatcttcctgacctttgacatctttaaccacattgatctctctgatttcgcgccgacctttctgacccccaaacttggtcatctcttctgacccttgacctctctaacctcctataaccttttaaacccctctctacaatactgaccctctctgttctccatgatcttctcaaatctctctgatttagtccttcatttaataaacattttcttttctttttttttttttttttttttgagagagagttttgttctgttgatctcggctcactgcaacctccgcctcccaggttcaagcgattcttctgcctcagcctcccgagtagccgggattacaggcgcccaccaccacacctggctaatttttgtatttttagtagagacggggtttcaccatgttggccaggctcttctcgaactcctgacctcgggtgatccgcccgcctcggcctcccgaagtgctgggattacaggcgtgagccaccgtgcccagccttaataaacatttttctaagcacctagcagtgctggcagtaacacacagtcctctctgggttagggaagtaggtgatcaaatcgtgaaacaatgtgaacttgccgtactggtgataggtagaaggtgacacgcacagacaggaagtacctggcccagcagggatatcaggacaggtttccaggaggtggtgaccctcaggtagttttgctttaaatcagagactgacacaatattaattttgttggtttttgttggagacagtgtcttgctctgtcaccaggcgtgtagtgcagtagtgtgatcatggctcacggcaacttcaacctcccaggctcaaatcatcctcctgcctcagcctcccaagtagctgagactacagacacatgccaccacacccggctaattaaaaacatttttttttacaaaaaattttaaaaattagacgggtgtggtctcgaactcctgggctcaagggatcatcctgcctcggcctccccaaagtgctggattgcaggcatgagcgacagtgcctggcctatatacttttttttttttaaggcagagtttcgctcttgttgcccaggctagcgtgcagtggcacaatctcagctcactgcaacctcagcctcccaggttcaagggattctcctgcctcagcctcccaagtagctgggatcacaggtgcatgccaccacacccagctaatttttgttttggttttttttttttttttttgagatggagtctgtctctgtcaccaggctggagtgcagtggcaggatcccacctcactgcaacctctgactccccggttcaagtgattcttctgcctcagcctcctgagtagctaggattacaggcatatgccaccatgtccagctaatttttgtatttttagtagagccagggtttcaccatgttggccaggatggtctcgatctcctgacttcgtgatctgcccacctcggcctcccaaagtgctgggattacaggcttgagccactgcacctggctataaacttctaaaacagccaaaaccaatccacagtgatggaaatcagatcagcagttgcctgtggcagggtatggggaaatgattgcctatagtggggcacacgagggaacattccaggacgataaaaatgtcctatattttgataggactggtgattgcgtgggaacatacacttgctgatcctcatggaactatacaagataaagaaaatgcagaacagtccaggcacagaagacagaaatagctcagggtgtttgggaaccaccaggacatattgttgttactgagtgaggaggagcagtcagaggagaagctgggagtcagtggcacctgatctcacagggtcccatgtgctaatatcacaggcacacagggcagtcatggaaggaagttttgtttgttcgtttgttttgttttggtttggtttggtttttgagatggagtctggctctgtcgcccaagctggagtgcagtggcgcgataccagctcactgcagtctctgccccctgggttcaagcgattctcctgcctcggcctcctgagtagctgggattacaggcgtgcaccactatgctcagctgatttttgtatttttagtagagataggatttcaccatgttggccaggctggtcacgaactcctgaccttaagtgatccacccgcttcggcttcccaaagggctgggattacaggcatgagccaccttgcccagccttcctgcatattttcacatgtgcatgcacgtgttacttttgtttcaacataaatgagatcatgcaacctcttctgtgacttattttttcacttaatacctgtgtgagagattagacacttagattatttcccatttttcactcttacaaacaatgtgatgaacacaacatttgcctaggcattgtattagatgtattcctagacatgtaattaccatgtatatttaatgatattaaagggtatatgcatttaatattttgatactgctgaccagtcgctttggctcatgcctgtaatcccagcactttgggaggccgaggcgggtagatcattggggtcaggagttcaagaccaacctggccaacatggcaaaaacccgtctctactaaaaatacaaaaattagccaggcgtggtggcgggcgcctgtaatttcagttacttgggaggctgagacaggaaaattgcttgaacccaagaggcggaggttgcagtgagccaagatcatgccattgcactccagcctgggtgacagagcgggacaccatctccaaaaagctatatatatattttttgatactgccaaattgtctcctaaaagttatattcccatagtctatgagaatacccacttccccagcatattgaatattgatattgaatgttaccagtgatttgaattattaccaatctaatggattttttaaatgtaatttcattttaatttcgttgtttactagtgaaactgaacatttgccacgattggccattttaatttctctgtgaactgtcagttcttactctttgctcatttttcagttggctcatgtgactttttcttgtcgatttattggtgttctttatgtatgatgtattaatcctcctgttctttagttgattaggttattgtgtctttttgtaatttttatttgtatttagcgcatatgggcaaacactattttgatgtgtctgataccacttgtgttctctgatcatttctgatctttgaccttgctgtcacctctgacccacgactgtcctccggtcttcactctccagagctttctggcttctgactcccctgacctccttggcttggcctccccccaggtttgtgaatggggcaggttactttgctgctgtggcagatgccatccttcgagctcaagaggagattttcatcacagactggtggtgagtgggaaaaggccccaacaacatggggcaggatagagcctggggcagatcagcattaggaggagaaggggggtgcagctggtggtctggggcttcgtttgcccctaatccactgccctgaatcccaggttgagtcctgaggtttacctgaagcgtccggcccattcagatgactggagactggacattatgctcaagaggaaggcggtgaggagagtggtcaggccgcagggggagggggttgcctgtgggtggaggttgattagcagggctgcagtgtgggagaattaggcagtctgaggcttcaggggagggaaaagtgtccatcctggcccagcacctgtcagacatcacctccgccctctccctctgccctaaggagaactgacaacttcctcttcatgctccctccacctggcagagacttccctcccagtatacataatactttattgtgttatctgggggtatacatgtctatctctctcactggactagttaatatcactgttccactacaaggcacagtacctgccatggagggggcatgtgtggtgttgatggacaggaagaaggatgcatggatgatgcagggtggctgggcaggtggatggatagaggacagaaagggtgatggatggaaggatatgagttggaaaggtggagggctaggagggtaggcaggtagatggatgaatgatagacggtacataaagggatgagtaaatgcttgggaagatggatggatggatgatgaagggtgggtggatagatgtgtggatgggtgagtgggtgagcacacagatgacatttagtctaagtctgtggcaagcagcaaagcagggcatatgtggcagagcctctaggatctccagacaagctggagggacacacgtggaaaaggtttgggagtgtggaaaggggctactctgggagaggcactaggatctgattccccaactcaccaccaggaggaaggtgtccgtgtgtctattctgctgtttaaagaagtggaattggccttgggcatcaacagtggctatagcaagagggcgctgatgctgctgcaccccaacataaaggtgactctcggcctcagagaccctcccacatgacagcccttctccccacactgtcccagcccccagcgctcccgctccctgatggtctcatctttccatctttcctctctccctcccagtacctcctgttttccttcacctaaacccaccctcatgaaccctccatgcctgctccaggtgatgcgtcacccagaccaagtgacgttgtgggcccatcatgagaagctcctggtggtggaccaagtggtagcattcctggggggactggaccttgcctatggccgctgggatgacctgcactaccgactgactgaccttggagactcctctgaatcagctgcctcccaggtaatccccctgaggccttcctgagcacccccaaactcagataagctcaatcaacaccatttcccagctccagccttaccccctcagtcattccaggccctgccaacctcagggttcctcagactttctgggactccaagaacccactttgaaagtgctgtaactggccgggagccatggcttatgcctgtaatcccagcactttgggaggccaaggcgggtggatcacctgaggtctggagttcgagaccagcctgaccgacatggtgaaaccctgtctctactaaaaatgcaaaaaattagctgggcatggtggcagttgcctgtcattgaagctactcgggaggctgaggcaggagaatcacttgaacccaggaggcggaggttgcagtgagccgagattgtgccattgtactccaccctgggcaacagagcgagactctgtctcaaaaaaaaaaaaaaaagtgctgtcacccacccagtcctttccccattttcactgaccatcaccccattcctctaaaagtgtcaaaggcaactggaggggagggctggggaatcagaccctctgtttcattcttcctctcggtctctctcactctttcagtgctcctctctttggccctggctctgtacagccccatgacttccccttgcccctggcttgggtgtgttccccctacagcctcccaccccgcgcccagactcaccagccaccccagacctctctcacaaccaattcttctggctgggcaaggactacagcaatcttatcaccaaggactgggtgcagctggaccggcctttcgaaggtgaagcctcccacccgccaaagccccagagagctgagagcagggtcagaagctggggctggtactgagagtgggatgagaggggtcaacggtggtacagccctccctctggcaggctctttctccctgccccaagtgtcccaaggagtccagccctgacatctcccctgactctcctgggaccccccagatttcattgacagggagacgacccctcggatgccatggcgggacgttggggtggtcgtccatggcctaccggcccgggaccttgcccggcacttcatccagcgctggaacttcaccaaggtgttcattccctccgataggggctggaggtagggagggagccagggcagattggcacctcctgctgactctgccatccctccacgtcagaccaccaaggccaagtacaagactcccatatacccctacctgcttcccaagtctaccagcacggccaatcagctccccttcacacttccaggagggcagtgcaccaccgtacaggtgaggccccccacttcagccagccctcccctttgtctccttcagcctaacaccccaacccactctccctggtgtgagagctgcccacactctcctttcctggggttaagaagcacatcacggccaggcacggtggctcacgcctataatcccagcactttggaaggccaaggcaggcggatcacaaggtccggagatcgagaccatcctggctaacatggtgaaaccccatctctactaaaaatacaaaaaattagccgggcgtggtggtgcgtacctgtagtcccagctactagggaggctaaggcaggagaatcgcttgaacccaggaggaggatgttgtagtgagctgagatcacgccactgcactccagcctgggcaacagagtgagactccatctcaaaaataaaataaaaggccaggcgcagtggcttacgcctgtaatcccagcactttgggaggccgaggcaggcggatcacgaggtccggagagcaagaccatcctggctaacaccatgaaaccctgtctctactaaaaatacaaaaaattagccgggagtggtggtgcgtacctgtagtcccagctacttaggaggctgaggcaggagaatggcgtgaacccaggaggaggagcttgcagtgagcggagatcatgccactgcactccagcctaggcaacagagcgagactctgtcttaaaaaagaaaagaaatgaagcacatcgcattcaccattccctaggtcttgcgatcagtggaccgctggtcagcagggactctggagaactccatcctcaatgcctacctgcacaccatcagggagagccagcacttcctctacattgaggtctgactgggaggaggtgggggagagcatggaaggggtgtcccaggagagagacctggggaatgagtggagtcagtcattgagggctggtggagcagaagcagacgcctggagcctgggaccaaggctggaggccgaggacagggccaggggccaggctgctgatgtctgtctctgattcttgccccagaatcagttcttcattagctgctcagatgggcggacggttctgaacaaggtgggcgatgagattgtggacagaatcctgaaggcccacaagtaaggtggactgtcaggaaggtggggactgtgggtgtggtttgagcccggttgaagggggtggggtttgagggaccagtcgcacctctgactccaccccctccccagacaggggtggtgttaccgagtctacgtgcttttgcccttactccctggcttcgagggtgacatctccacgggcggtggcaactccatccaggccattctgcactttacttacaggtgaccccccaggcggactccagctctcagtggccccatcccacccgtgtccccctcctgattctgtcctgatcccttcctgctgggccttaaagaagggccacctctcctgacctcccctcccctctgccagcctccacttctctccctctttcttttctctcaggaccctgtgtcgtggggagtattcaatcctgcatcgccttaaagcagccagtgagtgctgggggctgggggctcaagccctgggcccctgggagagggagattggggcgctgcaggcctgggggtgggggaaggaggctgtcactcctgtgagcctctgacgctacgcagaccatagctggcctttcactgcagggagaaggagagagaccagactctatgtaggaagagtttctggagtgagaggaggtgggacagggccctgtgcacacagagccacctctcacctcacttcccctcctgtcacgcagtggggacagcatggcgggactatatttccatctgcgggcttcgtacacacggagagctgggcgggcaccccgtctcggagctcatctacatccacagcaaggtgctcatcgcagatgaccggacagtcatcattggtcagtgccggatctagtcctctggcagggagagggtgtggggacaggcgaagagatgagaggcaggatgacagagactgcagctgaggctcgtgtaggggtggagggtccaagaaggaatgttgcaggccagtgctttggtagaggggatggggtactggggagagtgccctgggcccaagcacacagtgtgccccgcatccaccccaggttctgcaaacatcaatgaccggagcttgctggggaagcgggacagtgagctggccgtgctgatcgaggacacagagacggaaccatccctcatgaatggggcagagtatcaggcgggcaggtttgccttgagtctgcggaagcactgcttcgggtagagctggggcgggatgccacagggtgggagggagatgggggcgtctgccttttgagcaggacaagaggtagcaccgcataggtactcccggagccagaggtagaggcagtactagattctcaataggcaaggctgggcgcggcagctcacgcctctaatcccagcactttgggaggccaaggcgggtggattgcctgaggtcaggattttgagaccagcctggctaacatagtgaaacccgtctctactaaaaatacaaaaaatcagctgggtgtggtggcgggcgcctgtgatcccagctactaggactaatcagtttagagtatcagtaaagcaggaacaccaaaaaacaaaaagagaaaaaaatcttttttttttgagacggagttttgctcttgttgcccaggctggagtgcaatggcgagatctcagctcactgcaacctctgccctgggttcaagcgattctcctgcctcagcctcccgagtagctgggattacaggcatgcgccaccacgcccagctaattttgtatttttagtagagatggggtttcgccgtgttggtcaggctggtctcgaactcccgacctcaggtgatccacccacttcagcattccaaagtgctgggattacaggcgtgagccactgcacctggccacgaaaaagaaatcttttttgttgttgttgttgttgttgttgagacacggtttcactcttgtcgcccaggctggagtgcaatggcacgatcctggctcactgcaacctccgcctcctgggttcaagcaattcttctgcctcagcctccggagtagctgggattacaggcgcccaccaccacgcccagctaatttttgtatttttagtagagacagggtttcgctgtgttggccaggctgatcttgaactcctgacctcaggcttcggcctcccaaagtgctgggattacaggcatgaaccaccgcccctggccaaaaaaaaaaaaaaatcttttttttttttctttttttttgagagggagtctcactgtcgcccaggctggagtgcagtggcgcgatctcggctcactgcaggctccgccgcccagggttcatgccattctcctgcctcagcctcccgagtagctgggactacaggcacccgccacctcgcccggctaattttttgtatttttagtagagacggggtttcaccgtgttagccaggatggtctagatctcttgacctcgtgatctgcccgcctccgcctcccaaagtgctgggattacaggcatgagccaccacgcccggccaaaaaaaaaaaacttttgtgttttgtttgtttgtttgttttctttttgagacggagtcgctctgtcacccacgctggagtgcagtggcgcgatctcggctcactgcaagctccgcctcccgggttcataccattctcctgcctcagcctcccgagtagctgggattacaggcgcccgccaccatgcccagctaattttttgtatttttagtatagatggggtttcaccgtgttagccaggatggtctcgatctcctgacctcgtgatccgcccatctcagcctcccaaagtgctgggattacaggcatgagccaccgtgcccggccaaaaaaaaaatcttttaaaagtaatttttttcacaggttctgaggattggggaaagaacagaaaaagaagaaaatttaaaataaaaataattttttaaagcatcaaggtagtcatcaaagtcaagacaaatcagaactctgttggcttcttttacacttattttactattttatattgcatttattttgtttttgtttgtttgtttgttttgagatagggtcttgctctgtcacccagctagagttcagtggcgttaccacggctcactgcaacctcgacttcgccagctgaagtgatcctcccacttcagcctcccaagtagctgggactataggcacatgccaccgtgcctggctaatttttgtatttttttgtagagatggggttttgccatattgcccaggctggtcttgaattcctgagctcaagcaatccacctgcctcatcctcccaaagtgctgggaatacaggcgtgagccaccgcacccagccaattttgaattacctgagtagggacaatgtaacttttctggtactcaggttctctaaggatcttaatctggccctgctgggacccctttctcctatagtgtgattcttggagcaaatacccggccagacttggatctccgagaccccatctgtgatgacttcttccagttgtggcaagacatggctgagagcaacgccaatatctatgagcaggtgggaacttgggaggggtgggggagagtggcctggggaaatttgtggattatcctgctcagggtaggatggagagaagcgccaccatacagtcattattggaagggggatgagggcctggggacatttgctatcaagagatttagtggcccaggccgggtgcagtggctcatgcctgtaatcccagcactttgggaggccaaggcccggtggatcacctgaggtcaggagtttgagatcagcctcccaacatggcaaaaccccatctctactaaaaatacaaaaaaattagctaggtgtggctgggaggctgaggcaggagaatctcttgaactcaggagacagagatttcagtgagccgagatcacgccattgcactccagccacctgggcaacaagagcaaaactctgtctcaaaaaaaaaaagtacaaaagttagccgggcatggtggtgggcacctgtaatcccagctactcaggaggcagaggcaggagaatcacttgaacccgagaggtggagattgtagtgagccgagatcgcaccattgcactccagcctgggcaaaaagagtgaaactccgtctcaaaaaaaaaaagagagagagagttagtggcccagggtcaacggggggtatggagagatggtatgggggaaggggtctagcctagttggacttagattgttgggagagtctccccaagccttactggcgtccatgcccccgcccacagatcttccgctgcctgccatccaatgccacgcgttccctgcggactctccgggagtacgtggccgtggagcccttggccacggtcagtccccccttggctcggtctgagctcacccaggtccagggccacctggtccacttccccctcaagttcctagaggatgagtctttgctgcccccgctgggtagcaaggagggcatgatccccctagaagtgtggacatagttgaggcccccgtcagggagaggtcaccagctgctgtgccccaccacgtctggctccctgccccttaaccccaaggactgagggcagtgccctttgagatctggggaggcaggcattcctgaagggaactagaggtgttacagaggacccttacgtgagaaatagctgaaaagggcactcccaaccctgggctggggaggaggagagagtcccagagctcatcccccctgctgcccagtgcaaaccacttctccatgctgcaaaggagaagcacagctcctgccagggtgagcagggtcaagcctcttattccaggagaagggggctctgccccaggccctactacccattgttcccttcctcttcctgcccttgaaccccctccctgtcccagggccctcccagcccattgctgccaaggtggagggaaggataaagccacttctggcttcagcccccaccaggggaaggaaggagggcacattaactccctccaccagcctgctgacagacactaactttgtatccgttcaataagcatttcataaataaaggtgtagaaaaggttcatgcgtcttccttggaggaactaactgctcgttccagcctcccgttcctgcccacacggggcaccagtccccttcaccttatctccaccctcctccactctcctctctccacctctgttctacctatctgtggcttcgggagctcggtcacctggctcctgagaggagaaggtgttgacacagtgccgcctgggtagaaggacgggcagggcccaaccagggcacctggagaactgtggagctgctatcacaaccgcaggtgagggagatgctctgagaaggacctagagaggctgcctcttgttcaagcaacagccctggtagaggcttaatgaaggccctgtgggagtggttgagggtataggcttaaggtcaggaagacctggacccaaatcctggactcctcaatgagaagctaggtgaacttgtcaagtcattcacttctctgggcctcagtggtccccgctgggaaatgggaataatacttacatgactagcttgctgtcaagactcagccattgacttaaatatttattgattccctgctatttgccagctctgttctagactcacagaagtgagtgcaacaaagtcctcacccgtatggcacttctgttctggagcctcactgtccagtacagtagccactagccactagccatgtttggctatttctttttctatttattattattattatttttttttttgagacggagtcttctctgtcacccaggctggagtgcagtggcatgatctcagctcactgcaacctccacttcccaggttcaagcgattctcctgcctcagcctcctgagtagctgggactacaggtgtgtgccaccacgcccggctaatttttttttttttgagacagagtcttgctctgtcgtccaggctggagtgcagtggcgtgatctcagctcactgcaacctccacctcctgggctcaagcaattctcctgcctcagcctcctgaacagctgggattacaggcgcccgccaccacgcctggctaatttgtatattttttagttggccaggctggtctcgaactcctgacctcatcatccacccacctcagcctcccaaagtgctgggactacaggcatgagccactgcacccagactaatttttgtatttttagtagagacagggttttgctatgttggccaggctggtctcaaactcctgacctcagatgattcacccgcctcggcctcccaaagtgctgggattacaggtgtgagccaccgtgctgggcctggctatttcaatttaagtgaattaaaattagaattaaaaatgtaggggctgggcacagtggctcacgcctgtaatcccagcactttgggaggccaaggtgggtggatcacttgaggtcaggagttcgagaccagcctggccaacatggtgaaaccctgtctct

SEQ ID NO: 15806 - DNA, 28819 bp, Human
ccgggaccgcgcgtacccgcccctccgcgcgcgctcgcgcgtcccccgcccctcgctcccgccccagctcgcgctgcccgggcgggcgccggccgctggcgccgctactgctgccgcccccggggcgcgagtccgccgcccgccgcccgggcacccggcgaggggcgggggcagctccgaaccggccccagatccttcccgcttccgcctcacgcttcccggaaagcttgtccctctccgccgagctgctccgggagccccgccgcgccgaggtgagggctggggaagggggagggaagggacgcccgcggaggaatgtgccgggttggggggcggggagccggggtccggcggcgcgatctaggctcaagagtcgggatcatgtgctgtttgttccgcggaggcgcagagaggtgccaggcccgggcggccgccggctggctggacaggaggacgggtccgcatggccgccctgagaggccgggcggggacctgtgtgagaaccgccgggtgggcaaggtgcaggtggcccaagaccccctttcgggccggtcggccccaccccagccgcccagtatcctccttgtaccccacggctccttcacagctgcaccggccgacccctgtccctacctctattcccttaccccgctggcccccagccgtgccaccccatccctgtcccattagctgcagcaacggcgtcaccatcgcttgtccccaccagtgtccttccctcccctggtcagggtctagggggtcagggctgttcttcctgagccagcttctgtgattccagctactcccttcctgtcctgggacagaccagcccctcaccctcccatgctctgcccaggaagactggtgaggggaggcccagcgtgacaggagtttggggtccactggggccacaggagggggctccgcatcccttatccttcgtggtcctcctccctgttgtccgtgggcgtgggctgctcagcctctcctcccagggtgtgggcacccgatcacccacattcctgggctccagcctggcaccttccccagggcagtggacgccatagcactagccccaggttggggctggcaccagccagccggcttccttttctttctcccttttagggaggccccagggaccctctaccctcaaacacaggtatttctgggcgccccaagggtggagccctgagggttggtctgatggctacaggatgaccccaccctcccctgctcattgtcccggatcctgaggaggaagtgctgggggctgggcaaggggcttagagcccacacagctggccctgtggatcccagtcctgggccctacctacagtccttggactttgcccatctgcactactggcctggtgcatggaggttgtgggcctcaggtggaaactagattctcccttgccgacactgtgggggaatttgaggacaggttttgcatttgcagtttcctctctggtctctcttctgggctcccagtttgtgctttggcgccggagttccccaccctgtctctttaacaccgtgtgtttgctgtgctgtgtctcttcctcctttcctctcccattctttccttcatagcatgacctcaggcttgccttttgtcttatttctctaattttcttggtgtctgtgactctctgcccctcctctctctcttcccaccaccctcacgtctctgcccatgtgcccctctctctgaattgccctctgtccagcctctttctctctctgtcctctatctgaacgttcagtacatttgcgagtgacaaggaataaaaatatcaccgtccctgcccttggattcacattgcattcagccactctagaggggcagctgtccgtacttttcctgctattccccccgtaaccttggccctccaacctgggaaccccagacgggtctctggaaccacaggtgccttctaacaactcttcccccgcaatcagggtatctcccagagccccagctggtgtggccaggccccaggagtaggatggggctccccctacgagggccggtggcagccagaactgatacagcccccctggtctggggccaggacgccaggtaactgggggagaccgcccaggttcctgcaagctggaatatggctggggagagaggcagaaatacctttgggagtctctcaagacagtgacatttgggaggaaagccaagggaataagagctgggtccttgagaggctgggtggctctgggggagatgtgaagagactggttccgggaagaagctgggaggcaatgtctgggtccctgcagtggttctgaccccaccactcctttctctgtcctccagctgaggagggcaggagtgtctggagctatggctggtgcctcggtgaaagtggcagtgagggttcggccctttaacgcccgtgagaccagccaggatgccaagtgtgtggtcagcatgcagggcaacaccacctgtgagtgagtccccggggcctggctgggcacaggcagggaaggccgggcccaccacacaggccagtcccgctgggccaaactaagaggagggtaatgctgggcacagagcaggtgctagtcgtaagggcgggggctggggcaggctggcctttcccgtgttcccagtccctgggagggggaatgttggcctggagccctccattgcccaatccagggaggcagctcagtgggggcgggtcctaggaagccaaaattagctttggtggctggagggggtggggaatgttaaaggggagagaagagtcaggacagtggtgaggagtgggatgcttggattccaggggctggttggggtatgggcagggactgggaatacctgaccttgactttccttcctttaccctctcctgcccctcagccatcatcaatcctaaacagagcaaggatgcccccaaaagcttcacctttgactactcctactggtcacacacttcggtgggttgttgggctgggggaagagcaaggcagtgagagacagaggatttaggtcctggggaggggacatgttaagaaataggacccccaggggattagtcagggtgaattgggaggatgatcctgggtgggggtggtaggacccttaggctgtgattgaggcctcgacaggaaggcggaatcccttggggtaattaggactagcaggggctggataggatccttggggtggtaaggacaatgatgagggtgggagggcacacaggacatttggggaatcgtcagtgatggaagcaagactcttgggacagagacacaaaggataaagacatccagggttactctgtttttctctgcccccactttctcctagacggaggacccccagtttgcatctcagcagcaagtgtatcgggacattggagaagagatgctgctccacgcctttgaaggctacaacgtgtgcatctttgcctatgggcagaccggggctgggaaatcctataccatgatggggcgacaggagccagggcagcagggcatcgtgccccaggtacgcctaggacctggtggggcagccagggcaggagcatctttagctgccctctgaggaaggaaggactagggtcggaggattatggaacagagacctggctctgaggccattggtgatgggagatagaggttgactgcaagctggacaaccctctggggtgggagggtcttcgcccctatcagaggcaacgagcctcagtgagtagagcagggctttggcatcagtgagccttgggttcgagcgccagttttacgacttactactgttttacttggtttcataataatttgtgagtatagttctcctgcaggcttgtgtaccaccagcagagtgttaactgtagaaacgccaattgggataacggagttaaccataattgtccctggctgtccagcatagcaacctggcacacgggcttgggagtcagaactcctggggtttgcaccctggctggctgaacggtagcctgtgatcttgggcaagtggggacctctctgaggttgttttcccatctgtgaaatgggaataacccctccctcaaggctgtagcaagggttaaatggggtcacttgggactgggcctggcctgtggctggacactttaggtgtgccctgaacaggagcttctctgtatttccctgtgtccccctccagctctgtgaggacctcttctctcgcgttagtgagaaccagagtgctcagctatcctactctgtggaggtaagcccgggtcttggtggcagggctgagaggggtccagactgctgagggctgtcgctggaatcagacagcctgggatctaatcctggctctgctggttactgactgtgactttggggcagtgattctgtccttcagcttcgtatgttcatctgggagacgctgttgatcggacacacctcctggcttgttgggcaggtcgctgagctagcatctgcagaatgcttcgcactgtgtattagctgcagtcacctggatcgtgtccagtggagtcagattaagttgcgttgtcattgtttttgctagttttgttacttctcatttgcttctcccactcaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggtgaggcaggctgatggagcagagggcaagggggccagggttgggaaggtgagaggcaggatccagtgactgctttctttaccctaaggactgtggctgccaccaacatgaatgagaccagcagccgttcccatgccgtctttaccatcgtcttcacacagcgctgccatgaccagctcacggggctggactcggagaaggtgggatcgcccccccccccactcccccaccggatgcaacctcccctggcaacagggacagtgacatggtagaagggtcttgggccctccctgcccatgctgggttgagtgcctcctcaggactaccatgaccgcgccccacccctaccctgtttttccgtcagatcagtctgtccccctctactgtttgcttgtcttttttttttttttttaagacagagtcttgctctgttacccaggttggagtacagtggtgcagtggtgcgatgtcagctcactgtaacctccacctcccgggttcaagtgattctcctgcctcagcctcccgagtacctgggattacaggcatgcgccaccaggcccagctaatttttttgtatttttagtagagacgaggtttcgccatgttggccaggctggtcttgaactcctgacctcaggtgatccagccgcctcagcctcccaaagtgctgggattacagatgtgagccaccacacccggctgttcttacgagacccaggacagggcttggatcccctgtgtgtcccttgtccatgcctgcggtgggcctgtagctatttgtaattgagtgagtaaccaccgtctcactgttgtcacgtattctgtttcccccggcctcctccctcgcctcctcctggctctctctagcccttgccagctgcccacattcctgctgggtgcttccctgatttccctgccccgtcccccacccgcaccttatctcctgcctgtttcctctgaccccaggtcagtaagatcagtttggtggaccttgctgggagtgagcgagccgactcctcaggggcccggggcatgcgcctgaaggtgaggggccttcagagggtggtttgttgtggggcagtgttgtgggctgtatgtggaggtctccagtcggaacctgagactctcactggggaggtaggaagcggaagtggatcacattgggagaagagggtctcatccccacattcctcatccttttccaggaaggagccaacatcaataagtccctgactacactagggaaagtgatctcggcccttgcagatatggtgagacctgggtgttggaaagaaggggcttgggaaaggggagtgacccaccctaacctccttcctccttttatcccccagcaatcaaagaagcgaaagtcggattttatcccctacagggactctgtgctcacctggctgctcaaggaaaatttgggtgagggcctcttcctctttctctgccgaccctgacacatcccacaaactcttttgatacatctgacaaatccccttgctatgccgagaatcccaaatcccgttgtcttacttctccccctgacccttcaaagggaacatcctttgaagatttcctgatgctgagaacaaggccataccctcccgtcaagccaagggcctcactgacctggctactcatgacccctccctgatccctgatctcacacccactgctgcactgctgacttcatcccccttccatggttctgtgactgtcctgcagatatatctccctgacctcatcccctcccataaccagatgtcatggttagctccaccccgctagactcccctacctcagaccatgaccctgtaagacctctgcctgggcagtgggccccagccctgtgacccggtctgactttgcttagcccctccctcagctgaagcttttccatgcactccattcacaggggggaactcacgcacagccatgattgcagccctgagccctgctgacatcaattacgaggagactctcagcaccctcaggtgaggcttttggctctagcagggatggggcagcataggaagagtgccaggagttcagaggcgagttgctcaggaccctgctcgtgagacgggggagatgccggagccttgccacaatatcttgagacctgggagagggggaaggagaaacagcagaccaagggtcccctgcccccaggcctcaccgaccctgctcctctgtcacccaggtatgctgaccgcaccaagcaaatccgctgcaatgccatcatcaacgaggaccctaatgcccggctgattagagagctgcaggaggaagtagcccggctgcgggaactgctgatggctcagggactgtcagcctctgctctggaaggtcgaggttccagggaggggcagctcagggatgccccttggcccaccccatccctcctcacttgcctttgcccagtcctggagccagggagggaccacacactatgaaacctttcatgtgctcagtgacgtggacacagatgtggagagggaacgtatgtcttcagatgttacagagctgggagggactaattctctaggagaggatgaggatccagaaggacctgtcaggctcctggaagtaatgaaatgactgttacaggaaaaaatggcaatatatgcttacaggtcaaacagtaaattgttaagaggctaggctactgggtgactttcttgacagaagttcttgcaaaacgtcagagttgaagtggaccatagcctaacagatctcagtggagtgctttctggtatgtcatgctcagcctcactgatggaaatagtgtccaaatcagaggatgtgtaatccatgttgacggtcaggaatggaccctgcattcagtcttgagatcatcccattgaggatagttagggtgctgaagggcacagtgtggggagtatgagtgttcttggaaagagaaggataaggtagctagtgatgtttgccttccaacatttgagggattttcttgcagaagagaaagcagtaaggactttttatcccagagggcagaactagaaacactagcacacatgacgtgggaccagtttcagctcagcacagctaagaattctttttttttttttttgagatggagtcttgctctgtcgctaggctggagtgcagtggctccatcttggctcactgcaacctccgccttctgggttcaagagattctcctgcctcagcctcccgaataactgggattacaggcgcccaccaccacacctggctaatttttgtatttttagtagagacgggggttttagcctggcacagtggctcacgcctgtaatcccagcatttggggaggccaaggcaggcaggtcacctgagttcaggagttcgagaccagcctgaccaacatggtgaaaccccgtctctactaaaaatacaaaaattagctaggtgtggtggcacgcacctgtaatcccagctactcgggagactgaggcaggagaatcacttgaacccaggaggtggaggttgcggtgagccaagatggagccattgcactccagcctagcgacagagcaagactccgtctcagaaaaaaaagttcgacacagaggtttctagactggccaggctggtcttgaactcctgacctaaggtgatgctcccaccttggcctcccaaagtgctgggattataggtatgagccactgtgtccggcccagctaagaattttctctttttgagacagtcacgctctgtcacccaggctggagtgcaatggcgtggtctcggctcactgcaacctctacctcctgggttcaagtgattctcctgcctcagcctcccaagtagctaggattacaggtgcctgccaccacaccaggctaatttttgtattttagtagagacggggtttcaccatgttggccaggctggtctcgaactcctgacctcaggtgatccacccgcctgggcctcccaaagtgctgggattacaggtgtgagtcaccacacctagccccacctaagaattttctgatggtgcaaatcatctaatagtggaaaggactggccgcctccttcagtaatgagctctccacccctggagttcaagtagagagactgggtgcccatttaccatggctgcagtaggagggctccttgcctggtaggaggctgaccagcagtcttctgtagtccttacagactggtcctctgtgaagctcttggtctcctggatgtctctcatcagctccttctttccttagcctcattctttttcctctttctccctcccaggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggtgggaagctggagctggcaagggctgggggtctgggcattcctgggagtttacttctccaaagtcaagcttgagaaagaaggaattctaggagtagcatggccccagggtaggttgtccctaccctgggtctgcttgtcccagaccatcctgaaacctacccaccttacgcccccaggagacagagaagattatagctgagctgaacgagacatgggaggagaagctacgcaagacagaagccctgaggatggagaggtgtgagggccgacagttggggtcctgggtggagttggaggccatgggggaggtcaggccccacagggaaggaggtcacgggcagtgaaggtaagactgacatttgcctctcctctgcccacagagaagcattgctggctgagatgggggtggccgtccgggaggatgggggaactgtgggcgtcttctctccaaagaaggtgagtgaggaatcgagcgaggaggcctagagagctctctggatgcctagaaaagaggcagcaggtgcagggtagtgagtgctgtccctgatcgctccctttgaggtccccggcttgtccctccatcatttctgtcccctcccctgccacctcctctccgtcttgtttagtcatccctgccttctcccttcagccattcaacagtcagcctcaggagagggagaggacctgggaaatcggaggttggttgcaatagagcatgcttttgtatcatttgagttttgtattctgtgcatgctcaaaaagataactaaagaaatctatttttcagaaggataacttgggaagacaagactaaagggaatagaggaggcatgagcactacattgtaagacagtggttgccagtgcagcgaggggttggttatagatggaggcacccgtgtagcttggagctatgctgcaactggtttcctggagaaggtggtttggaaagtggaacctgaaagatggacaggacttgggaagtatggaggagtagggccaacatgaggttgaagagcctggggtacatgttggggtgagtgggacacgccagtgcctgacacgtgcctgccgccaggttttaggtacctaataaatctttgctgaaaggaaggaaggagcagggcgggagaggtcaggctcaggtggaggcaggaatgatactccaaatattaataaccatccggcatagggactgaccagtcagaaaggacactggatatagacagccagcaccgctgtaccggtgcataccagtgaagggatggtgcagaggccagtataccagtgaagggatggtgcagaggccagtttgagcagagcatgaacttccagttccaccagggaaccagcccagcccgtctggaccatggtgtgaagcagcagaggatcaggccctaagtcagatacactgtgctctgagccagacagtgtcactgggggctgcctggaagaggtgatgggttaccagaagaaggctcctctctgttttgtaaagtcaggtccatctgggggactaagcaagcagggatcactgaacccctgttctgaaaagaggagaggggttttgccttgcctggcccaagccacattgagggagtgaaagagctgtgggcggtaggccaggctgcgtgtctggggtcttgtctggggctgggtaccctggggctttggggtccttctgagggatccagactcttctgggacccagccacacctaggtggaaagaggggctacggatgcgctcagcatggcttccagccacctttgtatacctggagctgggccgcttccaccacggttgcaaggatggaggaaaagcagaaaggactggggagactggtggggtggaggtttcttccttggagagcttgcagagatgccacctgccaaagcctggggaccaaaggagggggttcttgttttaattgttcttataaaggtaatacacaccagagagaacattctaatagttctaaaaggtgtgtacagtgaaaagtctccaatttacagcattttgttatagaaaaaaaaaaaaagtaactctccatccttcccacccttaagtttcccctcagaggcagccttcattatgagttctttttttttttgagacggggtcttgtactgtcacccgggctggagtgcaacggtgcaatcttggctgactgcaacctccgcctcctgggttcatacgattcttctgcctcagcctcccaagtagctgggattacaggcgcacaccatcacacccggctaatattttgtatttttagtagagatggggttcactatgttggccggagtggtcttgaacttctgacctcgtgatccacccacttcggagtcccaaagtgctggggttacaggtgtgagccaccgtgccaggcccattatgggttcttactatattctccttgggtcgggcctggtggctcacacctgtaatcctagcactttgggaggccaaggcgggtggatcacgaggtcaggagattgagaccatcctggctaacacagtgaaaccccgtctctactacaaatacaaaaaattagccacgtgtgctggcgggcgcctgtagtcccagctactagggaggctgaggcagtagaatgacatgaacccgggaggcagaggttgcagtgagctgagatcgcaccactgcactccagcctgggtgacagacaagactctgtctcaaaaaaaaaaaaaagaaaaaatgttctcctagagatgctgtctaggagatgttataacacatgtacaggcatatgttatatagaactatacacatttactcacattcacggcctctctaatagttgtagttgcatatctattttatttatttattttgagacaagagtcacactctgtcgcccaggctggagtgcagtggcacaatctcagctcagtgcaaactctgcctcccaggttcaagtgattctcatgcctcagcctcccaagtagctgggattacaggcacccaccaccacgccgggctaatttttgtattttagtagagacagggtttcgccatgttggccaggctggtctcaaactcctggcctcaaatgatgcactggccttggcctcctgaagtgctggtattacaggtgtgagctactgtgcttggcctgcataccttattttaaagcttcctttatttttttcacggtgtcagggtattctattgtgtagatgtaggataatgtatttaaccagcttcccactgatggacattcagattgtttcccattccttgatactacaaaaaaaggctacaatgcatagtcttacaaatgggtgttatctgtagagcagattcctagaaatggagattttgggtcaaatggtagccatgtaaaattttaatctaggccgggtgcggtggctcacgcctgtaatcccagcactttgggaggccgaggcgggcggatcacgaggtcaggagatcgagaccatcctggctaacaaggtgaaaccccatctctactaaaatagaaaaaattagccgggcgtggtggcgggcacctgtagtcccagctacttgggaggctgaggcaggagaatggcgtgaacccgggaggcggagcttgcagtgagccgagatcatgccactgcactccagcccaggtgacagagcgagactccgtctcaaaaaaaaaaattttttttttaatctatattgccaaagtgccctctgaagattataaccataccaatttattttacttttttgagatggagtcttgctgtgttgcccaggctggagtgcagtggtgcaatctcggcccactgcaagctccgcctcccgggttcacgccattctcctgcctcagcctcccaagtagctgggactacaggcgcccaccaccactcctggctaattttttgaaccataccaatttatactcccaagggtaacatacaagagagcccatttcccctcgccctttcccacattctggcttagtaagacttttctctttgcctgtgtgattggtgagaaggtgtcttaaggtagttcacttttacatttttctcaaggtggtgaggatgaactcttctcatgtttaaaagccatgtggtctaaagccagaagagagaactgttagactcatggggaaatgggtttggtgtgagtagctccaacagggaatagttgggtcttagaggaaaaaactacagtttgtcttggagggagcctcctcttgctaagacccccaccaccagggctaaggattgcttaaatcagtggtgttcaaacctggttctgagctgccttctcaggggctgaggatagggacaggaccagaccctggggctctcacccccagcctgggcctgagcagcttcttgcttatctgcttgatgtcctaggcttctagagaaggtttcattttgaacaaagagttatagggctgaagaaaaagttgaaaagcaccgcctcaaatcgtgttccctctccccagggatagattgctttctgcttccggagcccatcagcgtttgccagtcccagagcaggcctgacactgcagtgtagggaggggcatgggagtccctcaggagaagtgtcgcaggagtgatccttggagcacttgggtgaagggcggatgcacaagatacacagacacctctgggggacacagctttgggctctgagtgttaagtggctcccagagaaatagaggttcgactccgtgctgtttcccttctgtaccctgtgctttctgcctccatgcttctgtccaggctgctttcacccggagcgctcttgtgcatgtccacgccctccttgtcctcaaaggctggctcccatgttacccttccattaagtcctcctgatccccttgaaatcccatagttcttcactttgttcctctttgcatgtgagtccctcccagaacacagtggcactcaaccccctgggaacaaatgaatgaataaacgaacttaaacaagggcatgagacaatcagaaactcctccatgaggcatccgtttcccacttgtaatggtgtttccacgccaagcctcacctcccctagctgactctcatttcctgactgactggacagcagtgcctgggcttgactcatctctgtaccccgcctagcgcttcaccagggtgaggtagaaaggccacagtcagtccttctgcagcagaggcaggggtcttgtgttctgatggaaggcttaggaaaacttcccggaggaagttgcatttcagacagactgggaggaacgtgaaggaagtgaatgattttggcaggtgggggcggggcgggaggcggtctgttgttggggacattggcagtcagggatgcaggaggcctactttggagggagtgctcaggggtccgctgagtggaagtacagagtctgggagagagcctgggaggggggcttggacagatggactggagccgggacatggaggaggcccagggatgccaggggaaaaagtaggctcaagtccagcgggcctggggttccagctggagaggtctcagcagagaggcaaagacatggccatagcgaggtgtgggcaggaagctgggagacctaaggggtggcaggaaggcaggtgggcctggtgcagggtggtgccgagggatggagaggtgtgtggcacggcagcagctggcaggaagggagacttccccaggcgtggcagcagtggcatgaatgggggtacagaggcagcgtcgcctgtacgccatccagagtactgcccagcaagggcagggctgttataatggaaacaagtcaggagaaggtgctgtgggagaagggaatgggccgggttttcagcacagagcagcgtaacaatcactcaggtgttcaggatggacttggctgggggccttaggcagggacagccccaggcgggtgctgcagggacccaggcttgaggtgaagcagcccagggaggggtagtcactggggaagagtcaatgagtctgcttcgagaaacatgtttgttccatttgcttttaagttgaagtgacactttttatttttaaattgtgaaagtaattcatgtgtgtaggaaattcaaggttgatgaaaggtggggagtaccagtctgctcactcagtctcccccaactctccagaagctgcaaggtacattttgaggaaagaaatgatgggacctgagacagaggaatatagggaagaagagaatgcagggggtccggggcttctggtgagggagcctggtgggtcgaggtgcttctgaagagacaggccttgggaagggttgctgacctggatgcagctggatgggtggggcaatttttgtcggccccttgtgtgaggagagggtggatcaggctgtcctgaaggcggttggtgtgagaggtgggaaccaaagaacgtcatcggggtggagggatgacgatgggaggagtacagagggcaggagagctctccagagtgagggggcgcagctggcagtgccaggactggaggggtgtctcctcccaccgctccctttcttcctttctatagcacccctggctggctccccctgaccacctttctctccccgcttagactccccacctggtgaacctgaacgaagaccctctgatgtctgagtgtctgctctaccacatcaaagatggcgtcaccaggtagcgtgtacccagcggcctggggggcagcctctgcttttggggtgtggctgccaagggttgtccacattggtgtctcccttccctggtggtccctggagatacctcagatctctaaacagctgcctccacagccctgcacgctctcccagcttcaagagaagcgtgcctgctcagtggctgtcttgcctccacctgccagtttggttagggcgagacaaccttgtttactggggcaggagagttgggaaacatagaccccctcattcttagaccctgatgccattgccttggcctcccttggtggggccttccctgggggcgggagaagggaaacacggcctggtctgtgcggttgagggctgggcagctaagggcatgtggctccttgggctggtattatgaagtcatgggggctcggtgcctcccctaaaggggtgagggtgcccttcccctcccaccacaggcattcgtggctgtccttggtagtcatcttgggtagggagtgagctctcaggatcatcaacctaaggatgggtggaggcctgtggctgagggtgcccgtttctcccaggtttgcttgtacccaggtagcatgtacccagtggcccggggggcagcctctgcttttggggtatggctgctgagggttagccacattggtgcctcccttccctggtggtccctggagataactcagatctctaaacagctgcctccacagccctgcatgctctcccagcttcaagagaagttggcgagcctgctgtataacatggtgactaagagcatggcttcagagtcaggcagacctgggctcagatcccagcatcacttcactgcccactgaatgaacccgggcaagccatttcacctccctgagcctctgcttcctcatctgtgaaatgggaataattggcttggttcattgagttggataaactggtgttcaggaggggcttggttaaagtctggcacatgctcacaaacgttggccattgcttccccagggtcggccaagtagatatggacatcaagctgaccggacagttcattcgggagcaacactgtctgttccggagcatcccccagccagatggagaaggtaatggctgagggggtgagagaggccagacagggagagaggccccatgttccaccccacacactgaactcagaggtctgggttgggcaccagggagtgcagccatataaagaggggatgtggccttgtcctcagaggggcttggggctcatgggtatgaatggaggaataccacaggcccagccctctgcacccaccctgagaagacagactactgtgtggtcaggcactggcgagggttctaaggtagaaatgggacactagtgagccagagtgtgggattttgctgaagagaagatcctgcccttcttgatcttgttcaccacaactagcactctgatcctttttaaacaaaaacctgtatttgaatatcggaacttgtccctgtggaaaacctgcctctatccagctatgactgccgagatttctttttctttttctttttctttttcttttttttttgagacggagtgttcgctcttgtcgcccaggctggagtgcaatggcgcgatctgggctcactgcagcctcaacctcccgggttcaagcaattctcctgcctcagcctcccgagtagccgggattacaagcatgtgccaccatgcctggctaattttgtgtttttagtagagacggggtttctcccatgttggtcaggctggtctcgaactcctgacctcaggtgatccgcctgcctcggccttccgaagtgctgggattacaggcgtgagccactgcccccagcttttttttttttttttttttttttttatcatttgagacggagtctcactgtttcccccaggctggagtgcagtggcatgatcttggctcactgcagcccccacctcccaggttcaagtgattctcttgcctcaaccccgagtagctgggattacaggcacgcgccaccacaccaggctaatttttgtatttttagtagagacggggtttcaccatgttggtcagactggtcttgaactcctgatctcatgtgatccgcccaccttggcctcccaaagcactgggattacaggcgtgagccactgcacctgctgaggtgtatttttgaggccaccagtttgttttagttctaacacttaaaaaaaaatagaatgatttgggttcacataagctcaagcaaagtctctgtgaaaatgagttgggcagggaggaaggacgtggtacacatgtgctgtctgtcagcttggacctggtgtgtgtgttgtgcctcagagacctaggagtgcttggcctaacaccttccaggggacaagggacctggggtgtgtatggtcagcactttttttttttttttgagatggagtctcgctgtgtcgtccaggctggagtgcagtggtgcgatctcgactcactgcaacctctgcctcccgggttcaagtaattctcctgcctcagcctcccgagtagctgggactacaggtgtgcgccaccacacccggctaattttgtatttttagtagaaacagggtttctccaactcccaacctcaggtgatcctcctgccttgacctcccaaggtgctgggattacaggcttgagccaccacacccagccctaatttttgtatttttagtagagacagggtttcaccatgttggtcaggctagtcttgaactcctgaccttgtgatccacctgcctcggcctcccaaagtgccaggattacaggcgtgagccaccgcacccggccagcacattttaaaaaataacaaaagacgctatcatgtgcgtcttacagtgaggtttaagacatacctcttggggctggtgggggtggctcatgcctgtaatcttagcactttgggaggccgaggtgggtggatcacttgaggtcaggagtttgaaaccagcctggccaacatggtggaaccccgtctctactaaaagtacaaaaaaattagctgggcatggtggcgaacgcttgtaatcccagctacttaggaggctgagacaggagaattgcttgaacctgggaagtggaggtttcagtgagctgagattgcgccactgcactccagcctgggtgacagagtgagactgtttcaaaaaaaaaaaaaaaaagacatgcctcttcggtttccatatggttcagggtcagccaatcaaggcagttgttctggtctggttcaagtcctcagtgacagcaaatgcttccggcattttgggttgaaagctgttgaatcagttcagcccagtgagttattgccaagttcctgttctgcggcaacctcaagccatttgctgggggagatatgaaagccatacaggccaccaaaaatacacctcagcagagccagcccatgggcaaggagctacagtgcggagagatgacacccgtgtgcaagactgacataggtcacagtaaaggcagccaatgattctgtgttgccaagggtggggattgtgatggtttagtccctgtgggccttggttcttttttttttttttttttttttttgagacggagtctcgctctgtcgcccaggctcgagtgcagtggcgcgatctcggctcactgcaagctctgcctcccgggttcacgccattctcctgcctcagtctcctgagtagctgggactacaggcgcccccccaccaccacacccggctcatttttttgtatttttagtagagacggggtttcgccgtgttagccaggatggtctcaatctcctgacctcatgatccacccgcctcggcctcccaaagtgctgggattataggcgtgagccacgcgcccagcctgggcctcagttcttaacagcagatttaagacctggccagaaacaggcagagaggacgggggcagcacagacaggtatggatgtagaagaatggtttttactgaccatctactctgtgcgtccgcattttctcacacagctcacaggtgagagaactgaggctctcgggggttaggtgatttgcaaaagatgacacaaaatggcagaactggattcagacacaggatggcaggcaccaggggctgtgctgtgagctctgccctagactgtcagattatcatgggttcagggtaaggctgcctgggccaagctggagcagtcttctcacccagccccactttccctgcataacacgtattccctccttttttattttcattttcatttttattttttgagacagggtcttgccctgtcacccaggctagagtgcagtggcatgatcatggttcactgtagcctcaacctcccgggttaaagtgatccccccacctcagcctcctgagtagctgggactacagacctgtgccaccacacctggctaatttttgtacttttcgtacagacagggttttactgtgttgcccaggctggtctcaaagtcctgagctcaagcagtccacctgcctcggcctcccaaagtgctgggattacaggcgtgagccactgtgcccaaccctattccctttagagaggactttagattatctgcttttaaaaatattaatagaattaaatgcctttttccccccctcttcttttagttttaataaatggcatctggccaggcacagtggctcatgcctgtgattccagcactttgggaggccaaggcgggcggatcacctgaggtcaggcgggtggatcacctgaggtcaggagttggagaccagcctgaccaacatggagaaaccccgtctctactaaaaatacaaaattagccaggtgtggtggtgcatgcctgtaatcccagctactcaggaggctgaggcaggagaattgcttgaacccaggaggagaggttgcagtgagctgagatcgcaccattgcactccagcctccaacaagagtttcactccaacaagagtgaaactccatctcaaaaaaaaaaaagaaaaaagaaaagccatccatcacgattaaatgactttagattatcttgtttattgtctgtcttaccagacagaagtaagctctatgagagcagggattttttgttttatatcaccaatgtatttctgagacctagtaaaatagtgtttggaagatagtaggagtgtggcatatgtgggtttgaatcaataaatgaattttgtggcatgatgggaaatgaagaaaaggtggggatagatggcaccccctctaggcacccgcatcccgtcctgctgtccacctctgctgctgctgtttccccgacccaccgtgatgcccttggctgcccctctccccatcggcttctgagtctccctctgctcctaagctgagtcctctgctctccttgttctcccagcagcatccgttgtccccatccctgcctgatattatagttcatcccagtttctgtgtttctctattacttccagtataagtattataataataaaacacatgtttgcatgttattttatggtttacttttttgggccttctaaccactcttcattcagacttcattatcccatcttatagaatatcacagaagttaaattgacttgttcagcatccctggctaaggagctgcagagcctgggcctttgggataccagggttcctctgcggcaatggccactgctcctcgaggacagggagctgcctcgtgcatcttcgcgtccccagaaactggcaggctcagtgatttgtactgaggagcagctagatggatgtttgggttgggttgactttctcttgtcacatgtcagctgtggcttgagaagatgagtcaggtggcagtttgcaagatgcatgaggcagaggggtgggctacaagcctgctggaggagcccaggccccaccagggataatgtcagtgggaaaggtaggaatggacatctggaaggcagaaatgacagggcctctgagcagttaaacatgaggaatgaatccttttgacaattactggttttctaagctgctgctggggaggatagaggtgggtgagtcaggagccactgcagaggcttctgggaattgtagttggggctctaaccctccttctgctcttcctttcccgtgctgcctgccaccagaggggccatggcaccccctacaggtactgggggtgggactggtggtgcatgtgtggttttttggggtaaggcaaggtgggaatctgtgaccatgacccaccttcctccagggtctaatctttccccttcctctgcccctccattcagtggtggtcactctggagccttgtgaaggagctgagacatatgtgaatgggaagcttgtgacggagccgctggtgctgaagtcaggtagaagatgtgtcgcagattgagggttctggggcgtggctgtgtgtaggaagtctcaagggaggtccttctgggtgcatcctagaggaggaccctgaaatacatcagaaatagcacggggatataaagaaggaactgggaagtgaaggtcaaggagtcaggtcttggtttctctttccgccccagggaacaggaagaggatgccaagctcttgcaattccctttggttgacaagaatggggttggtccctgggtgtcagccaggggagcataggctccaactgccttcagacttggggtgatgaaggggagggtgtcacagcccctgtgccagattctctatgccttgggtgtagggatggatttggtgctgatgggaagcgagtttacttttccctcctcccatctctagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggtgcgagggggttacccacgtgccccatggccgtctaggccgtccctcccgggcctctgggcccgtgtcctcctcttgtcagatactcaccaaggttgctcttccttccctccctgtccaatcccaggctgcaggatctggagaatcagtaccggaaagaaaaggaagaagccgatcttctgctggagcagcagcgactggtgaggggcagcaggggctggggatgggctgatgggcagatgagccgcaagcctgagtccgagtgcagtgctcaccgctgagccagagtgggaaatgggcatgggggtaaggggaagggtccaagaggaaaaagccaggagagagatgtgactacaggaggaatccattgtgaggaaggaaggaagattcctccagttgaccaggccttcccatactccagtttctcgtgccaagtttatgattttcaccatatccaagtaccacctgtgttggtattaagattgttgtggttttttttttttttttttttttttggagatggagtctcctgtcacccaggctggaacgcagtgggatgatctcgacttactgtagcctccgcctcctgggttcaagcgattctcatgcctcagcctccccagtagctgggattacaggagcccgccaccatgcctggctaataattattgtatttttagtagagacagggtttcaccatgttggccaggctggtctcgaactcctgacctcaggtgatccgcctgcctcagcctcccaaaatgctgggattacaggcatgagccaccgcacccggccatggactttctattttgtttttgaggcaggatcttgctctgtcaccctggctggagtgcagtggcctgatcatagctcactgcagcctcgaactccttgggttcaagcagtccttccacctcaacctcctgagtagctgggatcacaggtgtgcacttccatgcctggctacattttttattttttgtagaggtgggggtctcactacattacccaggctggtcttcagctcctgggctcaagtgatcctcctgccttggccttccaacatgctgggattgcaggcacgagccaccacccctcaatggtcttttaagtcttgcacaaagttccacactcgattagctacaactaatacttatggtaactttctcggtgccggccatggttctaagtactccacgtggatctgggaggtagatcccgtcactatctctgttgtctagaagagcagcgttaagcagtctgcccaagggtgcgctgttggggtggagcaggacttgaacccaggctccctgatgggcgtgtttccagtgtacttaggacacactgggccaagacacatgggctctggatgtccttagccctctcttcctctttctttctctggccccagtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggtaggactggccttctgcctcccttctctcctccctcggctcttcactttaggagtctgaaccttccatctcagagcctaaccttccccaagtctggaaaaaattgcattgaagtatagtacgtttttttcaatattgtttacgaaccacatgcctcgctgtcaccaggctgctaattaaaatagattcccgggttccaccccagacctactgaatccacatctttggggacaaatctgcatttataataagctctgggtgtttctgaaatacagtgaagtctaagacccactgatataaagtttgcagttttgttttgtttctgaggtgaagtcttgctctgttgccagtctggagtgcagtggcacaatctcggctcactgcaacttccgcctcccaggttcaagccattctcctgcctcagcctcctgagtagctgggactacaggcgcgcaccaccacacccggctaattttttttttttgtattttagtagagacggggtttcaccatgttggccaggatggtcttgatctcttgaccttgtgatccgcccacctcagcttcccaaagtgctgcgattacaggcgtgagccactgcgcccggccctaaaccactatttttcgagcttccttatctctaggcttttctctggaccctttgacatccagccactccaggtccctcttgaatccacatgtcctgaggattcagctctcctcacatcccttctccttttctcactcctccctcccaggatcatgaggatgagaatgaagaaggtggtgaggtcccctgggccccgcctgaaggatcagaggcagcagaggaggcagcccccagtgaccgcatgccgtcagcccggcccccctcgccgccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacagggagcttgtggcctgtttgttttgggttttcatggaggtgtaggttatataaggcaatggcacaggtcttaagcatacttatcagtgaagtattgtatgtgtgctctgtgcaggcaccacccagatctggatataagaatgtttccatcttgtcttcctgaacttcaccctcctgtctcttccttcagggtgcgcagcccgatcttttccccgctttttttttttgggagacagggtcttgctttgttgcccaggctggaggtacagtcttggctcactgcagcctccgcctcctgagtagctgggattacaggcatgtgccaccacgcccggctcattactgttttttttgtagtgacgaggtttcaccatattggccaggctggtctcgaactcctgatgacctcaagtgatccgcccaccttggcctcccaaagtggtgggattacaggtgtgagccaccgcgcccggcctcccctgctttcatgtttgcttacccagtgtctcagtctgtgccagcagcaccactgtctgttatggacaaagcacagaagcggggatgcgaggggaggtagagggaccgccagcctgtcaatgcttaactggctgttgctgacagatacagaaggatttgtggggtacagaggagttctgctttaagtcacctaacttacttgaaaggtctcccaagcagccagtttctcttgatagtgaatgggttgggcaagcatactgcgcttacctgattgttttcatcctggttgtgttacctgccttctggcaggctacatcattgttcccagtcgttattttatttgtgttaagactgtttgttggccaggcgcagtggttcacgcctgtaatgccagcactgggaggccgaggcaggtggatcacgaggtcaggagatcgagaccatcctggctatcatggtgaaaccccatctctactaaaaataaaaataaaaaaattagccgggcatggtggcgggggcctgtagtcccagctactcaggaggctgaggcaggagaatggcatgaacctgggaggcggagcttgcagtgagctgagattgcgccactgcactccagcctgggcgacagagcgagactccatttcaagaaaaattaaaaaactgtttgttgcctgcttgttttaatgttctggcttgaggcagcgagcccttgactatgccacattgccaggattttgcaggttagattgtactacagcactgcctttggcttgccagactctggagtccccacattttcatcctgttctcaggaaaacactttgacccacttgaagctctgagctactgcttcacagcttcctggggtcagtctccagccaaaaccatagatatcccaactgcagccaaaccacggctctgggcgaaggaacgattaggtttactctaggtttccacaccctgatgctcctgcctttactttgacacctctgactgccaggttttcacagacctgttgacagtgactcaagatctggaatgtaatggatggtttggcaacagtgtttgcttgagcagtttaaaatctggccagggagactcaatgtgagcaagaaaatgatagaataccaagttttctggaggtcagagggagctgagttgagtgttacagagaatgctgtggggtttgagatgagaaaaatagcttgctaatttaaaagacggattatttttccctaaagaccttgacttatgtaaatgtatattatccataattttaaaaatccacttatggctgggcacagaagctcacacctgtaatcccagcactttgggaggctgaggcaggaggatcagttgagtccaggagttcgagaccagcctgggcaacatagtgaaaccctgtatctacaaaacatagaaaaactagttgggtgtggtggtgtgtacctgtagttccagctactagggaggtaggaagatcacctgagcccatggagattgaggctgtggtgagctgtgaaggc

SEQ ID NO: 15807 - DNA, 6866 bp, Human
tttcggctggcaaggcgcccgactgataacgctgggacagcacttgtcgcccggcgtggggactgtcggtcagagcccctttccccatcgactgtgggcgctcagcgcacggccccagcccatcaatgaatggggctgaatcaacagtgaacaaaaatgaatggaccgaggacgggtggccttttgtgagcttctgcacgcctggggctcttccggcgccccacttgtagcactgcggggaggtaggtctctgccctcggtagagatctccactttgccggctctggggccagtgcggggtctgccccgagctcctctgcagccataccagccgaccggcgggggacacacggcgcctcggcccgactcggaggcccttcccgtcggcgccggggcagcgcgcgcccggtgactcacccccgccgccctctccccacccctgctccccgccccgccggcccgcgcggcctcccagcccccaccccaggccacctgccccgccacccgtccagtctcccctctcgccccgccccctcatctcaggccgctcctcccgggatttttccaccctggggtaggggtgcggtgggccaggggtcaggagatggcgggcggggagcgccgccacgtgcccgggtgcggccccgcccgagcccgccagtgactcagccgcgcggctgtcgaggaacacggactcgaggggcgtcggggactgtgggattcggcgtggacgccagggatgcgcgccgcgctcgggaggagagagaaaaccaaccccctttccgcccgggccgcgctcggtgaccccttgcccctagcccaggctccggaagccgcccagccctcggcggcgggtcggaggaggcggtttcaccgcggccgccgcacggccgtcccgcccgtcccgccctccccaggtggctgtgagcgcacatctgactgcgaagaaacccaaagggcccgaagtgggactttccccttcttgaaaaagttgccactcttgcaacttgagtattcttccgcctcgaaaaatagccccgcctgttaagccccgcgggtgtccgcgctctgtgacctctgcagacacaggccaaggggcacggccggtgatccagacattgcctgcctggggcgggcggggctgggatgtggggtgaggccctgggctagagccgatccagagaagggacaatcctctagactgagaatgggccctggtgaacccaacctgcacgacccgagaagacgctggggacagaagtggccccggtgggtgccttcagctatgagagcgactagaggatttggccaaactcttctttgctttcttattacttgaataagtaaaatcaagggtggtgaggcggcagcgcgcacggcttcgcccccgccccttccgccaggcgggagacacgtccccagcccgccttcctttcccgcagggtccacacgggtcgggccgggcgcgctcccgtgcagccggctccggccccgaccgccccatgcactcccggccccggcgcaggcgcaggcgcgggcacacgcgccgccgcccgccggtccttcccttcggcggaggtgggggaaggaggagtcatcccgtttaaccctgggctccccgaactctccttaatttgctaaatttgcagcttgctaattcctcctgctttctccttccttccttcttctggctcactccctgccccgataccaaagtctggtttatattcagtgcaaattggagcaaaccctacccttcacctctctcccgccaccccccatccttctgcattgctttccatcgaactctgcaaattttgcaatagggggagggatttttaaaattgcatttgcaaagttcggtgtctgggctggcgagtgggggagggagggaatggggagtaggccccgcccctaccgtcctttgcaaataaaaatctagcggggcggggggggggaggagcaggaagtggcggtgcgagggctgctgcacagcgagcggagccgcggtccggacggcagcgcgtgccccgagctctccgcctccccccgcccgccagccgaggcagctcgagcccagtccgcggccccagcagcagcgccgagagcagccccagtagcagcgccatggccgggtggaacgcctacatcgacaacctcatggcggacgggacctgtcaggacgcggccatcgtgggctacaaggactcgccctccgtctgggccgccgtccccgggaaaacgttcgtcaacatcacggtactgcgaggcctgcgcggtccggggcactgctccggtttggaccctgagggagggacttgggtgggggcgggcgcggtctagggcgcgcagcgagaggccctgactgggtgcttgccctggaagcggcgcgaatggcggctgcacgtgagtgggtccctcagttgcccgtaggtcctatgccccaggcggcggcgcccatcccgcccgctaccccgctttccgcgacggggcgttacatccggggcacagggcggggaggggcgcggcgcccggtgcggcggcccacttccgcctctcccagggcggggcggggacgcgcctcagtttttactggggattgggattgagaggggacccggggatccttggacccccagctccccgtccggctgccagcccgcgtccctctaccattgtttctcctggtgcggaagggagccccaggcgcgtggtcttggtcccttgcccaccctctgtgggctcctggcccctcctaactccgttagagagggcgaggccaccacacgcccccccagctcagcacgttggattcaacattcctgcgaggccaatcccggaagtcccctcgccctcccttcccgccatccggcggggcctggagcaggggaactttgtgagaagttctgagacagcataagcgaaagtatattggtttactaccgctgctcccaccaccatctccctgtccacactgcccggaagtggggagggggagcggaagttcaaaaggggggggaagggggtttccgggcgggaggggaccggatgtgggggcttggggtgaaagggggaggggggaaaggttcccggggtacctagacccgagagctggcctgccgggtctggcccctgtccaccttcaaaagttttccaactttcccggaaagcccccaggggtctgcttcctcatctcagagcagagatacctggagctaaactctaggttacttggagacccaggcgtccgggccctaacagctcctgcagaacctttgaccaaataagggcaaagttgcttctcttgcctcgcccgcccccctcccttcccctctccgcttctgcttttcctgaaggagagttctgagcatccaaaggctcctcacttacctcactgactccctttatttcctgggtttactttccccattaacactgacatctaaatctctagaggagtatgtcatcccttcctccctggttccatattctaagtttcagaatcatgatctttttctgcactaacgtcccacagtcctcagagtttctcacagttcattgatgtgtactgagtatataatttatacttagcccccacggcggggtggttctcagaagtggaagacaggtgggtctttggagaacacggtgggaatcttggtgcactgactaacttgatgggcgcttggttcctcttccagccagctgaggtgggtgtcctggttggcaaagaccggtcaagtttttacgtgaatgggctgacacttgggggccagaaatgttcggtgatccgggactcactgctgcaggatggggaatttagcatggatcttcgtaccaagagcaccggtggggcccccaccttcaatgtcactgtcaccaagactgacaagagtgagttcctgagtcttacccttcctttagctccaagatctctaatgtaccgccttctggtaatcttgagggtgcttttttgtgtgattccccaacatgaagggagtcagaccagtattgtgttccttgtctgctggatgctggaacatgggatagtccctccattctgtctcagttcctcatcttgtaattcgaagttgctgaactgcattacctcttaaattacttactgccttgagctcggattagaaactgttttctaggagtataggtagattgttggggtcctgaatcatcgagttcatcgtttgagttcttttgttagaacctggaggtggcatgcacatccacagccctttctagcctgaacacatgaatcaacagtctatgagcctttgacccctaagtttttagtctgttcctctccagcgtttaagcttgattttcctcttttgaaaagccttattgtttcagggtgactgacagcctgcctgtgtgtggtgggggggcgggttgggagagatgaggttgggttacagcccccagggctggacagctgctgaacagctggcagggggtggaattgtgacacctggatcctagcctcctttctctttcctcctcctccagcgctagtcctgctgatgggcaaagaaggtgtccacggtggtttgatcaacaagaaatgttatgaaatggcctcccaccttcggcgttcccagtactgacctcgtctgtcccttccccttcaccgctccccacagctttgcacccctttcctccccatacacacacaaaccattttattttttgggccattaccccataccccttattgctgccaaaaccacatgggctgggggccagggctggatggacagacacctccccctacccatatccctcccgtgtgtggttggaaaacttttgttttttggggttttttttttctgaataaaaaagattctactaacaaggtgctgtgtgatttgagcttgggtgtcagaatgggggataggcactgtgacttgcctcctttatcgtggcttgggagcagggaggttgaggtactacaaggtgcaggaatttgagcttctggccaggtggccctgcccctccacagtggcatttccaggcctaagtcctcagtgtgctggtcaaattggtggatgatggaatagagccatctggaccagagaatgggtgcaggcctgcaggcaaggcagggctagttgagtcatccttgtgggtggggctcccccttctgagtcatagcaaatgccggctggggctgtccccatgactataggttagtgtctctcagcattcccttgctccttatggctaaaggggtgattccaccaaagggttaagttcacctgtgtgagaatgatcttacccttccttagtccacaaagaaacaattttattagcccaagaagtgaagacccagtccctctgcttgccccagccccaccccaaagcccctcaaaaggataggtgtgggtaagggagaagcttgggatggaatgtcccctatccctcagaagactggagggaagacgacggtctgtgcaaataggtcaccagaggtgtatgtgtggggggttattagaccaggataacaggggaagagggaggggacagtgggggatctgttgaaggcccaggaaaaacaaggggagctggggctaaggaaccaaaggaggtgggaagagtggggctagaacccaaaagtggggtcctttctgaggcagggtggtcccttggctccccttcatcaccctcctcttgcccttgagtttcttcctcttggtcttcgtccccaggaccccgatgaacaggctgcttgcaaatggggcaggtcttccgggtctgagtgagccaggggtccacgcagcggctgtggtaggctgcagagaggaacaaggtgaagcacctggtggctgctggtggcagaggggcatgggcaggcagtgagggcctcaccatgagcacaggggagtacccgcagcttgtccccatcctcatattcatccaggcaaatggcacagacatcatactggtctcctgggacagaaagaaaataatctagtccttcactgagccacaatgacccagggctaaggcttttaaagccttgcaaaaatttcccctcacctacaaagccagtggaagagataagacaggtaggcaggataaggtcagggcagaacatggaagaatttagggctagaagggacaagcaaagagaagcagaggtaagaagggaagtgggtttttggggaggtgtgagggtggagatagggagtggaaggaacggaaatgggcagggcttctgccacagccttatacgggcactggaggccccagggcctaaagccccagccccttggtaccggtttcttccttctctaactgaatcctccccattcctcccatttttctgctctgtccacatcccctataagcaaagtctgtccctctattgtttcccacaattatttcacttaatcatctttgctttccatctcctctcccgtcttcgttgtatttatgcataaaaacagaagaaaagacagcatctcaagctgaaaccttcctactgccatctttatttttattattatttttttgagaaagggactccctctgtcgcccaggctggagcacagtggtgcaatctcagcccccgacaacctccgccttcctggttcaagtgattctcctgtctcagtctcccaattagctgggactacaagtgcacaccaccatgcccagctaattttatttttttatagagatggggtctcaccacattgcccaggctggcctgaactcccggggtcaagggatccacttgcctcagcctcctaaagtgctgggacttttctgttttatcatgtcacccaggctggtctcaaactcctgggctcaagtgacctgcccaccttggcctcccaaagtactgg

SEQ ID NO: 15808 - DNA, 15330 bp, Human
aattctccatgtatttttctcaatccagttcctctgtcttataaatagcagagattctggcttttctccattttccacatttctgtagtggtctgagtgggccgcaaggaggggctgcatcaggggccactggctggtgacactttccaggtgacagcctcattgcataccctctgaagccctgcagcccttcctgctaccctcatctcttcatggcactcccacatcctacttgagctagggctcattctgtgggggccttcactctcctgtttgcttctgagacccaggaggcagaggttgcagtgagccgagatcacaccactaaactccagcctgggtgacagagcaagactccatctcaaaaaaaaaacaacaaaaaaccattagccaggtgtggtggcacacacctatagtcctagctactcgggaggctgaggtgggaggatcacttgagcccaggtggtcagggctgcagggagccatgatccactccacaccagcctgggcaacaaagggagaccctggtctcaaaaacatttttttaattaaaaaaaaaagaagtcgactgggtggcttggctcatgcttgtaatcccagcactttgggaggctgaggcaggtggatcatttgaggtgaggagtttgagaccagcctggccaacatggtgaaaccccgtctctactaaaaatacaaaaattagctgggtgtggtggtgggcgcctgtaatcccagctacttgggaggctgaggcaggagaatcgcttgaacccaggaggcggaggttgcagtgagccaagatcacgccactgctctccagcctgggcggcagagtgagactccgtctcaaaaaaaaaagaagttatcaaggaaactgcagcaccccaacaaaaacagaacttctttgacctcagaatggaaaaatggcagaagctgattctcacagagttggctcagatcgcatggctgttgctaaatcaaacaccgaggctagcaggatagaacgctctcatcaatgaggcctaggtcccgagcccaccctgagagacaggcagtggcctcaagaggaggagacatcaataatcaaataccaagaagacgaaatgcaaggacaataagagcccacaatcacctctttaatttctccctgggaagaatgctgcctgagaggctggcagaaacgaagaggccaccacacatctgctctgtgcttcctagtttacaaaatacttctcaggttgtcccatttaatcctcacaagtagcccacaaggcaagtggcatcacttatttatttatctatttatttatttatttatttatttactttttgagacagagtttcattcttgtcactttatttacttatttatttatttttcgagacagagtttcactcttgtcacccaggctggagtgcaatggcacaatctcagctcactgcaacctccaccttccaggttcaagtgatcctcctgcttcagcctctcgaatagctgggattacaggtgcccgccaccatgcacagataacttttgcatttttagtagtgacggggtttcaccacgttggccaggctggtctcaaactcctgacctcaggtgatccaccctcctcggcctcccaaagtgctgggattacaggtgtgagccaccgtgcccagacacaagtggcaactgagacttaagagacatgaaggggcttggctaagttgcaaagcaggtatggaaccaacagaggggctgtggagctgtgcagaaaaaacaggaaggcactaacccagggtaatgtgtccatagcccccaccttgtccagcaccacatcctcccttcacctcagggctgcagctcctccgcctctgcctcctcagggcccacatcctgtgcctctctcccttatcattctgatcctgccagtttctgccacgcctctgtctgaactttgctccgtgctccaggcttgttttcctctggacctgggaaccactggcttactttcactcaccgcctgtccttcctgacacctcaccatgtgtacgggaaaatgtgcccgctgtgtggggctctccctcattaccctctgcctcgtctgcattgtggccaacgccctcctgctggtacctaatggggagacctcctggaccaacaccaaccatctcagcttgcaagtctggctcatgggcggcttcattggcgggggcctaatggtgagaaggctggcaggggagcccgggccagctggctgggtgccacctaaggggttctgaacaggagggagagggagagaggaataagaatggttgcttgggagaggatggcaatggcttcgtgggggctagcagccctctggagtcagtcctggaggagccccagggtcccaagctgaatgtctgtggggcacagaaaggacgagagcctcactgctctaaagagctcccctaccgggtagggagcatgtcctgcctgtcctccctgtccccactgttgagcagatgctgggaaaacctcactacaatggtcgaggcagaaggagcagctggttgtcagagacgtcatcggggcaggataataacaggcatgagggtggggcgcagtgaaattacccagagccagggactgccctcacggatcagtcaccctcgcttgcctccacgtccattcactctcaccccacatttctggaagcccaatctgtgcggactgctaaggataaactcagaacttaggtcagtatggcagggaggatgccctcaagtcgtcttccgggagatgagaatctatttgccaggggcggaggtgggggttggtttttgtgtttgttttttgtttttttttttttttgagacagggtctctctctgttgcccaggctggagtgtggtggtgcgaacatggctcactgtagccccaacctcctgggcccaagcagtcctcccacctcagcctccgagcagctggaaccacaggtgggcatcaccacacccagctaacttttaaatattttatttatttttattattattatttttttgagacggagtctcgctctgtcgcccaggctggagtgcagtggcgccatctccgttcactgcaacctctgtctcctgggtttaagcaattctcctgcctcagcctcctgagtagctgggattacggtcacgtgccaccacacccagctaatttttgcattttcagtagagacagggtttcgccacgttggctaggctggtctcgaactcctgacctcaggtgatccgcccccctcggcctcccaaagtgctgggattacagatgtgagccaccgccccagcttacattttttgtagagacggagtatctctgtgttgcccagactggtctcaaactcctggattcaagtgatcctcctgcctcagcctcccaaagtgctagaattatagatgtgagccaccacgcctggccaagactaggatctgtcagaagtggaggaaaaggagacacagatttccccaatttactaacccccatcttccaactctccacccattcagggaaactttgggatggtcaacctcgtttaatatcttcatgcgataaagacaaaagatctacccagcacagttccccacttctcaggacagttggctaatgacattctccaggggagagctccccttggtcccttttgctggtcacacctcgctggtcacacctctatttgctaaaagaggatacctctcctttaaccaacaatcccctcttactctctagtatcttttcttctactccctcctcctgcatggattcttggctgctgtactctactctatcgctctaaactcaactctctttgagagtcacactcctctcaggctgacacacttagccattgtcacggggtgctccctctgcaacctgaaccacccctgtctccccacactcctctgccccatctaaccagcttgcttcagcggagctccctgagtctgccttccccaaatatgcattcacagctgccttccctccacctctgtgcccagagtcactctcaagaagcaccacccggtgggcatggtggcttacgcctgtaatcccaacactttgggaggccgaggcgggccaatcacctgaggtcaggagttcaagaccagcctggccaacatggtgaaaccccgtctctacttaaagaaatatacaaaaattagccaggcatagtggcgggcgcctgtaatcccagctactcgggagactgaggcaggagaacccgggaggcagaggttgcagtgaggcgagattgcgccattgtgctccagcctgggcgacagagcaagactccatctcatacataaataaacaaataaataagcactgctgtatatcacagggacacagacaggttcctgctctccctgaagcttgtgttccctttggtaaggccaccagtctcacggaagcaaggctggaagtcccacgagagcaagcactgcctgctttgttggccactatgtacccagtgctagaccagcaccttgcactaaacagacacccaattaatagtcatggaatggcagcgtgtgcctgtagtcctagtttgggcccagaaatgaaagattgcagtgagctatgaccacgcgccactgcactccagcctgggcaacagagcaagaccttgtctcaagaaaataaaaaataaaaaagtcattgaatgaagtatagaactaggcaaggcaatttcagatagaagtaggtaccatcggccgggcgcagtggctcatgcctgtaatcccagcactttgggaggctgaggcaggcggatcaccgaggtcaggagttcacgaccagcctgaccaacatgcagaaatcctgtctctactaaaaatacaaaaattagccaggcgtggtggcgcatgcctgtagtcccagctactcaggaagctgaggcaggagaattgcttgaacccgagaggcggaggttgcagtgaaccaagattgcaccattgtactccagcctgggcaacaagagtgaaactctgtctcaaaagtaaaaaataaaaataaaatgaaatggtgctggcatgaagagctcctaggcaaagcagatgccactttttataggattttcagggacaggctctatgaggtgatgtctgaactgagacccaaatgacaagaagaaggtgtgagtgttgcagacactaggggctggtagtacaaagcctaaggtgggaacaagctctacacttctgaggatcagacaggtggccggtgaggtgagatgtaatgagatgaggtctgaggagggcagaggctaggcctggaacaccctgaaaagccacagtggagtcatttgaatttttattattataagtacaacagaaaactattgaaggacttttttttttttttgagacggaatctcactgtgtcgcccgggctgcagtgcagtggtgcgatctcggttcactacaagctccacctcttgggttcacgccattctcctgcctcagcctcccgagtagctgggactacaggcgcccgccaccacgcacagcaaattttttttttttgtatttttagtagagatggggtttcaccgtgttagccaggatggtctcgatctcctgaccttgtgatccacccgcctcggcctcctaaagtgctgggattacaggagtgagccaccgcgccatgccctattgaaggacttttggcactttgttttttgacggtttaaaactttttatttaagtcacacagacaagtacccagatccttagtacacagctcaacaaacttttacaaagtgagcacatctgagcccaggtcaagaaacagatcattaccagaagcccagacatgcttctcaccacacacggaaccccagaatcacttcaccaacaagcgtaaccactattctgtcttctaaccccatagacgagtttggcttattttgcactttacacaaatggaatgatagagtatgtgtctggcttttttttgagacggagctgttgcccaggctggagtgcagtggcgctatctcagctcactgcaacctccgcctcccaggttcaaatgattctcatgcctcagcctccagagtagctggggttacaggcatgagccaccacgcctggctaatttttgtatttactttagtagagatgggggtttcgccatgttggtcaggctggtctcgcactcccgacctcaggtgatccacccacctcggcctccccaagtgctgggattacgagcgtgagccaccgcgcctggcctgtgtctggcttctttagctccatattacgtttgtgagagccacccatattatcaggtgtagctgtagttttctttttttcttatacattctattatgtgactatacctcatttatacattctactgtttgtttgtttgtttttttgcttttttgcttttttgttttttttgaaacagagtctcgctctgtcacccaggctggagtacaatggcgccatctcggctcactgcaacctctgactcccaggttcacatgattctcctgcctcagcctcctgagtagctgggattacaggcatgtgccaccgtgcccagttaatttttgtatttttagtagagacggggtttcgcgatattggtcaggctggttttgaactcccaaccttaggtgatccgcctgcctcggcctcccagagtactgggattacaggcataagccactgtgcccggcccattctactgttgaaggagatctggatcattcccagtttggtttttttgcaaataatgctgctataaatattcttgtagatgtatttaggtacaaatacgtgtgcatttctattggataaaaacctagcagtaaaactgctgattcttaagacatgcaagtattcagcgctaatagatattgccagttttctgtagttcttagtgtgagaggtctggttgctccacacgccactggaatgaagaagactcctttgaccactgtgtggagaatgggtagtagaaggtctgcaatatatacagaaaaagaccaaactgagctgggcgtggggcctcaagcctgtaatcccagcacttttggaggccgaggccagcggatcatgaggtcaggagttcgagaccagcctgaccaacatggcgaaaccccgtctctactaaaaatacaaagttagcagggcatggtggtgcatgcctgtaatcccagctactcggaaggctgaggcaggagaatctcctgaacccagcagacagaggttacagtgagccgagatcatgccactgcaatccagcctgggtgacagagcaagactccatctcaaaaaaaaaaaaaaagaaaaagaaaagaccaaactgaggtcacggaagacatccaggagagatgagagtggcttggactaggccagtggctatggaaatggagaaatatgagctgattcaggctataagcacagtgttttcttcttcatttatgatgacacttttcactaagacaaaaagatggtgaagaatgagacagagaagcacatactacaaagggaagcaaacactttaatcaaaagagtaaaaatctcaaatagggccaggtgtggtggctcatgcctgtaaaatcccaacactttgggaggtggaggcaggagaatcgcttgagtcccagcattcaagaccagcctgggcaacatagtgagactctatctcaacaaaaattttaaaattagctgggtctggccaggtgcggtggctcacacctgtaatcccagcactttgggaggccgaagcaggctgatcagctgaggtcaggagtttgagaccagcctgaccaacatggagaaactttgtctctactaaaaatacaaagttagcagggcgtggtggcgcatgcatgtaatcccagctactcgggaggctgaggcaggagaatcacctgaacacgggaggcagaggttacagcgagccaagatcgcgccattgcactccagcctgggcaacaagagcaaaacttcgtctcaaaaaagaaaaaattagctgagtgtggtggtacaagcctgtaatcccagctactctaatgctaaggtgagaggatcacttgagcccaggaggtcgaggctgcagtgagccatgatcatgccactgcactccagtctgggcaacagtgtgagaccctctctcaaacaaaagcagaaacctcagacaagtagatcattcaaaattggtaaatccaaaaggcaattctaggtgtgtttggatccacaagcctccagtaagtgacctaaccagggaggtaaagtaaggtgtcagcatgggtcctggccctgccatgagacaggaagaagagagagcaggtgtttctctgaggttgctggggatgatataatagaactgaaactctcagccctttccctggagaagcacaaaatgctgccttggatggtatgtgccagataagacacatgaggagccaggcacagtggctcatgcctgtaatcccagcaatttgggaggctgaagcaggaggattgcttgagcccaggagttcgagatcagctaggcaacatggtaagacatgaactctccaaaaaaattagccaggcatgttgttccgcacctttagtcccagctactcgggaggccgaggtgagaagatcatttgagcccaggaggttgaggatgcagtgagccatgattgcaccactgcattccagcctggatgacagagtgagatcctgtctcaaaaagcaaacacacacacacacgaaagcaagaagcaagacagctgtggaattccagagataggagacaggcaaagaacctgacctggtgcaacgaagataaaggtaacggagccagatgaggaggcttaaatgccttacaagagttaggcgttcaagttacaagtcttggccaggcgcggtggctcacgcttgtaatcccagcactttgggaggctgaggcaggcggatcacgaggtcaggagatcaagaccattctggccaacatgatgaaaccccgtctctactaaaaatacaaaaaattagcccggcgtggtggcatgtgcatgtagtcccagctactcaggaggctgaggcaggagaatcacttgaacctgggaggtggaggttgcagtgagccaagatcacaccactgtactccaacctggtgacagagtgagactccgtctcaaaaaaaaaaaaaaaaaaagagttcagtcttgatgggcttctctgtgaagagaccctaaaggatttgagcagagaaaagaccagttgaaagctatgtttaggccagatgcagtgacttacacctgtaatcccagcaatttggtaggccagggcaggaggagcccaggagttcaagaccagcctgagcaaatagcaagaccccatgtctacaaaattttttttaattagctgggaatgatgacgcatgcctgcgataccagctactcaggaggctgaggcaggaggatcacttgagcccaggaggtcaaggctaaagtcagccacgatcaagccactgcattccagcctgggtggcagagtgagaccctgtttcaaaaagaaagaaagaaaaaaaaaagctatgtttaacctgatagaggatagagtgtagggtggcatggggcaagagctatgagagtgtaatagggaggctgagaacaccctcatgggaggtgatgagggattcaatgtggggaggaactcacagattcaggagccacttaagtaaaagttgagaaaatttgatgtctttctgggtgcaagattaaagctttccagcctggctgacctagtagatgttattttttccactgatggagacaagaaagtcaaagggagatgaatttgaggaatattgtgagatgagcgtgaggctggttgaatttgagctaaaaccaagatattcaagtgaacataggatctggaggcatcagttttggaggcaacttctggcagagtgaagagctgattccctgaaaggggatgggcattgttaggaaagccacagggagaaaaaaagaccaaggcttgaatcttggaaaatgctacactccatatcagaccatccactagcactcttccacactctactgtaatcccaattcaccagacactccaacacctctatcccttcctgctgctgagggaacttataaatattgagttactctgagctggtctttttttttttttttttttgagatggagtttcgctcttattgcccgggttggagtacagtggcacgatctcagctcaccacaacctccacctcccaggttcaagtaattctcctgcctcagccccccgagtagctgagattataggcatgcgccaccacgcccggctaattttgtatttttagcagagttggggtttctccatgttggtcaggctggtcttgaacttccgacctcaggtgatccaccagcctcagcctctcaacatgctgggatttcaggcgtgaaccaccgcgcccggcctctgagccagtcttaacacctagtcagcttgttctcccattaaatcctgagaacagacctgtgaggtagatcttccagacccattttatacaggcaaaactgagaccctgagagatgaatcaattcatagcatgtgaagtagtttccctgatttccattcagtagggcacctactatgtgccaagattggggaaaataatgatattgggccctaccctctagaggccacaatctggacagagataaggtaggcacgtaaataaggataaagtaaggtgaagcccagcagctccaggagacgtagagataaggtcttctacagtccaaagggctgaaggcatcacaggcagcttcctgaaggaggtaggcactgatgcaagtcaggcctggaggatctggggggacgtgctataacaatgactcttgtcccacaggtactgtgtccggggattgcagccgttcgggcagggggcaagggctgctgtggtgctgggtgctgtggaaaccgctgcagggtaagatccagattaagaaggaattcagggctgggggtggtgtctcatgcctgtaatcccaacactttagcaggctgaggtgggagtacggcttgagccaggagttctagaccagcccaggaaacatggcaagatccctatctctactaacaatacaaaaattagccgggcgtggtggcaagcacctgcaatctcggctacttgggaggctgaggtgggagggccgcttgagcccaggaggtccaggctgcagtaagcagtgatttaaaaaaaaaaaaaaaaaaaaaaaaagaagagaaaagatacagaaattagccaggcgtggtggcgggcacctgtaatcccagctactcaggaggctgaggcaggaaaatcacttgaaccctggaggcagaggttgcaatgggccgagatcacaccattgcactccagcctgggcaacaagagtgaaactctgtctcaaaaaaaagaaaagaaaagatacagaaattagcctggtgtggtggtgggcgcctgtaatcccagctactcaggaggctgaggcaggagattacggtgagccaagattgtgccattgcattccagcctgggcaacaagagcaaaactccgcctcaaaaaaaatgtatttttattttattttacatttatttatcttatttattttagacatagtcttggtctgtcacccaggctggagtacagtggcacgatcttggctcactgcagcttccgcctccctagttcaagccattcttgttcttccagcctcccaagtagctgggattacaggcgcctgccaccacacccagctaatttttatatttttagtagagacggggtttcactgttggccagagtggtctgaaactcctggcctcaggcgatctgccccccttggcctcccaaagtgctgggattacaggtgtgagatatcgtgcccagcctcgagtcaggtttaaaataaatttcccttcaaaccccgggcttgcagttaggctaacctgaaagccagcggccgccgagattcactggggttgtagttcccccctctccccttcacccgcctacccctcaggatcattgagatctgagatttgtgggtgccagggaagggtggggtggggcctgggagtccgcagaggagcttgtgtagctaggaattccatagagagtgctgtggttctgcaaggacaggtgcagaaacagagtccgaatttctaatttttttttttttttttctttttgagacggggtctggctctgtcgcccaggctggagtgcagtggtgcgatctcggctcattgcaacctccgcctcccatgttcaagctattctcctgcctcagcctcgggcatgtgccaccacacccggctaatttttgtattttcagtaaagacaaggtttctccatgttggccaggctggtcttgaactctcgacctcaggagatccacccgcctcagcctcccaaagtgctgagattacaggggtgagccaccgcgcccggcattaaaaaatacattttaacaacccgactggagcagatttcgataatgcgtgggggctggcgctgagcgtcgtcacccacaggtggggagattgggccttacctccccttccacaccacatccagatgctgcgctcggtcttctcctcggcgttcggggtgcttggtgccatctactgcctctcggtgtctggagctgggctccgaaatggacccagatgcttaatgaacggcgagtggggctaccacttcgaagacaccgcgtaaggtttagcctgtattcgtgtcctccattctctgcctcttccctcccgcccttcccccgtggactgggacacctgggcgggactcgacttcgagggcactcgctccacgtgggctacctgggccttagcaaatcccctgggacgtattcttgggggcggggtggcgcacgcgcacgctgccttctcccacgtggcctcacccctcccacaggggagcttacttgctcaaccgcactctatgggatcggtgcgaggcgccccctcgcgtggtcccctggaatgtgacgctcttctcgctgctggtggccgcctcctgcctggagatagtactgtgtgggatccagctggtgaacgcgaccattggtgtcttctgcggcgattgcaggaaaaaacaggtgaaatggcttgcggtggagttgtagagggaacctgcctggtcctggctgcgttctcaccttctcttttccgcaggacacacctcactgaggctccactgaccgccgggttacacctgctccttcctggacgcctacctgctcgctcactcccttgctcgctagaataaactgctttgcgctctcttctctgtctgagattgtgccttctgtaaggaggagtgtgcgagaggctacggatacacctggcctttggggcccctgcaccccacttgtactttcttaacgaatagatactgagctatttggttgcgctggaaataaggacggtaaacaagacagacaagttttattctctcaaagaacttggcattccaagagtggaagataggcaatttttaaaagaagcaaaaaattatttcaataggtaataagcactttttttttttttttttgacagggtctcgctgtcactcaggctggaaggccgtggtacgatctcggttcactgcatcctccacctcctgggctcaagcaatcctcccgtctcagcctcccaagtagctgggaccataggcatatgccaccatgccttgctaacttttttgtattttttgtagagacgaggttgcccaggctggtctcgaactcctgagcaaaagtaatcctcccacttcaggctcccaaagtattgggattacaggcttgagccaccgtgcgtggccgataagcactttttaaaagcatgttggtaatgggattgatattgacttatggagagactctcttttatgacagggaaaatttgagaaaatgaaatttgagctaagatcaggaaggcttgctaaccatctggatatttgggggattataggcagagagaacagcaaggacaaagatcctaaacagggatcagttctgtaggagaaaataatgaaaactatggaaaagacactgtaacctcttaagctctagaaaatggaactgtaaagccattgtggccttgtcacctcctaatttgatagaattttttttttttgctttttttgacagggtctcactttgtcactcaggctggagtgcagtggcacgatctcggctcattgcagcctccacctcctgggctaaagcaatcctcctgcctctgcctcctgagtagctgggactacaggcgcacaccaccatacccctgctaatttttgtactttttgtagagaggggatttcaccatgttgcccaggctggtctccaactgctgagcttaaacaatccacccacctcagcctcccagagtgctgagattacagctgtgagccaccacatctggccataatttggtagaattttcttaatcttaggtcactggttcagaaaggagacaacctaggcacctaatgggggcagggtgtctgcagactctctcagaaagccagacttcctgggcccgcacgatggtgcaagccggtaatcccaaaactttggaaggctgaagccagtggatcacttgaggtcaggagtttgagaccagcttggccaacatggggaaactccatctctactaaaaatacaaaaattagctgggcatggtggtgggtaccagtagtcccaactactcaggaggctgaggcagaagaatcgtttgaacccaggaggtggaagttgcagtgagccaagatcataccactgcactccagcctgagtgacagagtgagactccaaaaaaaaaaaaaaaaaaaaaagccagacttccatcacttgtctgaaaattatctgtttaagtgcgtttttctcgagtccataacttttcagcaatctaccatagacccctgagaccaaatccaaatgtatgcctcacctaatgctaagttaggaggggaaaaggagactcagttccccatcccttaaacaggcgagaccagccgggcatggtgtctcacgcctgtaatcccagcactttgggaggccaaggtgggcggatcatgaggtcaggagatcgagaccatcctggctaacacggtgaaaccccgtctctactaaaaatacaaaaaaaaaaaaaaaaaattagccgggcgtagtggcgggcgcctgtagtcccagctactcgggaggctgaggcaggagaacggcgtgaacccgggaggcagagcttgcagtgagccgagtgagccactgcactccagcctgggg

SEQ ID NO: 15809 - DNA, 11073 bp, Human
ctatggagacccccatccccctccagatggtcctgaagatctcccaaacctgaaagtctgaccgaatctctccccaggtggaggaccaactcctgagcttggcagtcagggagtgccaagcactgaccccatctgacagtccagcttcatctcaagggagatacctcacagtctgtgctccaactatcacaagcctatagatcacctgctccccaacagtgttttactctaagcctttgccctcagtccagccaggtgtgctatccttgccccatccccagccagtctaaccactcagtctgcaagtcactactcccaggcgaggccaggtgctccaagttaccctgcaacactattgctacactcagtttcccaactgctcctgtataatcttgtcttctggaccaggaactccttaaggacaaggtctaggcttcaggcatctcacaatagccaccaaggcgcaggacagtgtacacagaggcagcagcaggggcgccaggatgctgagctccacctcttctgctgatgaggctctgccaaagggacagctcccacctgctgcctgcctgtcccctagcctggcaagcactcctcagtttgaccttcccaaactctcttgtgccccaagaggttttaaggctccttgaaggctggcctgggaaccacacatcttctaaagaaatggacaaggttctcactctccccagccaaggacccagatcaggtctctggccagcattcccctttcctcaagcttccagtgcccacccacttaagccctggccttccacctgcactgcctccagcccacagtggtctgacttcctctctaagtctctttatttcctccctctttaggctgcagaagcagtcatcagaccgaggggcttttcctggggattatgtgagatgatctgggcatcggtggcattcttgggcgagtggctggaggaaacacaccgggcctgggatttgagtttttctggccctgtcagctgctgtggcatgacagatttatacagcatttgcaaaaaaccagcggctgctttttctttaacaatttttcttaaaaactccagttcctattctccagcttctttgtccagtctcctcccctctcctagccaccccccagactctccagatttggggctggtgtcatcaatccaatttattaagtcctcaatgagggggaggaagggccacatctccctctgcaggccctttgaccatcttgatggcttctgctcctccctgtcccctcagctctgccttggtttccccactgacaaaggggatcttctgctgtcctgtgtgccctgaaactaaaacccagggggaggccagaaatcctcaggaagttttccagctccctgcaagaatagccaaggacagagaaatcacaggatcaggacgagcagggcaagctggagcagggggtagaacagaccaagtcctttaccgcagaggaagaaaccacactgtggaagggaaataaatagaggggtccagggcagcagagcccaggcccccagggcgcagtggctataggcgcagcaggcgagtgggagcccccggccgcttcagccactgaggaagagacgcttgtaggccttgttcatctgctccaagaagatgaaggtgaggacggtgtgggggcccaggcgggcatagtacggcgtgaagcccttccacaggctgaagaagccctcgtagcggacaactttgaacagcacgtcctagacacagacaggcagggcgctggggctaggactctaggtccccatccccctcacccagctgccttcacacctttcccaggggatccgacaccccctcccaggcccccagaatggcttcctcaccagcccgttcttgtattccggcttcccatcaatcatccgcatgttctggattctgcaggagaggacgcaggggcatgagagaccgaaagggcaccctcccacccacctccaggcccaggctgcacactcaccgggtcttggcaatgtccacaggcatggaggcagcagtggtgacaagaccgctgatcatgctggcacagaagtggcacaagatgttgtcagagaagtagcctgggggaggtgaggcgggggtggcagtcagctcagaggtggctcaggccaggctgggaactaagggcccagctctggatctcacctgagtccagtaagaactgcttggattgggagtaggaggcgagctgggcagcattgacgacgacggcccgagccatggtagggatgcagccctggagggaggggagcggggaagagtcagaaacccctaaaaccagacctcacagcccccaagtctccagcccctccactcacccgccacagtgtgaggacaccctcttcccgggtgattcgaatcagggcgttaaacacatttttgtagccacggcgctggtcagctggaagcctggtgggaaggcagaaagaggtcaagatcaggattgcccacaggtgcaaagaaaggaaggccagaacaggtaaacactctgctccagatccgggataaaaaactggtcctttcattctagattcgagggaatggggctggggttaggttcagacttggaactcaccggccatcggcagtcatgcggataagagccacttcggctggtgttcccacaaaggcaccagtggcacctgcggtcatgccaatcacagccttcagcagaaagccagggggagtaccatcagccccagtcaggcgctcaaacagcacggtatagatgccaaggcgggtagtggtgtaggtggcctgacgcagcaggccagccgacagcctgaggagcagaggggtcagcatatcaggccaaggtctagagctgccaacccacagtctaccctccatcctgaggccccaatacccagtgtaaatgcccctcaggccttctgccttcaggatactggtgagggcatggaagctggttttgtactctcgagtcttggccccttccccgctcaactgcatccggttcttcaccaggtccaggggctggacaaaaactgtagctcccatcctgggggaagacagaggtggagtgaagggccaggcattccagatctaccagtgcccactggagcctggcagcaagaggttacaaaggtcagggcctgccatgcgattcaagaatcaggatgctggtgagcatgtgtataagagtctatatgtacaccaagtgcaacgggtctgaaaagtctagttgtccagtaggggccatgcaatgaaagtgctccaagcagcttcatgacagtcaagcagtgacctggggctgcacgcagtccgacacagggaggggaggaaggggcatccaagatttaggactccaggtagtcctgcaggagccatttaatggcctggaaccccctgccgcccggccgagcttagcaatgcgctgggaaactcagctggcccggcgggggttgtgcaacgaccctgcatgcagtccataagggtcctgcaatggggccctagcagcccatcggggaactcgcaatacgctggagatcgcgctgaccccgtgccggcacagttcactgcaacagacccagagatgaaccgggcccggttccttttgcccttcccttcctcctcttttcccatccctggggcctgagcttacccggccaggcccccaaacaggaacttgacggacttaggggaggtacggggcttcccgtctatcccgccggccccggcactcgccgtcgccgccatcgccactcaatggccctcggctccgggtcccgtgcgcgcgcggccccgctcgcgcccaaggtgacaccgcgcgcgcaacagagcgagggcgcgcgcacgcccctccagctctcaggtccgacacccgctggaagccggcgcgggcgcaggcgcgcagcgcaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggtttgtaaactaggaggctccgggtttccgggcacttttattaggtcgtcttctgggccaccagtgccccttccatctccacaggcagtccctccatcgctaacctttttttaaccggccttttaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggccgctgtgctgtggggagcggccccgacccgggggctcattcgagcggtgagtctgagggacggatggggaaagggcgctgaaaggaagggttgcaggctgaaggggaacatcgccttttttgtccgcagacctcggaccacaatgccagcatggactttgcagaccttccagctctgtttggggctaccttgagccaggagggcctccaggtgattttctttcttttcttttcctccttccctcccttccttccttttctgtcttttttctttttttagtatttcgcaagatcctccatcctaggctggggttggggaggtttgtcctgggtgaaactggaggtaggaaaatgaagttaggaactgagcacgtctagtgtagaacccagaatctagagggagaagacagagtgtccacccctggaactccgaggttatcagggagactgaaagtggacgaagacagaaggcaggatcaacggtccttatcaggaaggtctcaggtgctagttattgcttatatgactttgggcaagttaatctctctgagccttagtttgttttactgtaaaatgggatattagaagttttcctagggttattgtgaagatcaaagtagatacgcaattttggtagtacttcatcccaaagactgccacatagcaagaactcagttgggccttagtagcagtcgagttgtttgtgagatgggtaattagaaaattgaagaggccgggcgcggtggctcacatctgtaatcccagttcaagaccagcctggccaacatggagaaaccctatctctactaaaatggcaaaaattagctgggcgtgatggtgcacgcatgtagtcccaactacttgggaggctgaggcaggagaatcacttgaaaccggaaggtggaggttgcagtgagccgagatcgcgccactgcactccagcctgggtgacaaaacgagactccatctcaaaaaaaagaaaaacaaaaagaaaactgaagggaggggagtgtgtctgtatgagtatgtgctggagaggggactgtgaaacagaacttgagagaaagtgacatgggtggtttgagaattgaattacaattggaatattagaaggcaaaaataattgcattagcttgcagtatagggtacagattagcccatctgggacagcgagagggatgatgggagagtttggtgaagggatgttttatgtcattgccttttcaagaggctaagagaaggttgtgatggtgggatgctcactcagaccccaggaaggaggaggaagtgaggatagaggatgtgcagcatgtgggctggtgtgtttggtggcccctgtagagagcagaatctagaaaggagaaatctcactgttgtttgcttccatccttcaggggttccttgtggaggctcacccagacaatgcctgcagccccattgccccaccacccccagccccggtcaatgggtcagtctttattgcgctgcttcgaagattcgactgcaactttgacctcaaggttgctgaatgaggaaggggagctgggcagctgagggtaaaaaaaaggcaccaggaatgaagacaggtaaggcccatgatggctccttgtcctctgccttgtctccctaggtcctaaatgcccagaaggctggatatggtgccgctgtagtacacaatgtgaattccaatgaacttctgaacatggtgtggaatagtggtaaggctgggggaatctatacagctgggctttcagtaggacccagagatggtgggaaggctgaaggcctcaggaaaagaagccaatcctttaggtggggtggggccaaagtgcaagatgccagggttcccagaggatttgagtagaaggttgtgagtccccagagtaacaccttgatccctgcagaggaaatccagcagcagatctggatcccgtctgtatttattggggagagaagctccgagtacctgcgtgccctctttgtctacgagaaggggtaggacatgtgcctccttcccattcttccttcagcaagcagttccatgccaacctggagcccaggcctcctcattacccgaaccattcagcctcctgtccttccttccctgcctctttgactttcttcccattcctgtccccacctatgggctttgtccagagccagttactttgtccctctttttttctccctttgcctttctcgccctgctgagactggtcatccttttcccagggctcgggtgcttctggttccagacaataccttccccttgggctattacctcatccctttcacagggattgtgggactgctggttttggccatgggagcagtaatggtgagtagctgagggaacatgatgggaagcactgaggcctgtgaggccagactggatctggagttgggagatgggagtggcttgtcctagattgtctagttttgttcctaagccttgtccatccacccccgcttcccccagatagctcgttgtatccagcaccggaaacggctccagcggaatcgacttaccaaagagcaactgaaacagattcctacacatgactatcagaagggtgagggggttaggggagaagagggcttttcccacagtttacctggttctgaaggactttgagcccagaagatagggtatacaaagatggcagtggccgggcacagtggctcacgtaatcccaagtgcctctaatcccagtactttgggaggccaaggtgggcaggtcacttgagcccaggagtttgagaccagcctgggtgacatgataaaacagaaaagtcccagcactttaggaggctgaggcaagtggatcccttgaccccgggagttcaggccagcctgggcaatgtggtgagaccccatctctataaaaaaataaaattagctgggcatggtggtgtgcacttgtagtcccagctaattgggagactgagacaggagaatcacttgaaccaggaaggcggaggttgtcgggggctgagattgcaccactgtgctccagcctgggcgacagagggagtccctttctcaaaaaaataataataaaaataaagatggcagtaggaaggtttcagcttgagatgctgtcttttcttctgtttttatgcataaatacaacgaagacgggagaggagatggaaagcaaagatgattaagtgaaataattgtgggaaacaatagagggacagactttgcttataggggatgtggacagagcagaaaaatgggaggaatggggaggattcagttagagaaggaagaaaccggtaccaaggggctggggctttaggccctggggcctccagtgcccgtataaggctgtggcagaagccctgcccatttccgttccttccactccctatctccaccctcacacctccccaaaaacccacttcccttcttacctctgcttctctttgcttgtcccttctagccctaaattcttccatgttctgccctgaccttatcctgcctacctgtcttatctcttccactggctttgtaggtgaggggaaatttttgcaaggctttaaaagccttagccctgggtcattgtggctcagtgaaggactagattattttctttctgtcccaggagaccagtatgatgtctgtgccatttgcctggatgaatatgaggatggggacaagctgcgggtactcccctgtgctcatggtgaggccctcactgcctgcccatgcccctctgccaccagcagccaccaggtgcttcaccttgttcctctctgcagcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtctaataaccccccacacatacacctctggtgacctatttgcacagaccgtcgtcttccctccagtcttctgagggataggggacattccatcccaagcttctcccttacccacacctatccttttgaggggctttggggtggggctggggcaagcagagggactgggtcttcacttcttgggctaataaaattgtttctttgtggactaaggaagggtaagatcattctcacacaggtgaacttaaccctttggtggaatcacccctttagccataaggagcaagggaatgctgagagacactaacctatagtcatggggacagccccagccggcatttgctatgactcagaagggggagccccacccacaaggatgactcaactagccctgccttgcctgcaggcctgcacccattctctggtccagatggctctattccatcatccaccaatttgaccagcacactgaggacttaggcctggaaatgccactgtggaggggcagggccacctggccagaagctcaaattcctgcaccttgtagtacctcaacctccctgctcccaagccacgataaaggaggcaagtcacagtgcctatcccccattctgacacccaagctcaaatcacacagcaccttgttagtagaatcttttttattcagaaaaaaaaaaccccaaaaaacaaaagttttccaaccacacacgggagggatatgggtagggggaggtgtctgtccatccagccctggcccccagcccatgtggttttggcagcaataaggggtatggggtaatggcccaaaaaataaaatggtttgtgtgtgtatggggaggaaaggggtgcaaagctgtggggagcggtgaaggggaagggacagacgaggtcagtactgggaacgccgaaggtgggaggccatttcataacatttcttgttgatcaaaccaccgtggacaccttctttgcccatcagcaggactagcgctggaggaggaggaaagagaaaggaggctaggatccaggtgtcacaattccaccccctgccagctgttcagcagctgtccagccctgggggctgtaacccaacctcatctctcccaacccgcccccccaccacacacaggcaggctgtcagtcaccctgaaacaataaggcttttcaaaagaggaaaatcaagcttaaacgctggagaggaacagactaaaaacttaggggtcaaaggctcatagactgttgattcatgtgttcaggctagaaagggctgtggatgtgcatgccacctccaggttctaacaaaagaactcaaacgatgaactcgatgattcaggaccccaacaatctacctatactcctagaaaacagtttctaatccgagctcaaggcagtaagtaatttaagaggtaatgcagttcagcaacttcgaattacaagatgaggaactgagacagaatggagggactatcccatgttccagcatccagcagacaaggaacacaatactggtctgactcccttcatgttggggaatcacacaaaaaagcaccctcaagattaccagaaggcggtacattagagatcttggagctaaaggaagggtaagactcaggaactcactcttgtcagtcttggtgacagtgacattgaaggtgggggccccaccggtgctcttggtacgaagatccatgctaaattccccatcctgcagcagtgagtcccggatcaccgaacatttctggcccccaagtgtcagcccattcacgtaaaaacttgaccggtctttgccaaccaggacacccacctcagctggctggaagaggaaccaagcgcccatcaagttagtcagtgcaccaagattcccaccgtgttctccaaagacccacctgtcttccacttctgagaaccaccccgccgtgggggctaagtataaattatatactcagtacacatcaatgaactgtgagaaactctgaggactgtgggacgttagtgcagaaaaagatcatgattctgaaacttagaatatggaaccagggaggaagggatgacatactcctctagagatttagatgtcagtgttaatggggaaagtaaacccaggaaataaagggagtcagtgaggtaagtgaggagcctttggatgctcagaactctccttcaggaaaagcagaagcggagaggggaagggaggggggcgggcgaggcaagagaagcaac

SEQ ID NO: 15810 - DNA, 6202 bp, Human
  misc_feature (1)...(6202): n = A,T,C or G
cctcactgcaaaatgagtctgttttccagcatctgtctaaagttttgctattaactcctctccctttgactcctttttaaaacaactttaggccaggcacagtacgctcacacctgaaatcctggcactttgggaggccaaggcaggaggatcctttgagtccaggagttcaagaccagcataggcaacacaatgagaccctgtctctacaaaaaaaattaaaaattagccagatgtggtagcacacatctatggtcctgactcttcagaaggctgaagtgagaggtcacttgagcatgggagtttaaggctgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaagttttttgttttttgagacagggtcgcgttctgtcacccaggctggagtgcagtggcacaatccatggctcactgcagcctcgacctctcaggctcaagaaatcctcctatctcagcctcccaagaagctgggaatacaggcatcagccaccaagactggctattttttttaatttttaatttatactttttaaaaaattatttgaatttatttatttattagagatggagtttcactcttgtagcccaggctggagtgcaacagcgcaatctcagctcaccgcaatctccgcctcccaggttcaagtgattctcctgccttagcctcctgggtagctgggattacaggcatgcgccaccatgcccagctaattctgtatttttagtagagacggggtttctccatgttggtcaggctggtctcgaactcctgacctcaggtgatccacccgcctcggcctcccaaagtgctgggattacaggtgtgagccaccaaacccagcctttattttttaaatataggagatggggtctcactatattgcccaggctggtctcgaagtccttagttcaagtgatcctcccacctcagcctcccaaagagctgaaattacaggagtgagccaccatgcccagcccccaaatttttttataaagacagtatctcactatgttccccaggctagaccattcagtttaactgagtctaaccttcatgtgctaaccttgggcaaactagtttcattcttgataatctactataaactgttacaaacgatctttccaaaaaaggtaattctggtcataacacacttcttaaaaaccctttaaaggctcaaatgtcttcagactcaagtccaaagtacatagcttgcaagccttttcctgattccgctcctctctccagcctcaccattgtcatacctaacccccaccacgctccgttcactccaggcaggcagaatcccttgctggactccacatgcgctgttcccgtcacagcaccatgctgttgcctatgccgtctcccttttccactacaagctctcatccacgtagttcacctttaagattcagctcacgcctgtaatcccagcactttgggaggccgaagagggtggatcgcttgaggtcgagttcgagaccaacctggccaacatggtgaaaccccgtctctactaaaaataaaaaaatcagccgggcgtggtggcgggcgcctataatcccaggcacccgggaagctgaagcaggagaatcgcttgaacctgggaggtggaggttgcagggagggagatcttgcgactgcactccaacctggacgacagagtaagactgtctcataaataaataaacttgtgtagaataaactagaggccacagacagtgtcaagaagatggacaggtctgaatggcctcgggctaggggatattccactgtcgcctctgactacgggtggtcctgtggctgaggcgcagcgggccctgggagttgtagttcatcaagcggaccgaggaggcgaggctgcgctgagcatcctgggaatcgtagtgctcgctacacggtgccctctgcgcaggcgcacaccgagagccacttccggaacaagcgtcgcgtttctgaggagaaactcttggtgagaattcccagagtgataatggctacctacagcctggcgaacgagagactacgcgctctggaagacattgaacgggaaatcggcgccatccttcagaatgcaggttcgggatgcgacaacctggacagcggggagcgaaagcgtgaccgggctgcactggcagcctgacctgggacttggagcagggttggggagggaatcctacgtgcgtgcgcagcgaaagggcgggactgagaggggctggcctagggagaggctacactggcagtctccgtgtgtccccgccctctctccgccctggcaggtactgtgatcctagaattgtccaaggaaaaaactaacgagcggctcctagaccggcaggcggcggccttcaccgcttcagtgcaacacgtggaggcggagctgtcagctcagatccgctacctcacccaggtcggtgtgtctggggggttctgcgagcgaaccccagctctgggtcaaagcctcaggcttgggtgatccagggtggagcattaactgggcaggaccagacctccccagccggccatccagagcgggtttcttcctctaaaaggaaagaatgggccgggcgcagtggcttgacagagttcgagaccagcctggccaacacggtgaaacctcgtctctactaaaaatataaaaattaggccaggctcggtggctcactcctgtaatcccagcactttgggaggctgaggcgggtggatcatctgaggtcaggagttcgagaccagcctggccaacatggtgaaactccgtctctactaaaaatacaaaaattagctgggctggtagcgggcacctgtaatcccagctacttggaagggtgaggcaggagaatcgcttgaacccaggaggtggaggttgcagtgagccaagattgcagcactgcactccagcctgggtgacaaagcaagactgtctcaaaaaaaaaaaaaaaaaaaaaagccgggcttggtggtgagtaccggtaaccccagctacttggaaggctgaggcaggagaatcgcttgaacccaggaggcggaggttgttgtacttagccgagatcatgccattgcactccagcctgggtaacagagcaaaaactctgtctcaaaaaataataaataataaaatgaaagaattaaaggtggccctgcatacctcactgggtaacatcacatgtgcctagcagaagatgtgtaaataatgctagaactacagaactttgtcactggaaacttggcctgacctccaggccacgaggtcccaaatccttatatcctgagaagagggacaggattgagaaggttctgaaatcgtcgcagggaccactaccattactaatttttacggtgtgccagatactctgcattactttatctaatcctcaacaactctaggaagtagttattgtcacccccattttacagacaagattaacataagttaaatgatttatttacccagctaccagatggcctaacaaattcaaactcagggaagaaatgagacgagacctgatgcctggttggagttagggtaaaggagatggtgctccattgatagtctgtcttgtaggtggccacagggcagccccatgagggctccagctactcttcgaggaaggactgtcagatggctctgaagcgagtggactatgcccgcctcaagctcagtgatgtggctcgaacctgtgagcagatgctggagaactaggccagggagatggacccagagctgagagggagaccatcacctgtgccatgggacagaacctgggaacatgtagggtggggagtatgagcaccaacataccctgctggtcaaagtaccctaggacaaaggggcaaatggtgggcatggaaaaactgaagcccgagcctgcccacagctatgccttggcctctccagcagggtgctcctgctctgcactccagaaacaccctgacaggctcagagaggagatggaaactgacatacccaacccacttcctcaaacacttcatgctgctgccccagccttcccgcagacttggcctaatgaaaatacatacttcttcattcggagagacaaaacaagaactagagttttaatgataataaaagcaataataataaaagcaataacaataaaaacaagatcagactctcactggggtaggcaagggactgaggaggtgaaaccaacccgtatggtgtcccagcacggcacctgctaaggagggagggtgggaaagcccaggccttcgttgcgggtacaggaggatgcaggagagggctgaggtgggggaggaacaactggtgtactgggagagagatttgggacgagggggaaccatcagcaaaaaatgaagccaggaatcacagtaagggcgcaagggctgaggccagttgtttccataaagaagactcaatcattacaaaaataatttttagtagttaaaaaacacacatagggccaggcatggtggctcacacctttaatcccagcactttgggaggcctgggtgggcagatcaccaggtcaggagttcgagaccagcctggtcaacatggtgaaaccccgtctctactaaaaatacaaaaaattagccgggtgtggtggtgagcacctgtagtcccagctactcaggaggaggcaggagaatcgcttgaacctgggagatgggggttgcagtgagccgagatcatgccactgcactccagcctggatgacagagcgagactccgtctcaaaacaaagcaaagcaaaacaaaacaaaatacacatagaatttgtccaagttattatcacccagtgtgaaaagcagattttatagtataaccgtttttaaatgaggggcctaagagagggcagtggctggttagtcctatgttagatattaacaaatacgtgtaggctggatgtggtaggtgacgcctataatcctcgcaccttcagaggccaaggtgggaggatcacttgactcaggagttccataacagcctgggcaacatagagtccgtctctaaaaaacaaaaaacaaaaacaagtatgtatacagtgcctaccatgttgtcaggggtcagtctcctttattacactttttgtaagaataagccacagtttaccctcacaaacttccattcttggctcaggtattagagtcaggtgccacaggtatataatgaaccggcagatctggaaaggataaagaaattgagagatgagctctgagatcaaggacagtgtttgggggatgagagcttgaactagggaatcagatgaagacatcaacactatgacctggcccacagtaggtgctcagtgaaaatttgtgaattgaatgactggccctcacctccctccacagcttcatctcccactagcttgctctagccatcttctccatgatgttgctccaagcactagtccttgtgcctgtggtggcttccttccctctccactgtctacagtccccgactgactgtcctcagagggcccagagtcaaccttgtgcagacaaccttgatacttgtgtgccaaggccaggtttccagccacctgagagccactgggtcaggatgcctgtcaggaaggctctgggtccctggggggagggttcaaaggtccagtttacctggagaggactgcggtgactgccccctcctcctcttgcacagcacataggaaagggctgcggtgaggatgaagatgatggccaggaggcacaggaccggcactgtggctgatgtcctggctgtgggaccagcatttttttccggctgcttctggttctccccagcctcaggcccaactgccagactgtggcccgcagtgtgaatggtggtttcattgggacgagtgagctctttgtccgaggacagtgatcctactgggagggtggggcgctgagtggactgcaaggtggacaggagcatctgggcaggggtgtggatatctgaagatgccccctctgaggcctgagaaattggggggctggtaggaagtaaatgcttctggtgggccacaatccccgagtaagcatgtccacattctggaaaggaaagaaatgaggaatcaggactatcaggagacaaggtgaaaaagcagatagaggtgtaggggagaaaaagtaatatcttttcctcac

SEQ ID NO: 15811 - DNA, 13436 bp, Human
tgttttggcagggtgctgattggtgcatttacaatccgtgagctagacacaaaagttctccacgtccccactagattagctagatacagagtgtagacacaaaggttctccaagtccccaccagagtagctagatacagagtgtggattggtgcattcacaaaccctgagctagacacagggtgctgattggtgtgtttacaaaccttgagctagatacagagtgccgattggtgtatttacaatcccttagctagacataaaggttctccaagtccccaccagactcaggagcccatttggcttcacccagtggatcccgcttgggggccgcaggtggagctgcctgccagtccgcatgtgcttgcactcctcagcccttgggtggtcgatgggactgggtgccttggagcagggggcggtgctcgtcggagaggctcgggccgcacaggagcccacggagggggaggggaggctcaggcatggcgggctgcaggtcccgagccctgccccgagggaaggcagctaaggcccagcgaaaaattgagcacagcagctgctggcccaggtgctaagcccctcactgcccggggctggccggccactccgagtgcggagccgccgagcccacgcccacccggaactcgcgctggcccgcaagcaccgcgcgcagcccgggttcccgcccgcgcctctccctccacacctccccgcaagctgagggaaccggctccggccttggacagcccagaaaggaactcccacagtgcagtggcgggctgaagggctcctcaagcgcggccagagtgggttccaaggccgaggaggcgccgagagtgagtgagagctgccagcacgctgtcacctctcaccactgcactccagcctcggcgacagagtgagactctgtctcaaaaaaaaaaaaaaaaaaaaaacaagaaaaagaaaaaaaacttctgcgcatccttcagaaagactgtcctcatctgttccccgctctggacagcctgcactccctccacccccgcccgggccaattgctgttagcggctgtgtcttctgactcagacctctgtaatagcattcctgggtaatacctgtgtatgtgtctcctcaactattctaggaaggcaggggccatggtaattcgtatgtgtccccatcgattggcatagtgaatagcataacataggcacggatggatgggtccatagatggaccgatggatgggagcgggtgagtgagtggatgttagctgggatgggtgggtgaaggagatggatagtcagagacattggaaaagggaaccctgcgaagatcaaatgcaaacaccaggaggagctgacacgctgcagtgaagaagcgggagggctggccacagaaggcggcacgctccgagtggagcaggtgagcggcgcgcactgaagcaagcatcacgcaattgaaccgctcacccacgtgttcccccccaccatcctccttcccagacggcgcttcagctcattccaccgcccccagcagcccggtcgcccccaccgccactgagaaagcaaacaaaggggaggagacccctgcaggttctggatgccgaaggccaatcgaaagacttagatcccctggaaggcgggcgccttggtttaggggggtccaatcggtttcaaggggttgcagcggggcggggagatgggcgggaggagtgggagctggccccgcgcgcgggggagggctaccaggctgggaaggagcgcgaagggctgggggcggagccaatggccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccaggtaagggaggtggggccacgcggcggggcatgggcggcggctcggggcgggggctgggacggtcccagacgagggcgcagcggagaggatctgggggccggacgcctgggtccctagggacagccatccggggccgcacgcgcaggtcctcgaggataatgagggtgggggggaaatgcccgggcccctgcagaaagcgaggcctgagggggatcagaaaaaccggtgtcggggttctcgcagggatgtggggccagactactgggctctcccgtgcaggctgcgatgcagggatggaggaaggaggagcaggtggctggccccgaggggtcgtgtacggggaggctggatgccgggacgggggggatccactccagactcgcgccaagccaatggaaagcctcctatccaatatcccccaggtagtcgcgctgcccacacctgtcccgagggccgggtggctcctcacccaaacttctaccttcccttgggttgccaggagcaacagcttcatcttgggggagccgagtgcgtggcgaccctccctgaaactagatcgtatccctctctctgggggtgggggaggcagtattcaccctgggcgcgcgtccactccccggatgttttctgtgcaatcgaggctctttccttccactgataccccgagttctcttttttggtctctagcaaaatccacttcctgttgtgactcaacacccccaaggggcaaggggtggatgcctgagtcgcaggggagcgggagcaaaagacgaaaaggttggggctgtaggcctcaactcagagggtatcaggaatagggaattggtcctgagctctggcttgctctgcaaaacatcatatcaaccccacttccaacctatagagtatgagaacccgggtttctgagcatcaagtagacgagcatcagaaagagatcatcagagagatgatccgtctcctggatcagggtttaaacatcccagagaaaggggaagttgctgacttgtgggaggcccctgatttccgtcatgtggttcagggagtgggacagatggaccgaaggagactgctaacttggcacaatttccctcacccccatgaaattctgggccacaggaaatggagcgaatagcaggaagtgtgaaaggacatctgcttcagctacccctgctcccactgggcacctccctggtcatccccacactctgcctccttggccagcctagtatatgcacgctgctcctccccagcctggcaggaggtggctgggttaggatccaaagggcaagtgccttgcagctgctccagggcaattgccccagaaccacactccagttggcccactgattgtggctgtcacagccctgtgccagggctcctaatgggaggacaccctgggacaaagaggaaaaccagaagcaaaggggagggagagcctggatgatgccacggcactcagctcccaagttgggatgaaagatagggtgtttattctagcggctaccatatcgatgtgtattctcttttattggttaggaatacctggggccctccataccctttgccttacaacctttggacagcttggctttctgggaagaaggggcaagtgaagttgtagcagaaactgggcctatggtagaaaccatgtagggccaaaggccagggtcattgctctcctatatgctccagctgtcagagctggagaccagatggaaagatggttaggtcttacccagacactgtggtaacctgcccattggggtcctctgggaatggggtggtagacttggaagagggatgggctagttggcaggatttcacgtttctgctatctatctgaggatcctttccagggatcactgctgaggcagagtggattggaaggagtaaggtggtgcttcaaagaacaggcccacaattggccagatcactggggttgccaaacacttccttaccctcccagcaatgggtggagtccaggcttaaattgtttcagcaactggaaagcaaataaccttcaattcaacaaactatttatgccaactgcagagacagatagtgtaatattgatcgagaggatggactcggagccagactgccttggtttctattaattcccaccatttactccctctgtgaccttgaaacacttgacctctctctgcctcagtttcctcacctgtaaaacagagatattaggagctccatcactgggtggttttatttaatttaattaattaattaatttatttattttttgagacaaagtcttgctctgtcacccaggctggagtgcagtggctcaatctcagctcactgcaacctaaggccgggcacggtggctcacgcctgtaatcccagcactttgggaggctgaggcgggtggatcacctgaggtcagaagttggagatcagcctggctaacatggggaaacctcgtctctactaaaaaaatacaaaatacaggccagacacagtgactcaagcctgtaatcccagccttctgggaggctgaggcgggcggatcactagaggtcaggagtttgagatcagcctggccaacatggggaaaccccatctatactaaaaatataaaaattagcggccgggcgtggtggctcacgcctgtaatcccagcactttgggaggctgagacaggtggatcacgaggtcgggagattgagaccatcctgactaacacagtgaaaccccatctctactaaaaataccaaaattcgccgggcgtggtggtgggtgcctgtagtcccagctactcgggaggctgaggcaggagaatggcgtgaacccgggaggcagaggtcgcagtgagccgagatcgcaccactgcactccagcctgggcgacagagtgagactccgtttcaaaaaaaaaattagccaggcatgatggcaggcacctctaatcccagctactcaggaagctgaggcatgagaatcgcttgaacccaggaggtggaggttgcagtgagctgacagcgtgccactctactccagccttggtgatagagtgagactccatctccaaaaaaaaaaaaaaaatacaaaacatagccgggcatggtggctcactcctgtaatcccagctactcaggaggctgaagcaggagaatcacttaaacctgggaggcggaggttgcagtgagctgagatcgcaccactgcactccagcctgggcaacagagtgagactctgtctcaaaaaacagagtattacaagagatgacacatttgaaacacttggaacagtgctgggcatggagtagtcactctgaaatgttagcagcattaccatcttcatgatatggctggcattgtgctggagatgccaaattaataaggcctctgaggctcacagtctgaggagggagggagctaactatccttgtgtgctaccacaccacaagtaaaacataaacaaggtgtgacaggaacccaaaacaaggagcgaccagggtctgggctgggtcagcttcctaaaggctgggccttaaaagacaaataggcttttaagctcttgaggtcggagttggggacagttggaggtgagtagagtcgaacttgggtagggcctgtggtagaaactatctgagggccaaaggccagggtcattgctctcctatatgctccagctgtcagagctgtagaccagatggaaagatggttaggtcttatccagacactgtggctacctgcccattcgggtcctctgggaagagcctgggtggttcctagggcaaccagtggccattactggggagggaaggggacgaatgagggtggacaagacaaggggcatttccccttgccaccacgttagaaataggaaggaccttccgggaagaagggttccccttgccaccacgttagaaataggaaggaccttccgggaagaagggttccccttgccaccacgttagaaataggaaggaccttccgggaagaagggttccccttgccaccacgttagaaataggaaggaccttccgggaagaaggggaaaggggcagagctgggcaaagccccacagcctcaggcaggaggcctgggtgagcactgcttctcaggcctgggagggagagggtcctggtgtggggtccctgctgagtctgagggaggcagtggggtttccctttctgttttgttagggtcttcaagaagtcgagccctaactgcaaggtgagtctccacagcacttacccttttgaccctccctgggccccaacaaagcccagccttcccctagacgatccccaacctacccaaagatgatccccaacccctagctccccacttcctgtgacagctaagcgccgacttccttccctcctgaagccccttgccgcagaggctgctcagcctgagccagccacagggctgggtggggcaggcttgggtccccaagcaagaccacagaggaggaggccaaaagcaagccatgtgcctgtagccctcctaggagccaacccaaggtgcgtggggctgggaaaacctaacagcccccgggctatggcctatttatcctagagccccttgaggggacctagtgagggtggcagctgctctctagctggctggttgggctgagttctccccgaggatccaaacacacacacacacagacacacacacacacacacacacacacacacctggctggttgggctgagtcctccctgaggatgcaaacacacacacacggacacacacacacacacacggacacacacaaacacacctcgctggttgggctgagtcctccctgaggacacacacagacacacatgcacatacatgttcacacacacacctgactggttggctgaggacacacacacacacacacacacacacacacacacaacacaaacacacacacaccgggctggtgggcagaggtgtgcagagataaaggagcagctcaaaagcctaaaggtccactagtctgagaaacgccaccaccctcactttccaacactattgggaggaaacctggaacaactccttcctgatagcccagcctggagatccccgggcagggcagccagttttgagggctccgatgccctgtcaccatcctccccaatctcccctgtgaccccttgacatcctcagctcaccgtgtacttgggcaagcgggacttcgtagatcacctggacaaagtggaccctgtaggtaagttttcccagaaagggacagctcgttccccaagaggggaagaagttcccgggcccaggaaagcggggagcggccctttcaggaagtgagctggtgtgtccccctcctagatggcgtggtgcttgtggaccctgactacctgaaggaccgcaaaggtactggccccaagtccagggggcccagggaaagtgggggctagggaagtgaaatgggctggccttggaagggcgccccagagagatggaggctggaggtggaagccaggagtagggttcaggcaagtcttatgctgctgagggaggagcagcggctgctaggtgccaggggactggggaagtggggctcctgaccactcatctcaccctcccttgccagtgtttgtgaccctcacctgcgccttccgctatggccgtgaagacctggatgtgctgggcttgtccttccgcaaagacctgttcatcgccacctaccaggccttccccccggtgcccaacccaccccggccccccacccgcctgcaggaccggctgctgaggaagctgggccagcatgcccaccccttcttcttcaccgtgaggatgcccctgccctctgagggccagggggctggggctgggactgtgtctggggtgggggtaaggcactgctgtgggcagatctggaagaaacagtgaggcagggaccctagatccacttcccttcagggtcccagtgcattcaggaagcccttgattatctgcctcctctctggggccccttccttcttcccttctcatccccaggagtcctttctccagcctcttttttgttgttgttgagacaaagtctcgctctgtcgcccaggctggagtgcagtggcacaatcttggttcactgcaacctccgcctcccaggttcaagtgattcttatgcctcagcctcccgagtagctgggattacaggcacgcaccaccacacacgactaattttgtatttttagtagtgatggggttttgccacgttggtcaggctggtctggaacccctgacctcaggtgatccgcccaccttagccttccaaagtgttgggattacaggcatgagccaccacacccagcgtctccagcctcttaggttgagatttggaggaagatctgggggctttctggaagaactgaagtcttctctttcctccgccacagataccccagaatcttccatgctccgtcacactgcagccaggcccagaggatacaggaaaggtacgggaggaacagctctgagggctcctagggcaggacatgggccagcaggagcctggaggcacagctgagccagagggtgaactgtcgagatgccagggtggggccgagggtaggccagtgtcccccgtggaagtggggcgtatgtggtggtcattgtgcacgcatgacactgcctcctgctctgtggacccgcatggatctggggatgggggctccccttgcactaccatgaccaagcctctgccaggttctgggctttggagaggaagaagacttagtccccagggtcgtgagaccacaatgaggcaagagtccctgcccgagaggagggaagggggaggaagaaagggcagtgatggtggcgggagcctccggtaagatgtggccttttctcccctccccgaggcctgcggcgtagactttgagattcgagccttctgtgctaaatcactagaagagaaaagccacaaaaggtaagggaagtgacctcctctgtggtgtaagaggaggctttcctccccgcttccaggagcccaggccccgtgcgggggaggagtagggttggggtgtgtgaggaatgacccctcctgcccctactctgatcccaggaactctgtgcggctggtgatccgaaaggtgcagttcgccccggagaaacccggcccccagccttcagccgaaaccacacgccacttcctcatgtctgaccggtccctgcacctcgaggcttccctggacaaggaggtggggcgtgagagggtgacacggatgccacggtgcagtttagaccctgggggaggggcgaagccacacatcaagaggacatttgtaaaggaggttgccttggctgggtgtggacagttgccgtgggcttgggtttgaggggagggggccagaacaatgtgtctgtgtttggggacacactgatgatgggaacagtgaaaaccagttccaattcacatgaccccctccccccaaaagctgtactaccatggggagcccctcaatgtaaatgtccacgtcaccaacaactccaccaagaccgtcaagaagatcaaagtctctggtaggaggtggggtttggaagggggtcttcggggagggcgttactgcacaggtggctcctggtgtgatctcagcccaggccatttcccagtgcgggagacccaccagggctcaaagaatttaggttgttccagaatgatacggggagcctcggtgtttactgcttcagtggggagcatgggggggccacgccacggggtctggagttgtggtgtggtggtggcttgtgctccatccagagctgcctgaccccgtcccaccccacagtgagacagtacgccgacatctgcctcttcagcaccgcccagtacaagtgtcctgtggctcaactcgaacaagagtgagtatcgggagagacccatgttccaatctaggggagaagagcaggatcaggagaatgtgaggtggaggaagaattcttcctgagccatgtccaccttttttttttttttttgagatggagtttttgctcttgttgcccagcctggagtgcaatggggcaacctctgctcactgcaacctccacctcccgggttcaagcgattctcctgcctcagcctcccacgtagctgggactacaggcatgcaccaccatacccggcttatttttaatagagacgaggtttcaccatgttggccaagctagttgcgaacccctgacctcaagtgacccacccgtcgcggcctctcaaagtgctgggattacaggcgtgagccgccgcgaccggccaccatcttcacttaaaagggtattccctccacagccaggctccaggctgttaattttcttgagcacgttgagccaaaacctactcccttgtgacctgtgcccaaagaaacaagggactagtgagggggagatgctgcttgggggtcataggccgccccttgcccagcccagcgcccctaagcatcttgttctcttgtccccacccccagtgaccaggtatctcccagctccacattctgtaaggtgtacaccataaccccactgctcagtgacaaccgggagaagcggggtctcgccctggatgggaaactcaagcacgaggacaccaacctggcttccagcaccatgtgagggtggggctggggcgggtcccctgcaggccaggggccagacgtcggttcagtgctctatcctagtgtgccagggatgtatcagtgaacagaagagacaaaaagaactcttacattctaggggagggaggatagccaaatctgatcagtggtcactgtacggcaggtttagtgacaagtatgaaggagaaaaagccaggcagagaaggaagggatggggggcagtgaggtgcgaaggtgaattcggagtaaggacccagcggaagtaagcaatgtgggtgagcaggaaaggagggttctgggcagagagaaaacaaagactcagaggtggggcagcctggggtgttggaggaatggggaggtgccatcgtgccctcgggcaggagcagccctggaggtccccagcttcacaaagggctggatttcacctctccggatgcctttgttcagggttctcactgcacagccacacacagcaggcccggagggcaacttagggagaagaactaagtaccaggagaggaggaggaggtgaggtcaggggctaatggagagccagacggtgcaaggctgttagcggagaaggacgtcagcttttcctggagaggagccaaggaggctctgagcagggagtgcagtgcgcactgtaccataaccgcacggcctgggctgctggggccctgggggcctgtgcgagtttgtggtcctgcccagagtccccgtgggaaccccacggtgggccaggtgacagggtgataggccctggtctgactccaacaccctcaattgcagcgtgaaggagggtgccaacaaggaggtgctgggaatcctggtgtcctacagggtcaaggtgaagctggtggtgtctcgaggcgggtgagtgtcatgggggagcctgggtgggggtcacactggctctctctagtcccatgtcgtcgtcctcttcacgatgcctctccccttccccagggatgtctctgtggagctgccttttgttcttatgcaccccaagccccacgaccacatccccctccccagaccccagtcaggtgagcacactacccaccccaagccctcagagggagggcctgaagcagggccagtggaggaaaactggcccttccagcacccacccccacaccccctcttcccgtccccccagccgctccggagacagatgtccctgtggacaccaacctcattgaatttgataccaagtaagaaactcattcccctacttgaccctcttgggacaaagattcctataacattcaaatctgccctcatacctcttccttgcttttggtggggagaagcggattgtagcatcaaatcaagatgccttagccttgtgaggctgcctcttgctgccttttctttgtcccttcctgtaaatacctctggtcccactgctgttcgaacgcctctgtcccagaggcctagcttcggggagggcagggagtgggaggctgggacaagagtcagaagccctcacctcacaaccctctttcccaccaccaagctatgccacagatgatgacattgtgtttgaggactttgcccggcttcggctgaaggggatgaaggatgacgactatgatgatcaactctgctaggaagcggggtgggaagaagggaggggatggggttgggagaggtgagggcaggattaagatccccactgtcaatgggggattgtcccagcccctcttcccttcccctcacctggaagcttcttcaaccaatcccttcacactctctcccccatccccccaagatacacactggaccctctcttgctgaatgtgggcattaattttttgactgcagctctgcttctccagccccgccgtgggtggcaagctgtgttcatacctaaattttctggaaggggacagtgaaaagaggagtgacaggagggaaagggggagacaaaactcctactctcaacctcacaccaacacctcccattatcactctctctgcccccattccttcaagaggagaccctttggggacaaggccgtttctttgtttctgagcataaagaagaaaataaatcttttactaagcatgagtgtgtgttttctctgtagtgtttagagagtgtatggtgtgcttatccatgattctgttagcttgtgggggaggacccagtctctcttctgcacccaaaagccacctgacacggaggctatcagcaaatgtttattggatgactgtgctgtggctgtgttccagggtaaatatcaaaacttgacttagtccaaactcaagggtgaggcttgataaggccacaaagtgaacttagtcatttctagaggtcacagtaactaaactaactcgcctgcacacagatgctcacgggagctagccagggcaggcccttccctgttgcggccgacgcacatgaccacctgtgacctgttgtgaccgagtcacgttcatttccactgctccttatggctgctcgagccatctgctcctgtggctcagcggtgccacaaccgcaggcctcaccagacaagccacgtgacgtctctggagtctggtacctacattctaacacagaagctgaggcttgggcagcaagaacgtcatgctgccgtgggcccctgtcctagggaccacatcttagtgctgttcatgggatattcatcagggactccctgaggcttgaccgaagccccaggctgggctggagggaggtagcatcactccacgaacatttctcacctccatcatctgcttccactcctgaagcccaatctttctcctaaagctccttcatgcattccacaaacaatctggatttgagtccctacaa

SEQ ID NO: 15812 - DNA, 10281 bp, Human
taccgatgcagccgggcatctcccacagtaagctgtcggggctttcggggatccccagagcccatgggacaggccatgctgtgacagaggagagcataggcccaaggagccaggtccttggtccctgagccccagcttgcggttccctgggctccatccactagcagatcaatgcccaagatggtgccatgctcatccgtcacaagtaagagacaggaaacgtgcaggggggcagcctctggggaaagagggaaaagttgaggtggtagggggcagcgagagacaaatgtggtcagggtcaggagtaccaaactcaaatacctacggggctaggcaagtaacctcactgagtaaagggctctgggtagagagggcacgctccttctaaaggggacagctgctacagaggaccagaatgcgctgccatgcagaaatgtaggcccactgtcagagcttgagatttttcttgggaatgtgtaaatccagacttctggatactttttttcttgcaatgtttaaacattaaattaaaaaaaaaaaccccactgtgggtcaataaaaacaccttttcaggccagattggcctgaaggccagcactcagaactagtggcaggggagggctcccgaagggaggatggctgggcaaggggtagggcagggccagccctgggttcttaccactcctctgtcccttcctcttctggggtcttgtttcgttctccaccctgtcctctcggcagccatccttgccacctcctgcctcccgggcagcctcctctgactctcctggagggtttgtttcctggggggactccctgctggtaggggctagctcccggtcctcctctggttccaccttctctgtgctgcctgcacccccgtcctctctcttctcttcttcttcatcttcctcctcttcctcctccccttcctccccatcctctaggctgacaaagctgatgtaggggctcaggtctcgcaggtggagtggagggttgtctcccaggagccaggcagtccccaggcctggtccaggacctggttctgccccttgccccaggctgatgcccacactatggttgggcaggacatggagcacccaaagggcagggtcctggggtagccttctgatctgggcctccagctgccggcagcggccctcaaggctagtccctacagctccacgctctgccacaaactttcggaaccagccgaagagaagggcagtgaaatcaaggaactcatcccggtatccagacacaaactccatgtcttcagcggcacagggccccggcccagactgagcaaaagaagggatatatggtgagggacaggagagcaatgatggagtttggggctgggtcacaaattgagggagagggtaggtttgagagtcacttagggttggatccgtggatatgctaggagcggagaagaggatttttcagggctgaggatgggagtttagggaggaaaatgggggctggacttgaaagtgggtgaccagggttggagaagactactcagggatgagatggtatttggggcttaaaattggagagttcacaccctcaaaagcagagtttaaattaaggctagagaggagagagggctaatcctatcgggaacggtttggtggggagggaagcattttggatgcgtctgtggggtatgggagtgggagcgagggggttccctgggctcggatctgcgtggcgggcagccccggtagacctagcccctcccggccgccccactcctccggtacctgcagccgccaccacttttcgaaggtaaatacctcgcggtggagggtgcgcgggtgcggttgtgacgtcagggctgcccgagccctcgccggctcagcgggcggccacgccccccgggctcggtgcgtccgcgggtggctgccccgcaggtgcgcgcggccggggctggcggcgactctctccaccgggccgcccgggaggctcatgcagcgcggctgggtcccgcggcgcccggatcggggaagtgaaagtgcctcggaggaggagggccggtccggcagtgcagccgcctcacaggtcggcggacgggccaggcgggcggcctcctgaaccgaaccgaatcggctcctcgggccgtcgtcctcccgcccctcctcgcccgccgccggagttttctttcggtttcttccaagattcctggccttccctcgacggagccgggcccagtgcgggggcgcagggcgcgggagctccacctcctcggctttccctgcgtccagaggctggcatggcgcgggccgagtactgagcgcacggtcggggcacagcagggccggggggtgcagctggctcgcgcctcctctccggccgccgtctcctccggtccccggcgaaagccattgagacaccagctggacgtcacgcgccggagcatgtctgggagtcagagcgaggtggctccatccccgcagagtccgcggagccccgagatgggacgggacttgcggcccgggtcccgcgtgctcctgctcctgcttctgctcctgctggtgtacctgactcagccaggttagccgggggcggggcaggggacccagattcccctgtcacgggaagggggtgagttggggaggggacacgaggcccacggagttgagtggatgaaggcagcggggacaagaggaaagccagccagccgcctggggttggggacagaggcccggggacgcctggctccgggcgggattatggatgttgtcgggggcgtgatgatgtgtgggttgagcctggcgctctgaccctgggtccaccgagaggctgtcatggggctgtggattggatgccagggaacagcggagtggggaccctgggcctgggaatgggtgccgaccacctccgtcccgcgcaggcaatggcaacgagggcagcgtcactggaagttgttattgtggtaaaagaatttcttccgactccccgccatcggttcagttcatgaatcgtctccggaaacacctgagagcttaccatcggtgtctatactacacgaggtaatttcacctgcctctgcgagggcagcgcctgggcggcccctccttgcaggtgcctccaggaccctctctggtccagcctgaactccttcccggctcaccgagccccatctccgggttccgtttgctctcattccccgaaacttcatgactccgtctcacctactggggagtttcccagtcccaggagaaagggctctttcttggtggcaacttcacgcctctggaatgaggaaggagccggggaaggaaagaaggcgccgcagctaagcccaggtctctcctccgcaggttccagctcctttcctggagcgtgtgtggaggcaacaaggacccatgggttcaggaattgatgagctgtcttgatctcaaaggtgagacttttccactgctcttcaggctctgcctccagggcttagcagcttccacctgacagttttctttacctgagccttttcccctggggccgcacattcctagaaccttcttctgatcctgtccaaagtacttagactcgagtccctgtttgccaaacggggtgatcattcaccatcaccttcatgagttttgccaattcattctaccacgtgtgctattgtctacttattaatatttttcttgaaatcaaagtactattttattttatttttttgagatggagtctcactctgtcacccaggctggagtgcagtggcacgatcttggctcactgcaacctctgcctcccaggttcaagagattctcctgcctcagcctcctgagtagctgggattacaggcgcgcaccaccaagcctggctaatttttgtatttttagtagagacagggtttcaccatgttggccaggctggtctcgaactcctggccttgtgatccacccgcctcggcctccaaaagtgctaggattacaggcgtgagccaccacacctggcctatttttcttttccaatattttattatgaaaatttacacatatacaaaagttgaaagaatggcacactgaatatccagtgcctccacctagattctacaattttatttatatatgtatattttacatatttacataaacatatattttacactatcaattttacagcaattacacgatatttgctttattaagtatccatctattcatttttctatccatcatccatcaccttatttcttgatgcaattcctttttttttttttttttttttttaatggagtcttgctctgtcgcccaggctggagtgcaatggtgccctcagctcactgcagcctccgcctcccaggttcaagcaattctcctgccacagccttccgagtagctgggattgcaggtgcccgccaccatgcccagctaatttttgtatttttttagtagagatggggtttcaccgtgttggtcaggctggtctcaaactcctgacctcaggtgatccacctgcctcagcctcccaaagtgctgggattacaggtgtgaaccgcagtgcccggcctcttgatgcatttcaaggcagattgtggacatcattgcacttcatcccaagacatttcagcatgtatattaagtagagttcaatattttaatgcttttttttcttttgagttcaaatttacatacaatgaaatgaattacttttaagtgtgcacaaactagttttgaaaacttaagtagaggccaggacggtggctcactcctataatcctagctctttgggaggttgaggccggtggatcacctgaggtcaggagtttgagaccagcctgaccaacatggtaaaaccccatctctactaaaaatacaaaattagccaggcatggtggcatgtgcctgtaattccagctactcaggaggttgaggcaggagaatcacttgaacctggaggcggaggttgcagtgagccgagatcaggccattgcactccagcctgggcaacaaaaaaaaagaaagaaaacttaaatagtaaattatcctaagcaataatatctgtgaagtcacaagtttgatgcattggttatatttttctcttaaaataaatatacaaccattaaaatacaaaaggttcttccatgtcctagctaaagttttgtaggatctgtgtcatccatactgcctttaagtctgcctagacctctatgatttcctttcatcctcccaggaaccctggcccttggtactacaattatcctcattttacagctggaagatatcacttccggagaggttagggacaaggggtgaggttacacagctacttgaggttacacagctactttacagcagagcttggaatccaaccctggtcttctgatttcccagttcatgacacccacttgtctcgtggttcgctcacttccttgtcccctaccttttccgtctgtcatctgccttcctcttctggccttcagcgtgataacctccctgactcactcttccctctgttggagctcagaacatgacactccaaaacatggcaccttggtaattaagaaaacagcagaagtaagtagctcactctgctctttctgtttttctgtgagagctggccataaaggaattctctaacttcacgtggaagtaggtcataggctctcatttcagaggggtcctgccctatacttggaggccaagaagaatctggacaggccttgctggtcccccaccccccatttattgccattagatcatatcctttttgtccaatcatacttttttttttttgagatggagtttcgctcttgttgcccaggctggagtgcagttgtgcaatcttggctcactgcaacctccacctcctgggttcaagcgattctgcctcagcctcccatgtagctgggattacaggcacatgacaccatgcctggctaattttgtatttttagtagagactgggtttctccatgttggtcagactggtctcgaactcccgacctcaggtgatccacccacctcagcctcccaaagtgctgggattacaggcgtgaaccaccgcgcccggccaatccaatcatacgtctatacagctgtccattcttcacagcaagcctaagcataaaaatgcacttttcctcgggtctttgtttctgaaggttcctatgtcatgtaaaactgtgattaaataaatgttaggcttttctcttgttaatgttttttatttataggggtatcagccttgacccttgcgatgggtgaggaaaagatattactttttctcccctacacctctatctgctttttcaccttgtctcctgatagtcctgattcctcatttctttcctttccagaatgtggacatgcttactcggggattgtggcccaccagaagcatttacttcctaccagccccccaatttctcaggcctcagagggggcatcttcagatatccacacccctgcccagatgctcctgtccaccttgcagtccactcagcgccccaccctcccagtaggatcactgtcctcggacaaagagctcactcgtcccaatgaaaccaccattcacactgcgggccacagtctggcagttgggcctgaggctggggagaaccagaagcagccggaaaaaaatgctggtcccacagccaggacatcagccacagtgccggtcctgtgcctcctggccatcatcttcatcctcaccgcagccctttcctatgtgctgtgcaagaggaggagggggcagtcaccgcagtcctctccaggtaaactggacctttgaaccctccccccagggacccagagccttcctgacaggcatcctgacccagtggctctcaggtggctggaaacctggccttggcacacaagtatcaaggttgtctgcacaaggttgactctgggccctctgaggacagtcagtcggggactgtagacagtggagagggaaggaagccaccacaggcacaaggactagtgcttggagcaacatcatggagaagatggctagagcaagctagtgggagatgaagctgtggagggaggtgagggccagtcattcaattcacaaattttcactgagcacctactgtgggccaggtcatagtgttgatgtcttcatctgattccctagttcaagctctcatcccccaaacactgtccttgatctcagagctcatctctcaatttctttatcctttccagatctgccggttcattatatacctgtggcacctgactctaatacctgagccaagaatggaagtttgtgagggtaaactgtggcttattcttacaaaaagtgtaataaaggagactgacccctgacaacatggtaggcactgtatacatacttgtttttgttttttgttttttagagacggactctatgttgcccaggctgttatggaactcctgagtcaagtgatcctcccaccttggcctctgaaggtgcgaggattataggcgtcacctaccacatccagcctacacgtatttgttaatatctaacataggactaaccagccactgccctctcttaggcccctcatttaaaaacggttatactataaaatctgcttttcacactgggtgataataacttggacaaattctatgtgtattttgttttgttttgctttgctttgttttgagacggagtctcgctctgtcatccaggctggagtgcagtggcatgatctcggctcactgcaacccccatctcccaggttcaagcgattctcctgcctcctcctgagtagctgggactacaggtgctcaccaccacacccggctaattttttgtatttttagtagagacggggtttcaccatgttgaccaggctggtctcgaactcctgacctggtgatctgcccacccaggcctcccaaagtgctgggattaaaggtgtgagccaccatgcctggccctatgtgtgttttttaactactaaaaattatttttgtaatgattgagtcttctttatggaaacaactggcctcagcccttgcgcccttactgtgattcctggcttcattttttgctgatggttccccctcgtcccaaatctctctcccagtacaccagttgttcctcccccacctcagccctctcctgcatcctcctgtacccgcaacgaaggcctgggctttcccaccctccctccttagcaggtgccgtgctgggacaccatacgggttggtttcacctcctcagtcccttgcctaccccagtgagagtctgatcttgtttttattgttattgcttttattattattgcttttattatcattaaaactctagttcttgttttgtctctccgaatgaagaagtatgtattttcattaggccaagtctgcgggaaggctggggcagcagcatgaagtgtttgaggaagtgggttgggtatgtcagtttccatctcctctctgagcctgtcagggtgtttctggagtgcagagcaggagcaccctgctggagaggccaaggcatagctgtgggcaggctcgggcttcagtttttccatgcccaccatttgcccctttgtcctagggtactttgaccagcagggtatgttggtgctcatactccccaccctacatgttcccaggttctgtcccatggcacaggtgatggtctccctctcagctctgggtccatctccctggcctagttctccagcatctgctcacaggttcgagccacatcactgagcttgaggcgggcatagtccactcgcttcagagccatctgacagtccttcctcgaagagtagctggagccctcatggggctgccctgtggccacctacaagacagactatcaatggagcaccatctcctttaccctaactccaaccaggcatcaggtctcgtctcatttcttccctgagtttgaatttgttaggccatctggtagctgggtaaataaatcatttaacttatgttaatcttgtctgtaaaatgggggtgacaataactacttcctagagttgttgaggattagataaagtaatgcagagtatctggcacaccgtaaaaattagtaatggtagtggtccctgcgacgatttcagaaccttctcaatcctgtccctcttctcaggatataaggatttgggacctcgtggcctggaggtcaggccaagtttccagtgacaaagttctgtagttctagcattatttacacatcttctgctaggcacatgtgatgttacccagtgaggtatgcagggccacctttaattctttcattttattatttattattttttgagacagagtttttgctctgttacccaggctggagtgcaatggcatgatctcggctaagtacaacaacctccgcctcctgggttcaagcgattctcctgcctcagccttccaagtagctggggttaccggtactcaccaccaagcccggcttttttttttttttttttttttgagacagtcttgctttgtcacccaggctggagtgcagtgctgcaatcttggctcactgcaacctccacctcctgggttcaagcgattctcctgcctcacccttccaagtagctgggattacaggtgcccgctaccagcccagctaatttttgtatttttagtagagacggagtttcaccatgttggccaggctggtctcgaactcctgacctcagatgatccacccgcctcagcctcccaaagtgctgggattacaggagtgagccaccgagcctggcctaatttttatatttttagtagagacgaggtttcaccgtgttggccaggctggtctcgaactctgtcaagccactgcgcccggcccattctttccttttagaggaagaaacccgctctggatggccggctggggaggtctggtcctgcccagttaatgctccaccctggatcacccaagcctgaggctttgacccagagctggggttcgctcgcagaaccccccagacacaccgacctgggtgaggtagcggatctgagctgacagctccgcctccacgtgttgcactgaagcggtgaaggccgccgcctgccggtctaggagccgctcgttagttttttccttggacaattctaggatcacagtacctgccagggcggagagagggcggggacacacggagactgccagtgtagcctctccctaggccagcccctctcagtcccgccctttcgctgcgcacgcacgtaggattccctccccaaccctgctccaagtcccaggtcaggctgccagtgcagcccggtcacgctttcgctccccgctgtccaggttgtcgcatcccgaacctgcattctgaaggatggcgccgat

SEQ ID NO: 15813 - DNA, 134242 bp, Human
  misc_feature (1)...(134242): n = A,T,C or G
ttgcaccattacattccagcctgggtgattgagtgagactccatctcaaaaataatgaaataaaataaaataaaatagtaaagttgagactagccactagtggtcttgtgtgattttccaccagccagatttcagctacttaggggaatgtatgtagtaggtggatggttggatttagctagagttgaggctttgccagctgagactggaatataattccaatagaaaaacctgtaatattatttgtattagggttctgtaaagaaacagaaccaatagtatatggaggggtgtgtgtgtgtgtgtttaaatttattataaggaattggctcacacatttatagaggctgagaagtttcccaatctgctgtctgcaagctggagacccaggaaagctggtggtgtcattctgagactagagggccaatgatgtaagtcccattctgagggcagaggattgatgtcccagctcaaccaatcagagagaattccctcttcctcaagccttattttattcacgtcctcaatggattggatcatgtctggtcacactggggagggcaatctgttttattcagtacactgattcaaatgagattagctcatccagaaacaccctcacagacatacccagaaatagtatttaatttgagtaccccatgtctcagtcaagttgatatataaaattatctattattggacttgcctcacatattgaaaaactatatatatgatttgaccttgaatctatagagttaattttgtttaagaaaatctttaatcagctaggtattagaggagtggttactttactttcattctcattttgaccttggtttgtatttttattctttcatacttctgatatgacttagtcctttatttaatagatataaatctgtttcttagtgtcagtagctcttctcatttagagtatatcatagcatgtgcatatttttctagttctcaagacagggaaatcttttaccagtgattttcattctttattcttcattgggtcttggaaacttgaattttaggccttttacttattctcttattttttattaagcatatcattttcacatctgataatagaatatttgtaatgtcaggaaatttttcttgctgcctcagtttatctttaaaattaagtagtgttcattaaattatctccaagatacttacgtgttctgaaaatactatgattatgtgttagatattttatactgataatataatattcatagtcttagttttattctgattagcttcaactactaatcttgttcaaggctaaattaggcccttaaagaattttacattgtctctaagcagttatagttgggctaccataacttaatggatattgtcgtattttcacaagaaggaagcaatatttgaagagcctttgtcttttgcatgcatgcctgatagtgaaggttaatactgggttaatagatccattgcttctaagcagttggaggaggactggaatcaagagactccatttggagaaaaaaaacagtttggcaataaaaatcacaactggaaacttgtgaaactcaagaattctacatgtatagaaaaaaaatcacactagaaggacattcttgtgaagcagcagttttcttagctttggattcttggagggcctattataaggcaaattatatacttatgaattaacacaattaaagtcattgggtagaaagtgcctgctgttgatgtttctcactttgcattatccattgaaaataaacgtgcaaaaactcttcttcattgaaacatttaacttttggcctttcagacaataaaatgtctctgttgctaccttgtatgcaagccaggtctttgaatccaaaggtataattttatctactgtttcagccctattgctttcatttgtctggctatggtagatttatatgaagaaaatgagggcttattgtttcagcaagtgtaatgagcaatgtgtttttcctttaggatcaaacagagcatactgaatcagcaggactggctggtggtgcagcagacatcatgagtaagcaccgagaagtctgttccttatcacgtgtgtaaggggaaaaaggtaagaaaatgtttttatttctcttagagattgaacttgagaaaccaatgagatctatagaagataatgctgatgcatatatgttacttgcatcatttataacattgtgtcttattaaatcaggagtatgctttttttcaaaaagatttgacttaaattcagaggaaaagggtatttaaaaatcactgttattttgtgtcacaatggtcacaatgttaatttccctcccagtgctggctccttcgttttagagtttgttgaccatagaaaggtaatttcagaaaaaatatggatttgagcaatatttaagctcatgcaagagctaaacaagtaaagctaatttggtgatggggaatcagaaatgtaaatttaattatgttattttattttgtatttttaggtaagttattatgtagagcaataatttccagcagaaaactggaagtattcttgtagaacaggaatccttgtctttttcctaactaggagtcatgttgttttttttcaagtcttaagattatttaagggtgtgaacccccaatatctgtgttggaaacaagtgcttgatgtagccaaaagaaacccgcacttagacagaaattttctcagcaaggcacttttacttctgcagaagggtgctgcttgcacctattacaaatgcaagagcacaccgaacaaaggaaggaaggggtttttaaccctaacacagttcctgtttctgtatcttttccctattggctagggttggattgcacaatctaagctgatcccaactagccaaggcttaaacttttccaaacagggtaaatgtgagatttgtgaaggggcggggtgggtaaagaagaaatggttagacttaacagaagcgggggtaggattgtttacaacttatgaccaggaagttgagtctttgaagaggaactcaagtcgtcccaacaatttcccctcttctgtcttacagttcttcatcttcagatttctttaacaggatctggctttgttgttcttcttgattatcaaggtgcgagagcttatctgagtacggagggggagaggttggggaggtttttgtgagagctgcttctatgagcctttgggttaacccacgaatacaaggtatgatacagcaaccgacaaggatgagtacatctttaacaattgcaagggaagtaaagattgaggtcatgagtcccttccattttccaaaccacctttccattaggcctgtaaaggggtcgtctattccagagtttttggctaattgatttgctagggtggtaaggccttgtaaggcttttatgattgtcccatcaggggctgtattattaggaataaaagtacaacactggaccgtgatcatgacatagactctgccttttttggccaacaccatgtcaagggttattctgttttcccagaccatctggctgatggggcctagtttcagcgattccttttatggcatctctggtataattgatgaattgctgctgattgtagtatatgtgatttatccagtctacgtttttgtttatagtggaccaccagaataagatagactcgaacctggcggctatttggttttgagctttgaattcatttggtaccctccgcaggaccctgatgctgtctatgtaaacttgagggtcaaaggacccatttattggggcttctttttttcttctggttacctgcttcctgatgaaatgccatggtgaaagccatggccagttgaatcagagcacaagtgccactccagttgcttggcagtgtaccaaatattggtcccccacaataccaccatacatcctctcggggatggactagggctgactgattggttatctcttgaaaaggtttaggcccactacatcccatcaggtttccaaggaatgtcaaattttccccttgttgtgaaagacacaaggtaaaattggcatcgagagctggaagttgaatggcccttgggggctgtcccataggggtcctgacctttggggaaaatagtgagtgagtggcacatgacatgtttccccaggctgtggggtgctggaagagagctaccatacagtctttgcctgatggattggcccatccgagtgggaggggaacagtttgggtttctggcctgcctgttgcacaagcgtaacaatctgttttatttagggtgcgaatggaatatttaatcaattccagctaggcatttacatcttgataactggtttctatggctagggtttgctgtaaatccttaacttctactatagctactttggttttgtcagtaggcatgaagcgagaaatggtttgatttttgtggttttgggaagcgggtaatggggggagatggaggaggaggagcaaacctcatttcaaagatgcctgtagggtcttttgcagtgacatctgctcctaggccataaaggtgctctaaagtggggatagggtcagtggaggtggggataggaatagagagaagtactgggttacactggtggttttggcaatttgagggggtggttcctttggtgaagtggaggtagggttttagggcggtgcgaccctctgaggaggtccagccctgatatttcgtggtccagataatatctccccaactataacataacccctggaaggcttgtggtcgttgattgcaagggtcgggggtggtgctggtttttctggggatggggggcagaggtacttttctgaagaagctagctgtctttgactatggaggtttccacagggtatgacaagacaggcatcgaatgtaattgtggggagggtgatcgggttacattgataataaggtgtccttgggtagctaaaggaagaataaaaagacagattaaacctttttgaatgttagtttggagggtattgatcctggaatgatggtccatgactttgcaatggttgcggccccttttagcccagtgtggtgggtccatgcttttttggccgttcagattgctgtctcagtggttaggagtattagataaggagtattagataaggtccttcccaggttggttcaagctttccttctttccaacatatgataaggacgtgatctctgggctggtgtcggtgaattgggaattcgaggggtggagtttgcgctaggaggccttgagtcctgagggaggaaagggtggaagacagaccaaatatatatatttttagaaactgatcttttgtttcaaatgtgggaaggtcagtagtggaatttagataaggcagcccatagagcatttcaggccaagatcttttgtgtgtgtgtgtgtgtgtgtgtgtgtgtgtgtgtgtgtgtgtgtgtgtgtgtgtgtggcagagtcttactctgtcgcccgggctggagtgcagtgatcttggctcactgcaacctgcacctcccaggttcaagcaattctcctgccttggcctcctgagtagctgggactacaggcaccagccaccacgcccggctaatttttgtatttttagtagagacggggtttcaccatattggccaggctggtctcgaactcctgaccttgtgatccaccctccttggcctcccaaagtgctgggattacaggtgtgagccaccacaccctgccaggccaagatctttttgaggggcagtttggattcttagtaaggcaatgggaaggcattttgtccatggtaactggatttccaagattaatttggttaggtgattttttagagtttgattaattctttctaccctccctgatgaaggtggatgccagggagtatgatattcccattttattcctagtgcttgggttagccccttaatgatgtgtgcagtgaagtgagtctcattgtctgaatcagtgttctctattagtccaaacctggatatgatatgttccaacagtgctttgactacattactggcagttgtgcttgggaagggtatggcttctacccagtgggtgagatggtctactatgactagtaaatacttgaggcagccgattgggggcatttcagtttaatcaacttggatgctttggaatggccttaaccctgggtttcttcccgtgggaggctgcttctttagggtttccttactagtttttctgcacatgatgcaaccatcttccacttgcctagtactctatacacccatagactctgagggctacattgcacatagcttgaggaccccagtgagttcctggatgaagctgtgacaatatttccctcatgaggggcttagacagcatttcccttccatctggtaatgcctgctttccctctgggctctcctgagctcctattttctttagagaaaggtctacgtgggagaagatggggatcgcagctggagggggaaacaaagggatagatggaaaatgggtgccttttcggaagaggcagcttgcttagctgtttgatctgcaaggttatttccctggctttcaaaagatggattcttttggtgtcctgggacatggacaactgcaatttcttctggcagctgaagattttctaatacttgcaaaattaattttttgtggaccaaatcttggcccttactattgatgaagcctcgttcagtccagatttttccaaaggtatggactactctgaaggcatacttggagtcagtgtaaatagttccttcttgattctgcagggattttaaggcttggtttaatgcaaagaattcacagtttgggcagaccagttatttggcagtcttcctgactctacctctgtgaggatttccccatcaactgtggagtacctgttgtacctttttccttcaatgatccggggggaaccatctgtaaagaggtgatgccctgtttggaaaggggttttgcttagatccagtctgactctagtttgagaactgattagatctaagcatttatgcgtagattcttctgggtttggatttcctgttaggaaagcagcggggttgagtgaattgtcagtggttagtgttaggtcatccctctctaataagataacttcatattttaaaattcttgagtcagtaagccatctctctgccttctgattaagaatagttctgacttgatgaggggtacttatgatgaggtttcccccaaaggttattttcctgctttcttctgttagcaaggcagttgctgctatggattggacacattcgggccatccacgggttacggggtcaaggatttttgacaggaaggctacgggccattggtggcctccgtgtttgtgggtgagtactcctaaggccactcctttgcttatattaacaaaaaggtggaatggctgttctaaggagggcaaggccagaatgggggctgttacaagtaggtgttttatttcttctacctgttggatctctgatggggtccagaggagggtttacagggtctggtctttcttgagtgagtttttgatataggggctttgtttttaaggcataagagttaatccacagatgacaatatccaaccaatcctgagaatttcctaagttcctgctttgtttcaggtaaaggcaaagataccataccttcaatttgtttgggtcctatctttcgtttgcctttactgattaggtgtcctaggtatttcacctcaggttctacgaattggagtttattctttgagacctgtaacccttgttcccttaggaaatttaggaagttaactgaaattgctgttacttgatccttgttatctcctgagatgagcaggtcatccacatattggagaaggcatatggatgaaggcagggagaaattttctagaacttgttctaatatttgaccaaatagatctggggactctgtgaacccttggggcaagactgtccatcagtactgttgttttctatcagagtcagggtcctcctactcaaaggcaaacatgtcccgactatcttctgctgaagggcaagcccaaaaggcatcttttaaatctatcaccatgaaccattggtggttgtatgggattctactgacaatggtgtaaggattgggaacaacagggtgggcggtttgaactatttgattaatagcctggaggtcttgcactagccgggatgacctgtctggcttccttacaggcaatattggagtgttataagggggcatacagggttcaaggagtccatcgtggacaaggctttcaattatatgttttaaacctatcctggcttccaagggaatagggtattgttttgtttttactgcttccctggtagtttttaatttggcatggattggaggaacctgtagctttcctcgatttccttcctttgaccatatgtcgggatggatttggctttcttccgaagtggtgaccaggtttaaggaagtaagttttccctgattaacgtataggcctatgcctaaccttaacattaagtcccttcctaataaattagttcctgctttgggaattaataagaacttagtagtggccgacttattcttatatttgactttggtttcctctagaatttttgccctgaatccttcccctataaaccctgagacagtatggttttctgctgaaaatgctaagcctgatgggagaaaacatagggaaagcgagctgctcctgaatcgactaagaaagtgactatctctgatttgggtcccaccattaaatttatcaggggctcttggtgggactcaagatggaagatgtagagtacctgaccccgctattcttcttcaaatgtcatgagtggaaggactttcttttccctctcccattcaggacattccctcttaaaatgtcctggctttccacactagaaacatctgttttcccttctccccctccctgttccctgactctcaggtttcatccctttgcttcctgtataggggtcagacagccaggtgcttagaaggtctacaagttctattctcctgggctccctgttgaagagttccctgttgtagggtggacaggcataatctttgccttttgcttctgcctttcctcatccctctctacatacaccttttgggcctcttaaaagttcctctatgggatggtctttccaattttctatcttttgtattttttttgtaatgtctggccaactattggtgacaaagtggagctttaacattccttgtcccagtgggtcctctatgtctaaacctgcatattttcttatctgttccttaagtctaagaattctatgggcctttcatctttcccttgttgtacattaaatgctcaggaaacattagggttcaaggagctgattcccaaatccctttaattatcatgtccctgagatctctcatgttttctcagtgggcttcattattgttatcccactgagggtcctgggccaggaatttatgctctgctgcaaggacattttgaacaggagggtgtttgcgctcccagactatcatggcagccctgaagatcatggttctttcctttcctgagaagagaataactaggatagacattaattcagcccaagtgtacagttgtggctccagagactgtccagtttgatctgcgattccaaaagggtcgtctaacagtggtttgagttccttttttagatttctaacctctgaactagttaagggggcatttacaaagccaatatcccctcctcctagtggtacttcccttaagggaaaaagggttggggtagacttctttgaggaagggaggaaaggaaagttttggatatccctttggcattgtctatttcccattggagctttcctgaggaaggggcatgttcaggtggctgtccagcggggatgtggggtggcatggcccatggggcagggttatatgggagaggaactgagtgttcagcttggggtggaggggtagggaggggaaggactgagtgttccacttagggtggaggggtaggcaggggaaggtggtctagaggatcccatgcatctttagatacagaatttgacttaggtaggtcgtctttgggaggtattgaatttggctttgctttctcatcctttaggggatagagaaggacaggtctttttctccaacatagagcatcatctgtctcctcttgagaaactggacttttatcattgacttactggatcaggagttgacatatccagtcctcattttacccaaactctggccaaaagactgaaggtctgagggtgggttccttagtccaaataaaaacagcaatactttatcatacgctgtcttttcttgtgttttgtcctttcattatccttccagtattttaacataaggcataggggactgtcagggggaattttattgtctgcttggccttttatagtccctgtcttacttggggtatttcccatcctggcggttggtgaggctaaatgtctcgtattagagatttcttgcactcccgtgtcctagaggctgaacctccccttttcccactggaggtttcttgcactcttgtgagcacccactttgtccttattggctgcttccctcgtgagaattttaggttcctcttagtattggtgggttggtgtaatcccctgactggaaaactgccctaagacctacaaggtgaccacagaaccgagtccggactccacactcgcttcgcacccaatggcgtgtctcactcacacactttcaacctacagagatcccaaccaccaaggaatactttgttgccccaatagtgacgtttcttaccttggtctatgcacagagttatctggtcactgaggaattcttagggatcctccctatagcccatgttgctgagagtccggatttattcgtcactttgggcgagattcgatcctccactcctggggccaccacaacgaggcagtgggatgcgtctccccatgaaagataatcactagcccctcccaaaggagaatgggatcctggacaagcccccagatttgttggaaacaagtgctcagtgtagtgaaaagaaacccgcatttagaagttttctcagcaaggaactttacttctgccgaagggtgctgcttatgcctgttacaaatacaagagcacaccaaacgaaggaaggggtttttaaccctaacacagttcctgtttctgtgtctttcccatgttggatgggtcggactgcacaatctaagctgatcccgattggccaaggcttaaacttttccaaatagggtaaaagtgtgatttgtgaaggggtggcggtaaagaagaaacagttaggcttaacagaagaaggggtaggattgtttacaacttatgaccaggaagttgagtctttgaagaggaactaaattgtcccaacatctgggacaggtctcagtttatttagaaagtttattttgccaaggttgaggacacccaagaggtcctgatgaagcaactgtgttgtctgaggtatacacccaaggttcatcgtcttgtgccaggaaaatttaggacaccgacacacacgaggagtttaggagcagaggtttaataaacagaagaaaggagaaagaaaaacagctctctctattgagagagacgggtcttccgagggaaaagactggcaggtggtggatgcgccggattttatagtccagcttgaggaggcggtgtctgatttatgtagagctcacagattggttcgatcaggtatgaagtttacatagcatgcagggaaggctggttgccccaccctaatcttattatgcaaacgaactttctccttggcaggtgccatcttatctgctccttactgtacatgtggctggcagagaagggaagatggagcctccatcttgagcatgtctagtccctagttcctgctggcattcacccgtgcaagctcccagcttccttgtctgtgtctgcagctcgacttcacagactgctctttgttagaaaatgatttccagcctggccaacgtggtgaaaccccatctctactaaaaatacaaaaattagccgggcatggtggcacaagcctgtaatcccagctactcgggaggctgaggcaggagaatcgcttgaacccaggaggcagaggttgcagtgagccgagatcatgccactgcactccagcctgggtagcagagtgagactctgtctcaaaaagaaaaaagaaaatgatttggggctacttttcattaaaaagaaaagccttactgaggactctcgtacccttactatctgcctaagtgatttcttcttaactcctgtatcactgacaacacgtgcccagggttctcagagcacaacttggttttatacattttagggagacatgagacatcaatcaacatatgtaagatgaacattggttctgtccggaaaggcgggacaattcaaagcaaaggcaggactactggaagcagggagtgggcttccagatcataggtagataaaagacaaatgattgcattcttttgaatttctgattagcctctccaaaggaggcaacagatgtgcatttatctcattgagcagaagggtaactttgaatagaatgggagggatgtttgccctaagcagttcccagcttgacttttccctttagcttagtgattttggggccccaagattttcctttcagaaggggtagaaaatggtggagggtatataggtgagaaaggttacaaaaactgattacactactcactaatggaatgttgcatactctggttgagttatctgacttttccatgtaagctgtaaggaaaggcatggtgggaccagcagtgtttaataggaaactgagccacttttctcttcagttgagggtggagcagaggtacttggcagcaatgccttcttcaccaaaactctgagtctgcagttggcaagctatttctcctcctttagccttttcacatgggagtgtgagaagatagtgccctcttttctgccttcacttgccaaaatctcatccttcaggcgttgcctctttaggaagtttccacccattgtagcaaaaactatcagttatccaccaaagtcaccaaaatccatttttcccttctgtagtagccacagctgtgatgtcacagtccaatcagcctttgcagctgtgtattcaccatcacagttaagatacagcataattctatcaccacagagatccttattgctactcctttgtagttgcatgtaccctctcccctgactatccaatatttaatgactttttaaagttaaaaacactgttaaaactcataggaagagctgggttagcataaaggcaaaccctagtatgttcctggatgagaagacttaatatcattctttctcctgagtgaggactaggttaggaattctaatttctcatggtttattttattggcactctattccatcctgctccattgctgagtcttgggaccatggaggggactttttctgtagctcctggcttcatgtagaaagctcagtttagcccctctggtgcataaatttctatgtttgcagccagtaattcttattcttcctgctacctttcaaaacccaggcttaaaggttgctgtctagttttgatactcctatggactgccactcttcagttcctgctttccttctaggtttatggcatctgtgtatttccctttcttgcttttgaatttgactgtttaaactcttttaaaatattttatttagaatttttttatttatttatttttgagacagggtctcactctgttgctgaggctagagtgcagtgccaccatcatggcccactgcaacctccgtctcctgagctgaagcaatcttcctgcctcagcctcatgagtagctgggattacaggcatgtgtcaccacacccagcgaatttttaaaattttctgtagatacggagtctcactatgttgtccaggctgatctcaaactcttggcctcaagcgatctcacaccttggcctcccaaagtgctaaactctttaaaataattagttttgtctagaatttttttatttagagtaggaaggaatgtttaccacccatcagctcagtgtgcccttttttcttttaagaaatcttaagcctgcagaaaaatggaaagactagaacaattaagacccatatatccttcagctagagttatcagtttttaccattttgtcccttttgcacacctttcttcccttcccacacatatactctcacatcatttaaaagttagttgcagacaacacaacacttcttccctaaacacttcagcaggcatctcctaagagaacaagtaagggcattcccctacaaaatcagaatgccattatcacatctaagaaaatgataattaattcaatgtgtcacccaatgtatcgtccatatccaaatttcttctgagattgttctcaaaatgttaatttatgctgtgtgtgtgtatatgtgtgttttcttgatccagaatcaagtcagtgcctgacacttggttatttaatattttgtctgttctagttgagaataatcttttttcctttttttttttttaaagacgaggtcttgctctgtcacctaggctagaatgcagtggtgcagtcatagctcactgtaacctcgaactcctgggcttaagcgattctcctacctcaacctcttgagtagctgcaccaccacacctggctaatttttatttttatttttgttgatgttgcccaggctgctcttgaacttctgggctcaagcgatccaatcctccacctcagcctaccaaagtactgggattacagatgtgagccactgcgcctagccacatataatattttggaaagttcagatcagatacagaatgtctcacattctagatttgtcttattgtctcctcatgattaaatcggctaaatgttttggcaagaatactgtataggtgatgttttatatttttcattgcatcatattggaaagtgcataatgtcagcttgttaaactgttgtggtggtactgagttaaatcatttggctaaggtgatgatttctatatctcttcattgtaaacatacatttccttctttgaaattagtgatttacctgtggaatgataatgtgaggtactgtgaatagtttcttccccaataataatttacttaatagtttagcatccatttttgatgcttgtttgaatcagttatcgtaactggaattcagtacaacttattgaccagctgcttatacactgttcatttattcattctgcagttattaattgaaatagataccacattagcacatcaggctctatgtgaatcaccaggaatacatggtgaacacagtctggtgggtgcccttgtggtgcctacagtctggtgggagagattgacaaataatcacactgatgtgtatttatagatggtgataaatattttaaggaccaagaatggggtgccatgagggattgttgttgtagaaaaagcgggttcttgtcaaacaaccaggaaagattaggctcacagacacttttttttttttttttggagacggagtctcgctctgtcgcccaggctggagtgcagtggtgtgatctcggctcactgcaagctccgcctcccaggttcacgccattctcctgcctcagcttcctgagtagctgggactacaggcgcttgccaccacgtccagctaatttttttgtatttttagtagagacggggtttcaccgtgttagccaggatggtctccatctcctgacctcgtgatctgcctgccttggcctcccaaagtgctgggattacaggcgtgagcctccgcgccctgcctaggctcacagacactttgaagggtgagggggaaggcaaaaaggaaaaaactcagcaaagcgagaggggttcctgttaacaggctcccatctcacagattgaatcccatgttaccacacaggaacaggagaggcaaacggagtgaacttcccaaggccccaccccgtcctcccagtgtgcagtgcgcaggtgggcatccagaaagaatcagtcaaacagggaggtgaacaacacacaccagggcctgttgcgggggtggggatcgtacttagaggatgagtcagtaggtgcagcagaccaccacagcacacatatacctatgtaatctgcatgttctgcacatgtatcctggaacttaaaaaaaaaaaaaaaaagaatcagttggaaaagggcaggcttcatccaggatgggcaatttggtttttcagccctcatgctgttttaaacttgaaggtggggttttgctggggtacccttggctgcctcctgtctctatctgtccccttataaggggagccatcaccttttctgggggttcacataacacttgcctttgaaagtgatatttgagcaaagagatcaaatgaagaatgatgaacttaaataacctcttgaacttctgtactagttattctgtagcacttatctgttaattttatctgacaggttaatcacttgctgtctcctgtgctgttattaaaatcatttattatttaaattttcttacttagccttgtttactgttgactaaattataagctttataatgttagggatgatatctgagacttgattacagtatagatgcatatagtagatgcagtaggtaaatatgttaatctgattatttgtttactaatatttttataatgaccataaaatgctgttaaatattgtaggtgtatattgaatgtgtcagattgtgtgttgtgagaaatttcatttgctcttagcattagtagacattaaatgtgcaacctatctgaaatggcatgcatataaaaatgattttgacctataaataattagacaacaaagatagatatttaaaaaaattcatagattatgggctgggtgtggtggctcatgcgtgtaatcccagcactttggaaggctgaggtgggcagatcacttgaggtcaggagtttgagaccagcctggccaacatggtgaaaccctgtctctactaaaaatacaaaaattagccaggcatggtggcacacacctgtagccccagctactctggagggtgaggcaggagaatcgcttgaatccaggagggggaggttgcagtgagctgagattgagccactgcactccagcctgggtgacagagtgagannnnnnnnnnnnnnnnnnnnnnnnnnnnnnnnnnnnnnnnnnnnnnnnnnnnnnnnnnnnnnnnnnnnnnnnnnnnnnnnntaggagccaatctataaatgttaaccaagttaataatcatgggaaaatactctttctttttttgagatggagcttcacacttgttgcccaggctggagtgcagtggtgcaatctcggctcactgcaacctccacctcccgggttcaagtgattctccctcctcagcctcctgagtagctgggactacaggcacacgctaccactcctgcctaattttttgtgtatttttactagagacgaggtttcaccacgttggccaggctggtctcaaactcctgacctcaggtgatctacccacgttggccttgcaaagtgctggaattacaggcatgagccacgacgcctggccgggaaatacttgaataagtcagttaaattccctgagcttgttttcttatttgtaaaatgagggaaatatcattgacacttatatacctcagagaagaagaaacactaccttagtaagtcaaagaaatttcatcacttattatatttgacttaaagtttacaaagacagcctattacatttctgattttctctgtttttcatgttttccttactcagactttttggggaatttgtaatttgacctcccctgcctgtattatatcaataagaagccaagcagaattttcagtttggaaagaaaaatttgaaacactaaggaaataggtgtggagatcatggtaatggatggaaaaaaggagataataggtagcatttacttaacacctattatgtgcccttagcatctgttaagtcattgacatacctagtgtatatgcccaaggatgcttttggatcgattaacattaaagaaatggtttagaaatggtactcgaagagggttacaagaataaccaggtcagggccaagtgcatggctcatgcctgtaatcccagcactttgggagactgaggtgggcggatcacttgaggtcaggagtttgagaccagcctggccaacatggtgaaaccctgtctctactaaaaatacaaaattagctggacatggtggtgcttgcctgtaatcccagctacttgggaggctaaagcaggagaatcgcttgaactcgggaggcagaggttgcagtgagccaagatggagccattgcactccagcctaggcaacaagagtgagactctgtctcaaaaaaaaaaaaaaaaaaaaaaaaaaggaataaccaggtcagagtcatcattagcattttggaactagtatccgttactcctgtacttaaacttccctgtcatttcccatttgaaaaaaattctgtaagcttcgttctttaatagaaacacaattttataccaaacaatgattcctttcccagcatctgaaatgtgtctgttgaagcatgaaatgatcaccaagtcagccttttatatttagttatattttgttgattgtcagcttacaggtttttagaatttattagcttaaagatcttataatatatccagtgggatgccaggttttgtagtttaccattatctggaaagatttataagagattttatccttgtgtatatacttaagatttataaattatattttaataattcaaaatgtaatacgcatttactttttaggtttaaacaagtctcttaagtggtgtttcctcaccgatggagaattacttccaagcagaagcttacaacctggacaaggtgttagatgaatttgaacaaaacgaaggtgagaatttatattggtgaatctgtttgcctatgtggtatagagaatgtggggatataagaggatgtagtatttaaaaaaataaaatcaggtctgatgacttaatgatagtaatattatttaataatatacaggggaagaaataacattttttagcactaaatgccagatacttaaaatcccacagatcttattgccattttatagatgagaatagaggcacagagaggttaagcacttttctcagagttatcttgtgaacaagtggcaggattagaatccaggcagtgtgacactagagcctgagctttactgaactaccctatacaatgaatgtatggtcaagaaatgtgcttgcatttcctaaactaagaaaaatagctcgttctatattgattgcccaataaagtaaagatacatttaaaactatttacatcacaactgcctaagtggttaattatatattctcaagcatcagtagaaatgtccacttaagattcacttcttttgtttgtttgttggttggttggttttttgagaaagtcttgctctgtctcccaagctggagtgcagtgctcactggaacctctgcctccctggctgaagtgattcccatgcctcagcttccagagtagctgggattccatacacccgccaccatgcctggctaatttttgtatttttagtacagaaggggtttcgccttgttggccaggctggtcttaaactcctggtgtcaagcagtcctccctcctcagccgcccaaagtgctgggattataggcatgagccaccacgcctggccaagattcacttctatttagggaagacttttctctaaatttccatcttggtttaacttgagtgggtaagccataattaaatttcttcctcctcaccgttcttcccctgtgttctctatttctaacaggaaatggcattaacaagtttacaaagtggtatatttccatccaaagtccatgattccagtccaggcaacatgatgaaaccccgtctctacagaaaatacaaaaaaaattagccaggcctggtggcacacctgtggtcccagctatttgggaggcaaaggagggagaatcacttgagccctagagatagaggctgcagtgagctgtgatcatgccactgtattccagcccagatgacagagtgagaccctgtcttaaaaaataataaagcccatgatttccatattggtttacaaacctttgctatattcagtgaatcgggctattctttgatagcagttgggaagacagattagttttgactttgttactttagatatttaatgctctccagccttaaattgaatatggaatcatgacaggaaggaagagagagaggaaggctaccagagtggcctgcttttctcatattttaccattgatgacctaacactaacctatattcctaggctcattcctggttcatgtaaatgtgaaatctaatcattggggttttacatcatccaggtgggctttgtacataccaggctggaaggtatattattttctgagtttcaactgtttgtataagtattttcttaatcttttatttgatttagccctctgtgtatcacagttctttgagtcataaggtacttagacatgtattacacctaatcatgtgaatactatgcttctagaataccactgactctaataaaactcttagttcattacatttgtctctttgtgacttctgtagattctattagggtgctttgtgtatagttgttttcaatacatttttgttgaatcagtaaaaatattttagttaaaaaatagagcaattgcttacagaataataactcctttagaaggagaaggatttctgaaaccagcttcttggttgtaactttgtggttcatttgtttgaactatttttttgaatctcactaccagttgcattaaaaactatcacttcaagcctcgtgttatcttagagaatatacttaaaatgatttctcattttgtgttaatttattttctcatttaaatgaaaaaatataccacagactgtgatgacactgggcaatcaacattatgcccaggtaggaggcagttgaataatgaaaattttaatacccgatcatttctgtttgaacattgctaaatattcttgtaagaagctgtaactatttttttgtttccaggaaccatattggaaatatgacttatttgcttttttttcttttaaggaatcctgtgttactaaatttcaaatctctactggttcaaatttggtaaattcaggatttgacatttcagaggatactaagcccattcttcacacaatctgagttttgtgccctttttaacaacttttcactacttctttacactaattcttttctcaacccaaactgatttacttattgcttccttaaattcttatatttggggatatgcttttctttattcctctatttattaatgctttcttttccaaacttacataaaactgtctttgaagcatagcccagttcttcttgccttcatgaattcaagctcgcttacctcatcctggaaaatatctgtctcctctgaatttatttttctactcctacataatagttttcagacactgagtcctcacttgatgtctttgataagttcttggaaactgtgactttaagcaaattgatacactgtatgccggagaaccttaactgttgtttatatcaattagcttatagtaaaattggcttctttatacagtgagttgttttgcttataattgcagtttccaagaacctatcaacaatgttaagtgaggacttactgtacctatgctactccatactgctaattagatgtttgtacgtgtctcttattctcccaatgagattatatacttcttagaggcaagagctatcatttaatcttcatgttcctcaatcctgctgcttttactatggtagatattcacttatatatttactgtgtatgttctacctatcaggcactatgcaaagtgaggacttatattgatagaaatgatttctgccttcagaaatcattcagtggttgaaagagaagggtagataaactattgcatttcagtgtagtaaatgccttaataaagttttgattaaggtgctgtggacacattgaagattaatgttacagatgaggattgagcttacaaatatatctgcataatttcaggaccatgattatcagagatactggaggaagaaagcaagaaaggcactgagtgcattgttccttatttctctaatttacttagacatatgcagtagccctataacttgagagaataacttagccattgtagttatgatctgttaaaaagtaaacagaaacattatatgaaattatgcttattggtagactataagaatgttgatttaatatgataaatgaacactttttgcccagtgtcctcagataataatataaatatgaacctgattaataatgtattgtgacatggttacaagcagaatttcacgtactgtggcaaactttttttaacatgtgttgggcaaatttaaaatatttttaagtaagaagtataataaaccccagtgtacccatcatccagctttcacagcatttcatatgctgccattttgtttcatttatacctttatcaccttctcactccctgcttcattcttattttttttaacagctttttaaaaggtaaactttatatacattagaatgcatagatcttaactgtccagttttggcaaatgggtatctctctcaaacccacatcctaattatgatacagagtgtagagcattcagtctctacagaaaacttcattttccttcctgcttaattagttatcctagccactgttctaaattttttccatctaatccattagattagcacctgtcctggctttgctcaatccaagggtgctttcccctcttctgggtcccattcacctgtgggtcagtttaattatgttactagattgaggtagaattcttttgttgtttggaatagtctgagatattaccatttggtgacatataattgcagagaattgtctgaaatatattttcttattttttagccccgaattagaaatctaatatccttggaatatttaattttcaaacgatagttagaaatgttattaacttagtcataagcttttccagtgttacaagcaaacttattgtaattacttatttttttccagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggtaagttgcatgtatacactcagaaatcgggcatgcacattttgtaatgctgaattaaatagtaataaaggcaatgtaaggtgaatatatgtctggttgagttgacctaaatagcatttttgaaaacccagttctagtaaatttctatataaaaaatgatgtcactgattcttagatagtatttgtaattttttttgttgccacgatttatgctgaatcagtttttatgaagagatgagaattgaggaagtgtaaactttgtggtttctgtattgatagctacttggttaatgtaatagtttgaaataaggaagttattctttcagtttaggaaatatttgtcattaacttattgcattatttattgaaaaatgcatttaaatacaaaaaataaaaataaaaattacatttaattgttgaaaaatattacacatagaatccatcctacttttttctgtgagatttttgccattatacaaaacattctggaactctttatacacatgcacacatatttttgtcttttctcccatataactttgatacaaagtagagttgaagtctgtagatttttatgacaaggttgtaagaatgatattccttagctctccccaaattttgttagctaaaaacacatcttttttgtttgtttgtttagagttgtaaataaggaaggaaggagattttatatttttgagatatggtgtcaggtctagaataaaatttcagctttgttactattaattatataactttactaagccttagttttataatctgtaaaaacaaaccaaaaaagattaataacttttattgggctgttgtcaagattaaatgagatctcagaagtcatagtgctcaatgattaatctctacctcccttcttgcctgattttttggtccatctgtattaattagggtgctttcaacttcaaggaacagagtgtttgaccccccagtgacttaggtgaaaataacatttatttcatgtaaacagaagctatgagactcagtgatttatgtctgggtgcagagacaggatcgtggaagttctctcggtcttcccctcatgtcagaagatagtatctcagttctaattatcgggtctcaacctgacaacttcctaagcacaaagaaactggctggggggcaaaagagcctactctactcttggcaccctcttatcagggaggaagggacctccagcaacttcctttaatttattggccaattttagaccataaccaattacaggcaaaggggactgggattatctaatcaatcatgatttatctcctggggctgagcacagtgttgcctgaaaaaaagtgggattctgttaacaaaggagaaggggaagtagtgatatgtaggatgagtaagtctagacgtctaatgtactacatgaggactatgcataataaaatcatactatatttgggattcttgcaaaatgagtagattttggttcctcttgccacaaaaatgggtaactgtgtgagacaatagataggttaatttgcttcactatagtaacctttttactgtctggatgtatctcataacatcatgttgtataccttaaatgtatacaataaaatttattttaaaaaaaggagaggaggaaaatggttcctaggtgagcagtcactaaggtttactagaagatcctagcacaaaagaaccaaattacagggagcagaaagaagctaaagctgacactgggcttgttggtctctgattgctaaagtttgaagaaaataatatgtctaattcctaaatattttccagtcttcttcttgttagctgaagtactatttgtagattaggttcatcatttttatgttgttctgtattttgcttactgtaacactttctgaagtgtttgctttcttaagtaaataatgaaaacatttttggtataggccagcacatccagctataatgagtaaataggtaccttagatggattcagaaagaaaatgatgcacaaaatgcatcataaattgcaaaatggttggaatttttgctgagtagaatttgtggaatttatgaattcatggattcatgtggcttatggattcataatttcatctttttccctcgtttaccttagagatgttataagtattaatgagataatatctgtaaaaatccttgagcttctcagaagaaaagggcttataaacatagatactaattggattatgctgagaatgcagctagaaaaataccccaaataatgttatatattgaaaaaaagaaagtttgttccatttcagtagaaattaagcatacgtagtaattacttaatatttatagctatattccctttactgcaacaagcatatattgtgtctaatatataaaaggttctaggctaggtaatggggattcagaggtatataaattggaatttatgatgtcatggcaatctttttttttttttttttttttttgagacagagtctctgttgcccaggctggagtgtatggcgtgatctcagttcactgcaacctctgcctcctgggctcaggcaattctcctgcctcagcctcctgagtagctgggaccacaggcatgcgccaacgggcctggctagtttttgtatttttagtagaggcggggtttcaccatgttggccaggctggcctggaactcctgaccttaagtgatccacttgccttggcctcccaaagtgctgggattacagacatgagccactgcgcctggccaatctactgactttctaattatgatttcatttatgtcttatctaagtttattatttgtttttgtaattcagttccaagcttgatgagggtaaggattttttctgccttgattgctgctgtatcctcagccctagaacatacgggtgctcagtagatatttgttagatgaattaaacaataagtgaatactgtttcttaatgcagcagtactttttttttttttaaatccagtgccttcaatctttagatgatggtatcaaatttagatataacgggtgtaagaactttggaaaatattttaaattagtcatgtgtattgttcctacttaagaacagattcaaaccaaaatgtttctttccctagtttcttatgtactgatgggaatgaatagatatgagagtagtaagtagctgctttagaatattacatggcaattcacagtttccctcatactttgcatgaaaatctgtcttgccttgtaattgatattgtgattttagccatctggcatgaaaaaaacagaaccaacatttagattaatcttggtttctagtgaagctgaacccagggaaatattttccattacacaccctctgaaaggctgtattggttaaaagtggtctcatccatgtcatagcacttatcatgcagtattgtctttgtctttgttccccattaggctgtaaagatcttgagattgcctctgatttgtctttgtatccagcatccagcacaaatacctggcacctatgaagtactcaataaatgtttgttaatgagtgagtaaatgagtctcagatcattgattaattcaacaaacactgagtgcctgttatttgtctgtcactgtgctgggtgccgagcttacaccaatgatgttgtgctccccaccctcatggtatgtaaagattaggccagtgacaaaaacaaaacaaaacaaaaaaacatgatttgtggcaagggcgatgaaggagataaggagggataatataaaaaatgggggtgggagaagaaggtatgagaagacatctgagaagtgacatagttcaaggttgacacatcaaggttgacacataaaggtggaggagtcagttcttcaaagaacagagaaaaatgctgcaggaagtagaacagcatggacaaagtcattgaggttaagaaggcacctattcaacaaactgaaggaactcctgcaggaagtagaacagcatggacaaagtcattgaggttaagaaggcacctattcaacaaactgaaggaactccagtatagtgaacgagggaagagtcacataaaaagagatgggaaagcaggtggggtggcacaggcctgttgtcccagctactccataggctgagcatgttatgatcatgtctatgaatagccactgtactccagccagagtgacagagctgagaccccatctccactaaaaaaaaaaaaatgctgatgaggaagttaaggaatagatgatgcagagctttgcaggtcatgtaaggagcacagtgggaagccatgggagtggatgagattaccaagggaagagaatagactcagggctgagcccatgtggtcaagcagaggaggacccagtaccagttgccaaggagtgagcggagaggtaaatagaaaaccaggaaaatatggtctcttggaagtcaaaagaggaatgtagtttgtgaaagggtttatcacctatataaaatactgtcagtaagatatggacaggaaagggaccattggacttggctataacagggtcattgaaaaaagctgattgagtggagcaatgtttacagaagccagatgggaatgggttgaaagtggaatatgaagggaggaagtggtgatggctttttcaagaacttttgccatgaaaacagaaaaaaattgtagcaattattagatggagatggtggttatggatgcctttttggaggatgggaaatactgttgtatttttatagtggtatgggtgattctctagaaaagaagttttaggagaaagggaggattaaacaaaggaagagaaaaatccttgagaaggccaaagggatgggatctacaacatgttgaggatttgctcttcagtgggtggggctagacagaggttggtttatgaagttagtggtgagagcatgaagaaatttacacctgattggcttatacttcatatagaaaatataaacattgtgaagggtgaaatagggatagatgatgaaggtttgaggagagtgagatagttacattggagaggaaaagtaaagcctaatagtgaattgaaatttcaagagccctttgtgcttggcatcaaactttcagtcagttagatgaattaaaaaataatctagtccagtcctgacttaatgggttagaatcagtatttatccttggagatatgatgaaattgttatattatctttgcgatacaagcattttagtttggagaagcaagaagagttctgtaggacccgtctgtgctactacctgtctacctatttccatgtatttgttcttttttaaaacaatttaaaaaaacttttagctggatgcagtggctcatgcctgtaatctcagcactttgggaggctgaggcaagtggatagcttgagatcatgagttcgagaccagcctggccaatatggtgaaacctcatctctgctaaaaatacaaaaattagctgggcgtggtggcaggggcctgtaatgccagctactcaggaggctgaggcacgagaattatttgaacccaggaggcagaggttgcagtgagccgagatcgagatcacgccactgcactccagcctgggtgacagagagagactctgtctcaaaaaaaaaaaaaattatgacatattatttgttctttcattcagtgagcatttacttattgcttggtattctgttttttactaaagagaagcaaaaagaaaaaaaaaaaggaaaagaatgggcctcctggtaaaacataccactcatgttactgtagatgacttaaagatataaaatgagaaatgaacagttacaaagctgcagatgctctgcagtgggaagcagatagattgtggtggtggtggtggttgtgaggagaatgagatactaatatttattgagtgtttaccatgtgccaggcgcttttctaaatccagacttacagactttatttaatacacataacaaccctatgaagtagctagctactgttaaaatccacatttacaagtgacaaaataggcctagaaagattaagtaacttgttcaaaatcacacagccagtaagtgaagttacgattcaaactcagggactttgacttctagaaccaaaagggagctagcatttgtttagtgcctattctgtgctttatttattatctaacttaatcttcctggtaaacctgtgtgatagttgatggtatccctaattaacattgaagaaactgatacggtaggaccctgacacagtcttgctagctgtataactcatgctctttcccataaataaagttgagagaataaaacaaataggtttctttatggtgatctttatgttattttctttgcatttctgagagaaatgtctgcatttatgccataatttttatttttaatttttggagacagggtctcactctgtcgcccaggctggagtgcagtgatgcaatctcaactgactgcagcctctacttcctgggcccaggcaattatcccacctcagcctcctgagcagctgggactacaggcacacaccaccacacccagctaatttttgtattttttggtagagacaggatttcaccgtgttgcctgggctagtctcaaaactcctgggctctactgatacatcagccttggcctcccaaagtgctgggattacaggtgtgagccaccatgcctggcctttatgccgtaatttttaaaacaaatgccttaaatactatttcaaaaagaaagatgaaaaatatctaacattttattagatataaatttttattttgaatagttatgtgttaaattagttgcagtttatttttgggtaacttgagttgaagtcatttttgtttaacatttgagaatttagatgtgaatagagaataaccttcataaaatctgaattagtaacacattaagacaaataatgttttggcttataccttcagagatcagttttcttaaggattttttttatcctgttttttttcctgggttttttttttttttgagacaaactcttggtctgttgcccaggctggagtgcagtggcatgatggtggctcactgcaaccttgaccttccaaggtcaagcgatcctcccacctcagcctcctgggtagctggggctacgagcatgtgccaccacgtgtaactaattttttttttttttttttttttgagatggagtttcactcttgttgcttgcccaggctggagtgcagtagcaagatcttggctcactgcaacctctacctcctgggttcaagcgattctcctgcctcagcctcctaagtagcagggattacaggcacctgccaccacacccgactaatttttttatttttagtagagacggggtttcatcatgttggccaggctggtctcgagctcctgacctcaggtgatccacccacctttgccttccaaagtgttgggattacaggcgtgagccgctgtgcccggccactaattttttaaaaaatttaatgttgcccaggctggtctcgaaatcctgggctcaagggatcctcttcacctcggcctccccaagtgttgggattatatgtgtgagccactgctcctggctgcctttgattttaaaacatggccactggttgggctccttgggaagcagaaaggtagtagtaggccctcactcagtaccaaatgttattaacagataacttaggtgcaaagtgggataaaacacatgtagctagaaaatgtttgcactaagttcatgctattttttgtttttttgcatctcttctcctgaaagccatctccctttcaatatctagtctgctgatacattctaaatactagtcacaattttttattgtaaaatatgcataacataaaatttaccagtgtatatgggtttgagggtatatggttcagtggcgttacatgcattcacattgttgttgtacaaccataacaactatctccagagctttttgtttttttttgagacggagtctcgcttcgttgcccaggctggagtgcagtggcgcaatctcggctcactgcaacctctgcctcctgggttcaagtgattctcctgcctcagcctcccgagtagttgggattacaagcacccaccaccatgcctggctaatttttgtatttttagtagagacggggtttcgccatgttagtcaggctggtctcaaactcctgacctcaggtgatctgcccgtcttggcctcctaaagtgctgggattacaggtgtgagccactgtgcctggccatttttatcatctcaaacttaataacttcccatctttccttgcccctaatgcctggtgactgctattctaccatctgtttgtatgaatttcactattctaggtacctcatataagagtggttacacaatgtttgtacctttgtgtctacacatttcatccatgtcgtagcatgtattagtcagaaggacagaaccaataggatgtggagatatatagatatatatatatgactttaataggtaggatatatgtatatatacgagagtttattagggagaatcaactcacatggttagaaggtgaattcccacaataatctattggcaacctcgggaaagagaagctagtggtagggctcagcccaagtttgaaagcctcaaaagcaggaaaaccaacagtgcagccctcaatctgaggcctaaggcctgagagacccccagaaggctgctagtgcaagtcttagaatccagagcccaaagaacctggagtctgatgtacatgggcaggaggagaggatataagcatctggcaaggaaaaagagaaagcaagcaggaagactcagcaagcaggcttatctttgcttcttctgcctgctttgttttagtgcactggcagctgattgtatggtgcccacccccattgagagtgggtcttcttctcccagtccactgactcaaatgtcagtctcctctggcagtaccctcacagagacacccagaaacaataccagccatctaggcattcctcaatccagtcaagttaacacttaatactaatcatcacatagtgtgtatcagagtttcattcctttttaagtctgaatatttcattgtatgtatgtaccacattttgttaattcatttatccatcaatggacacttcagttgtttccacctcttgggtattaccaataatgctactatgaacatgggtgtacaagcatctgtttgagtccctgctttcagttctttgtgtatatacccagaagtagaattgctggattatatggtagtcctgtgtttgattttttgattaagcaccatattctttttccactgcagttgcacaattttccattcccgtcaacaattcacaagagctccagtttctccacatcttctttggctctgtgtccccacccaaatctcatctcgaattgtaatccccatgtgttgggggaggggcctggtaggaggtgattgaatagtgggggcagatttcccccttgctgttctcataatagtgagttctcatgagatctggttgtttgaaagtatgtggcactttcccctttgcatgctctgtctctcctgttccaccacggtaagatgtgcttgcttccccctttgccttttgtcatgattgtaagtttcctggggccttccagtcatgttccctgttaagtctgtggaactgtgagtcagtgaaatcccttttcttcataaattatccagtctccagtagttcttcataacaatgtgaaaacagactaatacacttgtcaacacttgttttctattgttttgatatagccatattaataggtgtgaagtggtatctcattgtggttttggtttgtatttctctgatggttagtgatgttgagcctcttttcatgtacttactggtctctatattaaaaatctttggagaaatgtctattcaggtcttttgcccatttttaaattgggttgtgttttctgttgttgagttttagagctctttatatataattcagtctcctatcacataaatgatttgcagatattttctcttattcttgggtttttcattctgttgtcctttgatgcaccaaagtttttaattttgatgaactccaacttacattttcttttgttgcctgtgcttttggtgtcatatcaaagaaatcatctccaaatttgatgtcatgaagtctttcccttatgttgtcttctaagtgttttgcagttttagtgcttgcgtttaggtcttttatccattttgagttaattttttgtgtatagtattagcttagttttattcttttgaatgtggatatctggttttctcagtatcatttgttggaaagactgttctgttcctatggaatggttttggcactcttgtcaaaactaactggaccatataagtgagagtttatttctgggcttttttctattccattggtctttatgtctgtctttaatgtcagtaccacatggttttgattaccatagcttcatagtaagttttgaaaacatggaatgtgagtcctctggggttgtagtttgtcaggattattttggctattctggatcccttgagattcaatttgaatttgagaatggatttttctgtttctgcagaaaacatggttagggttttgatagagattgcgttgaatctgtagatcactatgggcattgttgacatcttaataataagccttctagtccatgaacatggaatgtttttccatttatttgtatgttctttaatttcttttagcaatcttttgtcttttgtagttttcactgtacagtattttacctccttggttaagttaatttctaggtattttattctttttgatgctattgtaaatggaattgtttccttgatttcatttttggataattcattattagtatgtagaaatgcaatggacttttttgttgatttttgtatcctgaaactttgccgcatttattagctctaacagtttttgtgtgtttgcggggaatctttaaggttttctaaatgtagcatatgttgtcagtatacagagataattttaccttttcctttccaacttgggtgccttttatttatttttaattgctctggctaaatttccaatactatgttaaatagatatggcaaaagtatgtatccttgtcttgtttctatcttaaagcaaaagttctttcagtctttttttttttttgagacagggtgtcattctgtcacccaggcttgagtgcactgccatgatctcagctcaccgcatcctcaacctcctgggctcaaggtatcctcccacctcagcctcccaagtagctgggactaacaggcgtgcactaccacacctggctaatttttttttatttttagtagacatgaggtctactgtgttgcccaggctggttctgaatgtctaggcacaagcgatctgcctgtcttggcctcccaaagtgctaggattacaagtgtgagtcaccatgcttggccagttttcagtcgtttttgttgttgttgttgttgttgttgttgtttgtttgtttgttttttgtttttcttttttgagatggagtctcgctctgtcacccaggctggagtgcagtggcgcgatcttggctcactgcaacctctgcctctcgggttcaagcaattcttcttcttcagcctcctgagtagttgggattacaggcacatgccaccatgcctggctaatttttgtatttttagtagagacagggtttcaccatgttggccaggctagctttcggtcttttaccagtgcatatgatgttggctctgggtttttaatatatggcctttattatgctgagataatttacttctgttactagggttttttaaagttttttttaaatcatgaaagagtgttgaattttgttaaatgctttttctgtatgaattgagatgatcatttggggttttttgtttcattttgttcaggtaatgtgattacattaattgattttcataagttgaattatccttgcattccagtaataaatatcacttggtcatggtgtataattctatcaatatgttcaattcaatttgctattattttcttgagttttgtatcagtatacattcatacagaatattggtctatagttttcttataatatgtttgccttgttttggtatcaagatagtgctggcttcacagaaggagttaggaagtatttcctcctcttcaattttttggaagagtttgagaaggattggtgttctttaaatgtttggtagaatttgccaccaaaatcatctgatctagggctttactttgttgggaagtttttgattactgattcagtctccccactagttataggtttattcagattttctgtttattactgattcagtcttggtaggttttgtgtttttagaagtttatccatttaatctaggtaagtcacatttttgttgtagcgttgaggcattttttttttttttacaaaaaattggtactcatatacataaagtaatatgaacttaaaattcatacatttacttcattttttagcttgacattctagtaaatcttttgctccatttatttttggttatgatagcagaagatctacctggatgatttaagagcatcatttgtcaatgagcacctcttattttctctttattggcagtagtgcttacagctactattaatgctgctttccattttgtcgtttcgggttcaaacatacctctgtaatagccaccactgaaggcagattttggtagactttgaaaaatttgttttgttgttgttgttgttgttgttgtttgttttggggtttttttgttttgttttgttttgttttgttttgttagagacggagtcttgctctgttgcccaggctggagtgcgatagcgcaatctcggctcaccgcaacctctgcctcctgggttcaagtgtttctcctgcctcagactcccaagtagctgggactacaggcgtatgccaccacacccagctaattttttgtatttttagtacagacgagttttactgtgttagccagggtggtctcgatctcctgacctcatgatacgcccaccttggcctcccaaagtgctggaattacaggcatgagccaccacgcctggccgaaaaatttgttttacttgaggttccacatgccttatataagggttgcaaaacataacagcctgcaaatcctgcagcagcaatggtcagtccgactgctaccactgtactggccatggctgggctcccctactgcaccaggagcatggctcatcccagcccagaggttgcggccaacaatgacacacctttaccagagagtgacacaggcaccgatggcaagcacaatacactggattataatttttttaaacaagaggattatttgaaaaacagtctaggtgcggtggctcacgcctgtaatcccagcactttgggaggccaaggcaggcagatcacttgagcccaggaattctagaccagcctgggcatggtggcatgtgcctgtagtcccagctactcaagaggatcacctgagcccagggtaatcgaggctgcagtgagctgtgctcacaccactgcactccagcctgggtgacagagtgagaccctgtctcaaaaaagaaagaaaaacacagtttatgttgttgttgtatatcgagtcttaaatcaatgcttcctctggcagaacaaatcagaagttggttatacagtatcaactggccaagtgtctttattatttacagcatctacattagtttttaaaaccatcacattttcaatatataaatgggcaaaaagatgtttagatgggttagtaaacaatggagaaatattttaatttactagatactaagaggtagaaattaaaatttttaaaattttatgcctatataacaaaaaatagaaaatgttgatagtatgatagatagtgaaattgacactggcatatttacacatttaaaaagccacacgtgggtcgctggggaacccaggctgtcctaggaagccgagtgggagtggcacagagctgctggagatcctgagaacctgagttttggcaagcagccagaatacttaaaaaatgaccacaccaaacaaggcacctcctggtactgaccctgagcagttggaaaagactggaacagtacgggaaattgggtcacaagctgtttggtcactctcatcttgcaaaccaggatttggagtggatcagttacgagatgacaatctagaaacttattggcaatcagatggctcccagcctcatttagtgaacatccaattcagaagaaaaacaacagttaagacattatatatttatgcagactacaaatctgatgaaagctatactccaagcaagatttcagccaaagtaggaaataattttcacaaccttcaagaaattcggcaacttgaattggtggaaccaagtggctggattcatattcccttaactgataatcataggaagccaacttggacgttaatgatacagattgctgttctagccagtcatcaaaatggaaaagacacccacccatatgagacaaattaaaatatacacactggtagaagagagcgccattggtaaatttcctagatgtacaactatagatttcatgatgtattgttcaataaggtgactttaaaatgatatggaagtcattaaacgtatctttgttttatcctgtctttaaatagtatatcagttacctttattgaaaaaaacatcagttatttgcaactttatatatatttaaaaatattttattgtaattttgataaatttgggtcatattatctttaacatgtaataaagctcacatattttacattactaaaaaaaaaaaaaaaaagccatatgtgtggctgggcgtggtggctcacacctgtaaatcctagcactctgggaggccgaggcaggcagatcgcttgagcccaggagttcaagagcagtgtgggcaacatggcaagacctcatctctgccaaacaaaaggggacgtatgttccaattttttgagctaatgattccttttttgagtaaataattcttaaaacaagtgcagtaaacaaaaagatgtgtattttagtgttactaaatagcaaatacatttaaagtaatttgtgtccaaaattggataatgggccaggtgtggtggctcattcctgtaatcccagccctttgggaggccaaggtgagaggatcacttgagctcaggagttcgagaccagcccaggtaacgcagtgagacctcatctctactaaaaattaaaaaatggcgggatgtggtggtacatgcctgtagtcctagctacttgggaggctgaggtggaaggattccttgagcttaggagttcgagaccagcctgggcaacataatatctctgctaaaaattaaaaaatagctggatatggtagggcatgtctgtagtcccagctacttgggaggctgagttgggaggatcacttgaacccaggaggtcgaggctgcagtgagccatgattgtgccagtacacttcagcctgggtgataaacgagaccatgtctcaaaaaaaaaaaaaaaaggttaatggtaagttaagtacaatacatatatttgcttcagccattaaaaattattacaaggcagtgtagaaaatgcttatgatgacatatgaatagaacagaatgcaagcttatgctttgtttacaattaaattattcttgggcataaaaacagatatgtctgaaggaaacatatttttaaaaagtaattttagagccaggcacggtgggtcatgcctgtaatcccagcactatgggaggctgaggcgggcggatcaccagaggtcgggagttcaagaccagcctgaccgacctatggagaaaccctgactctactaaaaatacaaaattagccgggcatggtggcacatgcctgtagtcccggctactcagggggctgaggcaggagaatcgcttgaacctgggaggcggcggttgcggtgagccgagatcgcaccattgcactccagcctgggcaacaagagcaaaaccatctcaaaaaaaaaaaaaaaaaagtaattttaggctggatgcagtggctcatgcctgtaatcccagcactttgggaggccgaggcaggtgaatcacctgaggtcaggagttcaagactagcttgggcaacgtggcaaaactccatctttattaaaaatactaaaattagctgggtattgcggcgcgtacctgtagtctcagttacttgggaggtcgcagtgagccgagattgcatcactgcactctagtctgggtaacagagagagactctgactcaaaaaaaattttttttaattcattgagtctgagctattatgcttatttcttttcttttcttttatttgctgtactttacttttcttttcttttcttttcttttcttttcttttctctctttctttctttccttccttccttccttcctggcttccttctttcctttctttctttctgtctttctttctttctctctctctctctctctctttctttcttttctttctttcagatggagtctcgctctgtcttccaggctggagtgcaacggcgcgatctcagctcactgcagtctccacctcctgggttcaagtgattctcctgcctcagcctcccaagtagctgagataacaggcgtgtgccaccaccacgcctagctaatttttgtatttttagtagagacggggtttcaccatgttggtcaggctggtcttgaactcctgaccttgtgatctgtccacatcagcctcccaaagcgctgggattacaggcatgagccaccatgcccggctcttttttttttctttttcttttttgagacagttttgctcttgtcgctcaggctggagtgcagtggcacaacctcagctcactgcaacctctgcttcccttcccaggtttaagcaattttccttgcctcagcctctcaagtagctgggattacaggcatgtgccaccacgctcagcagatttgtatatttttagtagagatggggtttcaccatgttggctgggctggtacagcctcagttggatataatattgaaagtctgaattagagatctcttttaaccctttctgtaatggacacttaaaatgactctgataattattattgttttctattaataacagtgaagtttaaacaggtgtttagacagaggcaagggtctggatttgtttgaactgctttagatcttatgatactgatttttgctatgtgctaataagtggagggataaagtactcctgcatttgacaatttttataagttgttactttcactggtctttgtgaacagctggacactggtcagttctatgcactctcctctcctgtttttattattctcacatcacagttatttttgtcataattatagggctttttgaagacctgggacatcattttttgcattttctaatttggaaagaaataagtgagcatttgatgatttgaattttcaagaattgcaaaggaataagtgttattcacactgtaagagggtataaataggcacaaagtggtactttgaatataaagcatgttcacagatttagcaataggatttgttatgtggaaagcctgtagtgggaaattttaaaaggaaaggaaagggaaataagaaaggtaccaacatacatttagaacctattatatgctacattttatacatataatttcatttaatcttcataaaagccatatgaaggaaatactgtattagcatttctattttacatgtgagaaaaactaagacctagagagtttaaattattcccataaggtcatctgactagagaataatcaagttgaaataggaacacagaagtgccacatttaaaaaaattacatataaacacacaaatggaaccttttaaccagtacttagctggaacatcgtatagaatatatattataaattaccttactttgtctctttatgcttaggcaggtcatacggatcctgccatatgatgtcagctgtaaccattaggcataaaaatcttgaggtcattcttataaacagattaaaatgtgttgttgcaaaagttgaatggctctagattattttctgaatttggatatgaatcatatagtccttccccaaaaagtttacattaatgtttgtttctccattcatacatttatgtatttatgtatttatttattttttgagacggggtttcgctcttgtctcccaggctggaatgcggtggcgcgatctctgctcactgcaacctccacctcttgggttctcctgcctcagcctcctgagtagctgggattataggcgcctgccaccactcctggctaatttttgtatttttagtagagatagggtttcaccatatttcaccaggctggtctcaaactcctgacctcaggtgatccacctgccttggcctcccaaagtgctgggattacacacatgagccactgcacctagtcccagtcatacatttatttatgcaataactttacttttcaaggaagcaataagcaaatatttactgagtactatgtttcagacacaatattgaagataccagtattaaaaataatttagctcattattccatggagtttacattctagtgtggggaaatggagaataagttcaatcagtgcagtagattgtgttgtgataaagatatatggcatatggtaagatatttcagcagtataatttaagttcaggtgtgcaaatatgtaattttcttaatttttagaactgactttacttttttactctaagcctgtagcttagagaactggggaaggtacttagatggtatatggaatatagtggggtatttttagttgtcagaatgactgaggttgctactggcatttagcaacctgtgcataccaagactgctaaacatcttgctatgcccaggacagtactgtcctatgaagaactggcccacctaaaatgccaagagtgcccctgttgagaagcactgactaacctggctcatggtagacaatttcatcttgatctttttaggcaaaattgactattatccagtaatttcaaattcaggattatttaaactatcccaaacctggctcaaatctcttagattctgcccatctcctctgtgatactaattcttatgacctatgaatctcactacgtcatagtctggcgttgaagagtcatctacttttctagctaactcctgtgctttcctctaatctcattggaaacgtaaaggatctctctatactgttcttcggcctgtgggatattgagaaagatgggtattcttgggttcttctgtgtttactccatttgctgctcccttgcttgcttttttttttttaagatactttgttttttattcaaaaatcattatttgagattattgtcccaaagcctaactcactacttctgaatgttcccaactatattagtttgctacagttagcaaaataccacaaattgggcagcttaagcagaaatttattatctcacagttattagaagtctgaaattaaggtgatagcagggttggttcctcctgggggctgtacggaaaagatctcttccatgtctctctccttggtttgtagatcgacatcttcatgttcatatggtggtgttcttgtatgtatacctgtgtccatatttgcctcttttataagggtatcagtcatgttggattaggagactaccctaatcacttcattttgattacctctgtagagaccctatcttcaaataaggtcacattctaaggtgttaggagttaagacttcagcttaagtatttgtgggggatacagttcaacccataaaagcaactaatttttttaaatttttttctaatttaaaaagtacagaaaaaactaatcaaaataaaataaaaatatcccaatacaacatttaaaaaattatataaagtaaaaggagagaaaagatagccagctgtggtggctcatgcctgtaatcccagcactttgggaggcccaggcgggcagatcacttgaggtcagaagttcgagaccagcctggccaacatggcgaaaccctgtctctactaaaaaaaaaaaaaaaaaaaaaaatcgctgggcatggtggtgcacacctgtaatcccagctgttcaggaggctgaagcaccagaatcgcttgaacctgggaggaagaggttgcagtgagctgaaatggtgccactgcactccagcctgggcgacacagcaagactgtgtctaaaaataaaaaagaaaaaggccctacttccattccaatctcatcctccaacttgactatatttttcttttccatgtcaatcggtacatacagaactatttcattctttttatgggaacgggattccattttatgggtatactgcagtttaattagctgttacactactgatgaacacttgggttgtttacaacttttattataaacaatatggagataattcttgtgtagatctctttgcacatgtggatgttttcagtagtgtaaaattttaaaactgtgtgctgagtcatactgaataaacacttccaattttaaaagatattgtcaaattaacctaccagcgtatattactaccagcagaatctaagagctataccctcaccaccgttagatattatcagtgtttaaaaaaaaaatctttgctagtctcatagtaaaaacatactataaaactcattgttttattttgtcatgtgtggtatttactatatctgttggccattttatttattttttctgtgtatttaccaatgtgagttctttgccttatttccttggaggtatttgttggttattgaagctcatgtttttatcataaattaatttttttgtaataattgtagtagctcattaaggtttcccaaatccattcttattctcttccttttttttctccctacactgtgcccatacagatctgatcatgtctttctctttgattaaaatgcttaagtgggggctgggcacggtagttcacatctgtaatcccagcactttgggaggctgagccgggcagatcacctgaggtcaggagttcaagaccagcctgaccaacctggtgaaaccccatctctactaaaaatacaaaaattagctgggcatggtggcacacacctgtaatcccagctacttgggaggctgaggcaggagaatggcttgaaccctagaggcggaggttgcaatgagctgagatcacaccattgcactccagcctgggcgacagagcaagactctagctcaaagaaaaaaaaatgcttaagggctttcccattgctctattaaaaaggtcaaaacagatcctacagagcctttgcttggtctggcctcagcatattccatgcatcccttaactcttggggcctcaagccatattaactttttttagttatttggtgggtccatgcttcttcccctaataggaactgtgtacatactatttcctctactattactgtctcttcttggcacctctttgttcacagaaaactcttacccatccttcagatttgatgtcttgtcatttcctaaatcttccctgaccttgccaatctaggctagagcctagattacatgatcttatttcaccatttaccacttttgaaacacgtgatttatattcacttgtatggtttttctttttctttctttcttttttttttttttttttgagacagggttttgctgtgttacccagacaggagtgcagtggccattcacaggtgcagtcatagtgtagtgtgtcttcaaactcctggcttcaagccatcttcctgcctcagcctcccatgtagctgggacaataggtgtactcctctatgcccagccttgtgttattatttgattttaggttataacctgaaacccttgcactaaattgcattgcatgaaggcaaggaccatgtccgttttgttttctgccacatccccattgggtagcttggtgcccagtacatagtaagagttcatatatttgtggaataaatgagtgaatgatggattcttggttttgtctctttattagaaaggttattgaaggattttaagaaatttaacattattagatttattttttagaaagttcagtctttgtttggaagattaattggaaaggcagatgtgaagattaggagaacagttaggttatcatcatgatcgtttagtcctcagataataacagcctgaacagaggcagcaatgttagagataggagaagatgtgattttggaagaacaatttcagaggaaaactaacaggacttaatgactgactggatgtggtcatggcgagggagaaggaaaagtcaagactcaaaatttaaatgaaatatgtaatttagtatgaagtagtattacagagtagttaactatagagccattgcagtcatacagattaatcatgtaatttactagctgtatgaccctggtaattttacttaatgtcttagtccattcgggctgctataacaaaataccatagactagatggcttataaataacagagatttgttacagtctggagcctggtaagtccaagatcaaggcaacggtagatttggtatctggcgagggcctgcttacttatagacagctgtgttctcactctaacttcacagggcagaagggtgaggagtctccctcaggcttcttttatagggcactaatcccatatgccccactacctaataccatctcttttggggttaagatttcaacataggagttttggaacattcatctgtttacctaactgctaattgtaaatgagtgtcttcatggaatttttgaggttaaatgtaacacatgtaaagtgcctagtagtcatatagtttgctgtgaacttgaggaagtcatttaaccatctaaactcagtttcttctgatagaaaataaggataatatgtataccctttgttctccctgtatcacagggatatctccctatatcacatttaagaatgtcaagccctataaaaattgtaaactgataacagtcatagtaactagatattaattatacatagaaggatgggagatatcgagcttaacttagactttaatatgacccctcatctcttggttcaactttgtaaagtataggatgcttcttggctgtaaaaactgaagaagtagaatttatcctactgggaacaggcttttgccactgtaaggctctatgtggtaaatgactgatgagttctcaagaaaataaatctggccgggtgtggtggctcacgcctgtaatcccagcactttgggaggccgaggtgggtggatcacttgagttcaggagtttgagactagcctggccaacatggtgaaaccccgtctcttctaataatacaaaaaaaaattagccaggcgtggtggcttacacctgaagtcccagctactcaggaggctcaggcagaagaatcacttgaacccaggaggtggaggttgcagcagtgaaccaagatcgcaccactgcactccagcctgggccacagagtcaaattgtgtctcaaaaaaaaaaaaaaaaaaagaaaagaaatcttaacaggaacaaaggagattgttgttgcctggtgtagaggggagaaggaagtgagattaccaggaaccaagcccagaaggtggaaattggcatggcagattttgattgcctgctgtgatttcctgtagctaaagcagtgcgtttgtttatgattgagttgtatatattgacccttggccttcatagcaaaaacagtgaaaacagctggtatagttattattccacatataaggatagtaacaaacagaagttaaaacacagaaattccaatctttgtttatttcatcctgctataattcctttccaaacggaaatagcacatgtaactatctttcaacacccatgttaggtgattgtgtgcatagaaatcttgcctaggggtaattcaggtggttttttccccactgctgtatatttgccacgtgatcttagttaagatttttattttcagccaatgtttcccatttctttattgttgacagacttgtaatctcactcttgcttttgaattacccaacttcctgaactacattttctttgaaactttagtattgtagtttaataaggttcactgacaatcagtgtttgtcaatattggttcactctctttgcatggcaatcccaagtaaattttgtgtgttcttccccccccccccccacaggttttctgtgcttcctgctgtagcctgaaatgtaaactgttatacatggacagaaaggaagctagagtgtgtgtaatctgccattcagtgctaatgaatggtaagtattaaaacaggttgatttcatagttattgagacaaaacaagggaattacgatgagaagacttttttccccctgcctttctttacaagttgctcaccttctcaaatgtcataactttaactgaaaatatttagctaaatttccatgttttgaaagtatcttagcatttcagaattcctgtgcctaatttaatgaataaatgctaaagccaggtaagttttgcaggaataatggaagttctttggaaatctggtgcgaggtagttatttgtgttcctataaaataaccagagtgaggtgggaatggggagcttttgatcaccagatgataagatgttaaaactgggctgagattttccttttaagagaagccatctctttctaaggaacaacttaataacttagcatgtgttcttatcaacaccttgtttcattcatcttgttgaagataactattttagcatctaggaccaagtagaaaattgcatttttaaagcccatttatctctttaatgctacttagatttgctatgagaataatggtttagaatctagttgttacgtggtaaaaagaatatggccggggaaagtaaataaaacttacccagtgttcatcttttgctggactggaaatgattttaagggcatattagttaaaaaccctgagtattcttgtaaaaagatacactaaaattgttcaggttatagtattttctctttgaatgcatctttgtacagttactggaacaattactaatagacataaaatgttgaacttgaacaccagtgctacctgtgccaggatagtgtgcctcctggaggctggaacttatctgctctgagacccctcctgctctgtccgtctgcattgctgatagtgatgttttcttgttgctggcttattaacctgttgcatgacagttaatctgatctgttctaatttcctatgatccacccagtttcctcccatttctgaattcttacaattttgaccaaatatgaatcattctctccactcttaagggttactttttaaatagtggttatttcacttggttgctcaattgatgatttttattctgctgctttcattttcgggcacatattcacagataagagcatgctgcttaattatagtacctaatacctcttttatttgatgagatcttccaacttgatagctaatttttttaacttggcatagctaaagatgaaggaaatggcagaggattcacatggaatacttactttttattaagccaaggaggcccttaacaggggatcctaaggtaatccacttttcctggtttttccagtgtctttcctctcgcatggcttagcccggtctttttcttaatatttaatttgatgcttttcggtgttccctatccctttttccctttctccttttctcttcctcccctctttctgccagtgctttcaaaggaacatagcttttgttactagccttgtcttgcagtttggaggcaataaatattcaaaatcctatggatcattctttgatgttgaaagagatttttgaaaggatgcttaaaaagagggtggcttctatttctgggcatgtggtattacctgaacctagaagataaaatttggtatctttcatttctgtagcacctttcatcctatttgctttaaaggcgataggtgatgtgtcagtatttagtgaaattatagggtacacagaatcttaatgtatttgtgatcatttatattggttgatcacacttacatgatattggcacattttcatgttcaaataggtcctgtgcttttgagacacaccaaagatgtgaaatggttgttactgatggatagttttatacagggtgatgattacataaaagcagaattcagaaaaagattgagatgtgtcctcctgagctttaggctttagaaatttttaatgagattttattttaactaacaagagccttaaaagtttagaaatgaaacttaaaattttacagtagagttattctattttagcccctgattttgctttttgatagaactttataaaatgcattaaatattaaatgaaaaaatgtctaaatgctatccaagtttcaaattcttaaagtttgatgttgtttgactccctcttaaggaaatgtttggtctcctataaagaaaccaggctccaacctttaactcagattgatctgctatcagtctatcagaagtatcctataattcttttttatttttaatttttttgagatggagtcttgctctgttgcccaggctggagtgcagtggtgtgacttggctcactgcaagctccacctcccgggttcatgccattctcctgcctcagcctcccaagtagctgggactacaggtgcctgccaccacacctggctaattttttgtatttttagtagagacggggtttcaccacgttagccaggatggtcttgatttcctgacctcgtgatccacccgcctcggcctcccaaagtgccgggattagaagcatgagccaccactcccggtctaattctttaaaaaaaaaaaaaaaaaaaaaaaaaaaatcatgttactcttatttgctccaaccaaatagtttacttggctaaatggtctcctttattacataaaatcacctatctctttaataccttcactaggtggaagagagacatactatgagtattaattaggagaagctgcattatttatccaatattgtggaggtcttgatgtccatattttgcaatccattcacattgattgtgtctgtatttgctttagctcaagcctgggagaacatgatgagtgcctcaagccagagccctaaccctaacaatcctgctgaatactgttctactatccctcccttgcagcaagctcaggcctcaggagctctgagctctccacctcccactgtgatggtacctgtgggagttttaaagcaccctggagcagaaggtaggggatcatgtgctattctctctctttttcctcacgaagttcctctgaaaaggtgctgatatgactttacagcacaagtcttaaaaaacactgcagataagtctctttgggtggttattaaaatggaacaacaaggtgagaaatgtgtcaagactatttctgggcaagtagagaataatatttgtgttgcttggtattttagaggcacctcagaatatatgtcagtctcctctccaacttaagaatggagtaattacactgcttgtccttaaaaagaggtgcagaatttgaagtcaatctgtaaattcctagcctacctcatgcctgtcttaatgttctttgtaggagtttagtaagtgataaaaatgagagttcttctttccgaccagcccattcaagtattgctttttggagtatacattgccattttctcttttcatttttaatctgtccatataaaaatatgaacatttttgtgttagggacatagactttaaatctagaactttaattctgattatatcatatgataggtagaaaattacaggctcaacttacattggtttattatatctttatgatgataatattgtcagatgaaaggcactgtgtaagtgcaggggattatgaatagtaaaaataacatttatttccttaaaatgatcttatcaagtttcccttggtaattaaaatcagtcttccttcattaattttatcttttcatctattaatattcccttccccttgctaaataacccacctttccttttgaagatcatagacttctattgacattatcatactcttccccattttttctcttttcagatcatcccttagtcatactccttgtatttttatgaatttaggctttcttaaaatctttattctcttcatttgttgtttttgttgttcttccctagtctctgtgtgttttggctgtttgaattgatttctaaaactggacttaaagggatcatttcatcagactcagttttccagctttttccctgtctttttactaaaacacaaattacttttgcactgccagatcagtctttttcttcttcagttacacttcaggcaaagatctggtcagtttgcttcccaattcttacatatctgtgccagctcttctgttataaatgaattattctttaacattcttcagggcatcttttgccctttgaaagtaccatatcactttaccagatgtttaatttctttggaaacctcataactttagaaaatgtgaatgtctattgcttttttcaccatgctattaatttatttccgaggcccttgaacactttccttagtttctctgtcagtgatacgggacagagtatgtgacataatcatagatgtatttaagaactcttaatatttcaaagcaaagtattttactctttgcatataagttaaacaagtaaagaatatatttaaatttgtatttttaattcatttataaccacttttatatacagttacatttctgatgtttctgattgtaagttgccaagtaatgatttctttgtacatctggaattggtgaccttctcttctttgatgttagaaaaccttccaatgccacattgatgcctgttttatttttctggcccctcaagtggctcagcccagagagcagaggcgagtttggtttgctgatgggatcttgcccaatggagaagttgctgatgcagccaaattaacaatgaatggaacttcctctgcaggaaccctggctgtgtcacacgacccagtcaagccagtaactaccagtcctctaccagcagaggtaagaaaacaaaacagcaactaaaattgcatagctactttactcagcattgtgctgcctctgttgaattacttttgtgtggaactctgtaggttttggatacaacttagtgtatacgtgcacatatatggataaagtaaatgtggcaaaaatcagctgctgttctttgctgtatatttagaagttttttcaggagaaaggttcttaatgaagattgttctcagatgagctcaggtgctccactttagctagcagtcgggctgtggggaattctgtccccttgctacattggtttttaaagcatgttccccaggttccatggcagcctctcaggagtgctatggtgaggaagagcaggtaacatgaaagggcctgaggagctgagtttaaaaccctggcttatcaacatcccctaccagagtggtacacttgttacacttgttgaacctacactgacacatcgtagccaacccaagtccacattttacattaggattggatacttttttttctttttttgagatagagtctctgttgcccgggctgcagtacagtggcgtgatcttggctcactgcaacctctacctcccaggttcaagcaattctcctgcctcagcctccaaagtaggtgggattacaggcgcctgccatcatgccaggctaatttttgtatttttagtagagacagggtttcaccatgttgcccaggctgcgtctcgaactcctgacctcaagtgatccaccccctcagcctcccaaagtgctaggattacaggtgtgagccaccacaccctatcaggattggataaaaattttactcctgatgttttcatagaattgttagttactaattatttatattaatgataagtaatatttttttagacatttacatcctatataatttgtgagtttgattgtaattgaaattgcatgttgttaagattagattttttgacatgcagagctgacttacctgtttggtgagttattgaaccatgtaatatctgtcttcaaatatttctagtttttgaatttttctgtggctgcagagggtgacagccagaactgtgtcttatccttctttgtatctccacagtgactttgtcaagaaagttttttctttattccccccaactgtttttttgtttgtttgttttggtttttttttttgagacaaggtctcactctatcgcccaggctccagtatagtgccgcagacatggctctctgcagccttaacgtcccaggctcaagcaatccttctgccacagcctcccaaatagctgggactgtaggcaagcctggccacaactgtttatttggaaaaaaattcaacctacagaaaagttacaagaatagtacagtgaatacccatatactcttcacctatcttcatcaacttaaccattttgccacatttgctctaccacttcacagtacacacgctttttttttatgacccatttaaggattggttgcacttcaccacttaatagttcagcttgtgtaccctaagaaaagtcattttcttatacaaccacaatgcaattatcacatgagatggaaacttaacatgtaattctggtttccccaattgtcacaataatgttctttatagctttaatttttttgttttgttttgttttgagatggagtcttgctctgtcgcccaggctggagtgcagtggtgcgatcctggctcactgcaagctccgcctcccgggttcacgccattctcctgcctcagtctcccgagtagctgggacaacaggcgcccgccaccatgcccagctaatttttatgtatttttagtagagatggggtttcacgatgttagccaggatggtctcgatctcctgacctcctgatctgccctccttggcctcccaaagtgctgggattacaggcgtaagccaccgcgcctggcctatagctttcatttttacatatatgtgtgtgcacagatatattaatttttaaaataaaatttatttttaaaaatcaagatctcattaaggaccacagttgcatttagttgtcatatttctttggtttgctttaatcttgaatagttctctctcttttttaaagtttttatatcattaatatttaagtatttgggccatgttttacatgatactctcaatttgtatttgtctgttttttttttttctcatgactagtttcagattaaacattttttggcagtaatgacaatcctacataagtgagggtgatttcttaaaggatcacatcaagaagtattagtttgggttgggtgcagtggctcacatctgtaatcccagcactttggaaggccaaggcaggaggattgcctgaaccccgagtttgagaccagcttgggcaacatagtcagactctgtctctatataaaattaaaaaattagctgggcatgatggcacatgcctgcagtcccagctactcaggaggctgaggcaggagggtgatgattttctctttctgttaaatttctttcctatctcttagtttgtatgatgggttcttaaactataaatatttttgaaagaatgaggaaagtctagtgagtgaatgttatagggaaacaattttctgctcattataagacaggctaagccacattattttgtgctctcacattgtgcaacactctaatatttatgtggtaaaatgagagaaagcaaactctttaatgccagactagaaaatattaatatttttcttatttttatggtctagtagagtgcctggcacttaacaagtgcccagtaaatgaagtaaatgtctttttattattattattatactttaagttctgggatacatgtgcagaacctgcaggtttgttacataggtatacatgtgcaatggtggtttgctgcacccatcaacccgtcatctagattttaagccccacagtaaatgccttttcacagaaggcatttaagtagagaccaactgaccactttttatgatattaaaaggaggatttttgcaccattcaatagtaggttagaatagattattttctgtaccaggccttcaagtcagttaatggtagtttgccagtaaaattttataaagttcctatatgatgccataccggaaaattttagaaatcccactaaaaatgtatagtcctaaaaactttgtcctaagtagagacagaagtatggcaaaacatgggcatatttattttattttattttattctttgtttgagtcagagttttgctcttgttgtccaggctggagtgcagtggcatgatctcagctcactgcaacctccgcctcctgggcttgagtgattctcctgcctcagcctcctgggtagctgggattacaggcgcccaccaccacacctggcaaattttgtatttttagtaagagacggtttcaccatgttggcaaggctggtcttgaactcttggcctcaggtgatctcccctccttggcctctcaaagtgctgggattacaggcatgagccaccatgtccagccatattttgaagaaatagttttaatgtttgttcaggtatacaatatatgtagcaaaatgcatgactaaggagcatgaatctttaggaaacaccttgaatttatacatggttttatatatatgtgcatgtgtgtatacacacacaaacacacacacataaaatatgtaagcaccattcaggtgaagatacagaacatctccagcactccataagggttccttatgcactttttctgtcagtaccttctcctttcatcaaggtaaccattgttctcacttctgtccctacagattagttttgcttattcttgaattcatataaatccaaacaatagtatataatgttttgtgtttagctttttaagctcaacttaatattatgagatttatccatatgcatcaaaaattaatttatttctgagtagtattccattgtatggatatgccatcatttatgttatgttctcctgttagtggccattcaaattgtttccagtttttggctattatgaatgaaatgaagctgctagaaataatcttttttttttttttttttttgagtctcgctctgttgcccagactggaatgcagtggcaggatctcggctcactgcaacctccaccttccaggttcaagcaattctcctgcctcggcctcccaagtggctgggattacaggcacacgcccagctaatttttatattttttgtagagatgggatttcaccatattggccaggctgatgttgaactcctgtccttaaacaatctgccttccttggccttccaaagtgctgggattacgggcgtgagccactgtacccggccgtatgaatattgttatacatgttaaaaacagcttttactgtttttcttttaactttttgttttgagacggagttttgttcttgttgcccaggcggagtgcaatggtgcgatcttagctcactgaaacctccgcctcctgggttcaagtgattctcctgcctcagcctccctagtagctgagattacaggcatgcgccaccacgcccaactaatttttgtattattagtagagatgggatttcaccatgttggccaggctggtctcaaactcctgacctcaggtgatccacccacctcagactcccaaagtgctgggattacaggcgtgagccaccgcacctggcctcttttaactctttaaaagcttctatttcatgtttaagttatagagaatatacatctgtatagtatgggaaataaaagttatagagaatgtagagaggagagcatcattttaataaacatttgagcatgttctatttaataattaagtggatttaacgccaaccaacatgttttgcaaccttatacttcattaaatatagctaatgtgatctgcctagtaatgcaaagaaaaacaaacttcaggccgggtgcagtggctcacacctgtaatcctagcactttgggaggccgaggttggcggatcacaaggtcaggagattgagaccatcctggctaacaggtgaaaccccatctctactaaaaatacaaaaattagccaggcgtggtggcacgcacctgtaatcccagctactcgggaggctgaggcaggagaattgcttgaacctgggaagcagaggttgtagatgatgccattgcactccagcctgggcgatagagtgagactccttctcaaaaaaaaaaaaaaaaaaaatgaacttcaagatttattttattacatagtaaatgaaaaatgatgacattttatcaaagttgatttttttcccttttttattgtggaaaaatattaacatatataacaaatgatttacaattttaacaatttttaagtgaattcattggcatcaagtacattcacattgttttgcaactatcaccactgttttcaaagttaatttttaaaagcaatataaattagaccttaagtagttcccaaggtattaaagattaagaaattatgaaataatattgaagttttgtttcttttgccactacagttttttaaaaatatttttctcttatggcaaaagaaacctgggtaaaggaagctttaatgcaggttttaaggcctcttctgtcattaccatgatttgatgataccaaaaggagaaacttacacatttgaaaacattttcatagtataagcctgatttgtttttttgttttttttaatccatgggttaatgaatattttgtgctacctttcaaaaagtatgaatttcagattttcacttaagttcccatttgtatttttaattatgtcctgccaaagtcttgaattctctgtagtgctcactttgttgatttgcttttcctagacggatatttgtctattctctgggagtataactcaggttggaagtcctgttggaagtgcaatgaatcttattcctgaagatggccttcctcccattctcatctccactggtgtaaaaggaggtaagtggactacatatttaaacagtgatagttctatctgccaaatgttaccttctaattaaggtagagagacagaatttgagtgacattcacctttctcttatccaacaaaacaaactcccccaaaactatgaaaatggttgttgctgttattattttagagtagatgcttatgtttttatattataatgtcattttcagtttttgaatggatataatattacttataatgtaaatgtagtttattagcagtttttaaaaatatttcaaagcacataatattctgaaggattgcttgtggtttaggatgaacccactctgatacagtcatttatttagcttttcattttgaggtataatatacattcagaaagaacgtatagtaagtgtgaagagcactgaatttaaatggcagttttactgttaaaaatatttttagggatcttgataagaagtaaaattattatctaatcaaaagaatgcttaatattatgtgaaattttatttttataattttaacttttattttagattcaaagggtatatgtgccaatctggtacatggatatagtggataatgctgaggtttgggttatgattgatcctgtcacccaggtagtgagcatagtacccaatgggtaatttttttttgtttttgtttttgttttttgttttgagacagggtctctttatccagtcagccactgatgggcagttaggttgattctatgtctttgttattgtgaatagtgctgcggtgaacattcaagtacatgtgtctttttggtagaacaatttattttcttttggatatacacccagtaatgggattgctgggctgaatggtagttctcctttaagttctttgagaaatctccaaactgctttccacagtggctgaactaatttacatttctatcaacagtgtatacatgtccccttttctccacagcctcaccagcatccatggttttttgactttttaataatagccattctgactggtgtgagttgatatctcattgtggttttgatttgcatttctctgatgattagtgtgaaattttattgctgacatatatggatcagtatacaattactacatttttagaaggtggcttattaattaacctctcctgaactttgtcctaggcttttaactggtctccttgccttcagtctttctttccttcattttgtcttccacactgttgccagttatgtttttaaacatagatattatcttatattgcttttacttagaaatatttaatggattcccaatgtctttagtgtaaattacttaccttagcaagcaatttttttttttttttttttttttgagatggagtctcactctgtcgccaggctggagtgcagtggtacagcctcagctcaccacaacctccgcctcccgggttcaagcagttctcctgcctcagtctcctgagtagctgggactacaggtgcatgccaccatgcccggctaattgttgtatttttagtagagacagggtttcactatgttgaccaggctggtcttgaactcttgacctggtgatttgcccacctcggcctcccaaagtgctgggattacaggcgtgagctaccatgcccggtctgacaatgtttcttataaccttatctcagcctgtctttctagccatttattatcaactttatttccagctattccccagcaccttacatgtatactgcagattatttgctattttttgaatatttacttttcattcttctgtactttttcttgtgctgtggaataatgggaaagaatggacttcagaattgaacaaacctgacttttaatgccagtaccgttccattctagctgtgtgatccagttggcaagtcattcatcctctctgaatttgtttcctagtctgttttatttaaaacaattatataactacacctacttaaaagtcattgtggttattaagttagatatcatacctgtaagtacataccaagaaagtatctggcataaagtaggcatgtaattaatattttccatttcttcctttcttctgcctagaatacccctctctactgtagacttcctgaagaactcctcaaccttttaaaatccagcttaatggttaattcttctctgaatccttacctgggctgcttagaaaatagtgatttgcttcattatctctgttctaatagtggttcctatagactgttggctacattaacactttttctcattgcaatttagatattatattttcagatcgtattctttcacttagactatgaaattcttcatcttattttatacttgcatttactgctccttgcatggtgctaggcctgtagtaggctctcagcaaatgctgtctatattgtactctcaaatgcagctatgtcccagatagttcagcagtgaactttcacatacagttaagcattcttttgactgcataatgcttttgcttctttaccaggaccctgtaaaaatatctactgttagtaaaattgctgcttagggttcagatttttattttaataaatcttagattaataaggaactaaattggcctactctgttgttaaaaagagtcagattgttggattctattgttagtaaaatacctattgttagtaaaattatctattgtaaaaatatctattgttagtaaaattgctgcttagggttcagatttttattttaataaatcttagattaacagggaactaaattggcctactctgttgttaaaaagagtcagattgttggattccattttcataaaaagttatgtccgttaaatctaattgtcaaaacttctcctaccaagaaagaacagtgaattatctatattacttaaactatattacagtctcttcatcaaaattttgtaattttttattccagtgggatgactttacttaaaaaattttaaactcaggatttctctttccaataaatatttttaataatggagtagatatttcccattgtatccaaaaaatccattttaaaatttccattagaaaatgggaaatgatgttactttgttctacctgactgtccctcaaatatgcattttatataagaccaaccaagcaacattcaacttttaggttttcagttcctttcccatatctctaggttctacagtgattattacgcatgatttgacttcaagctgaaaggaccactgtcattcaaaatgagatgctgaagcacatactgtgcttccagagattaaatgagaagagttacattcagtattaacttgttcatgttcagaatcttatgtgtgatttactgatgattttagtgacatatgtactaaactcttaaattatacttaaaggaattgttttatgaagccagtcacacacaatacttttattttctgggttcattttttaaagtttaagtttttaattgtcaaaaatgtcaaacagtacaaaaggtcatagagtaaaaggtagggctctcttctaccccaactatttgatatcctttccagaggtaactagtatattatcactttcttgtatatcatgagttattttaaatgctggtcttgaacatttattatgtgaaattcttgttataatagttggaaaatttttattaaatagaaaggtagtctttagattgtggcacaaaccactgtggggagaggtctatacacaggataaccacattatcatctaaggtggactgggtcacttttgagagtaaaagagggcactattaatttgatactgagccagcagatacaaaccatgctctgtatgcacctattgataaatcaaatgcatgtctcttttctgtgaataattagctcatttctccatctgatctctttcttgatttgttcctttaaccaatctattacattgttttctcccctttcagactatgctgtggaagagaaaccatcacagatttcagtaatgcagcagttggaggatggtggccctgacccacttgtatttgttttaaatgcaaatttgttgtcaatggttaaaattgtaaattgtaagttataaatttttaaaaattaaaatcagatgttttactgactcatagtacataaaactttcagatttattacacacaagtatttttatatagagccacatctttttttttttctttttttttttttgagacagaatctcgctgtgtcacccaggctggagtgcagtggcaccatctcggctcactgcaagctccacctcccgggttcacgccattctcctgcctcagcctcctgcctgagcagctgggacaacaggtgcccgccaccacgcccggctaatttttcgtatttgttttttttttagtagagacagggtttcactgtgttagccaggatggtcttgatctcctgacctggtgatccgcccgcctcagcctccctaagtgctgggattacaggcatgagccaccgcgcctggcctagccacatcttactgaacactgagttctgaaaaagttggtttttataaaatgatatatcccagaggacagctgtggaactaaccgaaactctcacatttagttacaggggtgaggtaggtgaattctccatggatgaaagccaaacaaatcttgaacttatctgagttaagttcttcttgagatgagtatgttaaatcacaacttaccaccagaataactggtggtagataaattatacaggctactcaaataatttacatgctgtgttttaatcccagaaacctcaattatggtgcaaaactttatttaggaaaagtgttaactaacacacagtaaagcttcaatacatcataaattgagattcagaagaaacttctcaattgttggtgctagcatcatgggcatcaggatgagaaagacgacagtatttgagaattttttgagacagagtctcactctgtcacccaggctggattgcagtggcatgatctctgttcattgcaacctctgcctcctgagctcaagcagttctcccacgtcagcctcccaagtagctgagactacaggtgcacaccaccatacctggctaattttttttgtatttttttgtagagacaggagtctcaccatgttgcccaggttgttcttgaactcctgaactcgagtgatctgcctgccttggtctcccaaagtgctgggattacagatgtgagccactgcgccagctagtaattttgagaattatttagagaatgcatttattctgaatgagtgttaataggcaattttaaaggacagaacctctggggaaccatcctgcagttctccatgtgtacttaagttgattttggaaaccagaaacatatactacttccttagaagttctacattgatgaaatgtgggtttctggcttacttgctaatcacactcttgtatgtttggccagttattaatgcttgctaccttctaggatcagatttaaaatgaatttgcttgaaatttcaatttgccatatctagtttataaattatgcttagaaattagctaacctaagaccaggcaccatggtgcacacctgtagtcccagtgctttgggaggccaaggcagatgaatcacttgagcccaggagttcgagactagcctgggcaacatggtgaaacctcatccctaccaaaaaaaaaaaaaaaaaaaattgggcatggtgacatgctcctgtagtcccagctactctcgaggctgaggtgggaggagttcttgagcccaggagacggaggttgcagtgagccgagatcatgacactgcactccagcctgaatgacagagtgagaccctgtttaaaaaaaaaaaaaaaattagctaacctagattcttgaagtatataccatcatgaggaatgtcctatttaggtacataaagcaaggattcccaaagtgaaataaagatgtctttgtttttttgattaacatttgttttgatttacatggtggtattcataattttatttgagtcctttttcagttcctttggggatcccattgtgttggggtatgaagagtaaaagtgtcaaggattaaacattgtttttgactacatatggtttctgctgttcatactctccatatagccttaaagtgaaggagtggaactaagtagttcagaaaagccatccttttcactaatttttacagcatgaagccaagtaaagtcatgttgctgattatctagaattttttcctggaaaggactatagttaaaatagctggaatctcttggtcatatattaaatttaataaatatacataaaaatatatttcctttaggtcacaacctgaagataaagctatattattggcttttgttgtaattacttctagccttacattggtaattacttccttcgatgatgtgattttttaaaatataaaggtggaggactatgttcttcaatcacgtttggcttacaatacatagtttggttttattttagtattaatagaatgttgcttcttttaataggagttaaaagttttaagtgcgttttattattatttcttttacttccatttcaatcatttttcttttcttttcttttctttttttttttttttgagacggagtctcactctttcgcctaggctggagtgcagtggctcgatctcggctcactgcaagctccacctcccgggttcacgccattctcctgcctcagcctcccgagtagctgggactacaggcgcccgccactgcacccagctaatttttttgtatttttagtagagacggggtttcaccgtgttagccaggatggtcttgatctcctgacctcatgatccacccgcctcggcctcccaaagtgctgggattacaggcgtgagccacctcggccgtcctcaatcatttttccaagtgtttagaaaagagccagaggcattggcatgttttattttctacaataggtttttggctcaatgcagtgacagttcacagttgaattatacagactcagtgtgatctattttaatctttgctgtattgtaacacagatttctgtgcatctttttttaagagtaaggattgataggaatgtctttatttttgtgtttttattccatctgtagatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcaggtaggaatgctttatgacttagtctgctccctttgtagatgacaaaaaaattttgaattcaaatacaaaataatagtcttaactttggacttaagcatggcaggggactttgatattagtggcaagttgaagctttccatggtttgaagaaattataaattttagtattgtacctggtatagtttttattttacagaggctggaatcaaagctgtaagagaatctggtgacctaaatgtaagaatattttctttttagtggcctggggtcaggatattggtacctggtagaaggaagcatatttgtaacttacttcttgtttctttggttaacaatatttatttaatcatagtgtaaatgctaatgaatattcaaatttcaaaaacaattagcatacatgactatggcttcaaaataaattgtaaatattaactgtaacaacttaaaagtaaaagcatagaggttagaagctgggaaagactaaggatattaacataaaaagaaactaagattgagagaaaagaaacacattatttgacattatagttatttattatgacattgtgttatttgacattacaaagtcagcctccctttgatttaacaaatgaggtagaaaaacggtgtaattgaactattctcgtttattgtaacaggaagtcagtacataatatctgtatttgataaatagggtttatctttgaggaagaaggcctggagagggtgtgagggtgaccggggtattaaaactattttcatgtattatttgataatatttcatacatatattaaaacaataaattattcagactttcttaatgcaataattttcattgtgggattctgtgccaaagacagtatccagaatataaaatgcacttctgtgaatgaaagggtttattgcaacattacctaaatttaacacaaaaattcagaagcaacctgaatgccttagctataggtggaaagtttaactgtgttatacttattagatgtgaggatctttttgagaactttttttggccattaaaacaatatttatgaaaagaatgtagtaacatggaaaatgctctttaaataattacagaagcaggatatataattgtatttttaatgtgatgtagattatgcgtaaaagattgtgcctttatgtcttcattagtctctacaataatttaggtgtagcattacataagggcaaggtgatacattggaaactgaccacatgatacctgtgaagtaccttttaatgtttaccctgtctgttccaaaatgtatagggttaaatctgaaatcatccaggtcctccaggccacataataccctggagctgaatttagtcctggaaataactgggaactttcacttttctcctcaatctgaatgtattcacttttaaacactctagaaaaatggcattggaggttcaagtaattgtagattcatgtgggttttgagagtgtgttagagactagggtatgggaggttcatgaatgtcttatttaggagcccatgctttattctgtaggcaatgaagaaccattgaaagtatttgagatgatgagtgacataatcagatttgcattttagaaagatgactctggaagcagtgtgaaaaatggatcaaagtccgtgagtctggtggcagttaagaagcaatttcaggataagcaaatgtatattcatacactagaatactgctcaacagtaaaaatgaactaactgctgatgtacacaacaacatgcatgaatctcacagacattatgctgagcaaaagccaggcacaaaaaagtacatattggatgattccatttatatggttttctaaaacaggcaaaattaatctttggtgatagaaattaggtcagtgtttgcctaaagtgaggtgggggtgcaggtgctagaactgactacagagagtcccagaaaactttctgagatgagaggtctatatctggattaggatagtggttatgtgggtgtttgccaaaactcattgaaatgtacacttaaaatctatcatttttataatatatagattatacctcagtaaaatttattttttaaaaagatattgcaggaatccagcaagaaattaagaaattatcaggatttaaattaaataattgcagtggaaataaagaagagtattggagagatacgaaagatgtggtgcttcaattcagtaggatttggtaactaactggatatagggggttagaggggacaagtcaaggttggcctcagattcctcgcttgagcacctaagtgtatgttggtcttcttctattcaccatcttgatgaataacagatttggcagaggtaagggaattctttgttcagtgtgctgaatttgaaataatgacatcagatgaaacatgaaaatggcagatgattatatgggtatggatcccagaagatagatctgagttaaaatacagattttggagacacagctttcctgtgatagttgagagtatcgttgtgaatgggataggcctgtgtgaagagactacggctgtagatggaatcctgagagatagacatcctctcaaggagaggatgtgaattattgcatgaattattaaaatatgtttagcataaattttttttttttttgagatggagtctcgctctgtcacccagcctggagtgcagtggcgctatctcagctcactgcaagctccacctcccaggttcacgccattctcctgccccagcctcccaagtagctgggactacaggcgcccgccaccacgcctggctaattttttgtatttttagtagagacggggtttcaccgtgttagccaggctgatcttgatttcctgacttcgtgatccgcccgcctcggcctccgaaagtgctgggattacaggcgtgagccaccgcgcccagcaatggttatttttttaaaaaggatacttatatgtcagttcagtccattttgaactattgcaaaaattttgaaacaacaaaaatacttggaactgattacaagatactaatgatagtctaaggtcagactataatacatctaagccaactaaaaatattttctataatgtaggatagggacacgaacatatatatgtatatctaaggaaataacatttcaaaagcataagtgagacgaaagagtttttccttgaataggaatcatttcacaactcatcaaatattgggactagaaggcattttagataatttaatacaaactcttcattttttagataaggaaaatcagacctagaagtgttaatggcgtacctaaatcacagaccaagttggtggcagaattgggactgtagctcccagatcagtattgtttacattatgtcagttgcctctgtgtaccattaataatatatcagttcttaaaaacacagatatattatctatatactatacatatttattaagaaccttatttttagataatcagggtaatagcttgatatatttcactataaattttttaataagtaaaagcatattttgggtgttctaaaacggggtccccaacccacaggccatggactggtattggtccgtggcctgttaggaaccaggccacacagcagaggtgaggggcaggcaagcaagtaaagcttcatctgtatttacagctgctccccattgctcacgttagcgcctgagctctgcctcctctcagatcagcagcggtattagattctcatagaagtgcgaaccctgttgtgaactgcgcgtgtgagggatctaggttgtgtgctccttatgagaatctaatgcctgataatctgtcactgtctcccatcacccccagatgggacagtctagttgcaggaaaacaagctcagggatcccactgattctacattatggtgagttgtataattatttcatgacatattacaatgtaataatagaaataaggtgcacaataaatttaatgcgcttgaatcatcctgaaaccgtctccccttccccacagtccgtggaaaaattgtcttccacaaaacccatccctggtgccaaaaaggttggaggctactgttctaaaatgatagcaggctgggcacggtggctcatgcctgtaatcccagcactttggcaggccaagccgggtggatcaccttagctcaggagttcaagaccatcctggccaacatggtgaaaccccatctctactaaaaatacaaaaaattagccgggtgtgatggtgggcgcctgtcatcccagctacttgggaggctgaggcaggagaattgcttgaaccctggaggcagaggttgcagtgagccaagatcgtgccattgcactccagcttgggcaacaagaatgagactctgtctcaaaaaaaaaaaaaaacgtatcgcaatttattatttttctcttctgtgtagcacattgagtgaaattgacaaattgtatcttaaatttctcctgagtgtgaaaccttgaatactgtattactagcttagggttattctgccctaaatcacagaaaagccttaggagctattgaatgaacttttttataacttcctgtgaattttaaaatctaaactacaggtatttaataaccatatgtgtgttgtatatctatatatgtgtgtgtatctgtgtttcacatatatatacacacacacttttttgtcatacacagtttttgcattctgcagtggagggaaacattataatttgtgagaaattatgttctgagagtttcagaatgccttctggttatgacagtgccatcggaggttgtagactatatattgtttctccctgtctcctattcattcctccatattttgtacctgtttttttgcaaacaatctattcagaacatagacttgaatgaaattggacttgtatctaccagattgttatttctggagttaatctctggttgtttccctatcttactcaaaagctactttggctttgtattgcctttagaataaactgtgctccaacattcagtattctgcatgatctgttcctatatttttagtctcatctcctgctagtcatctctccatacttccgttgtagccaaacaaaacatttattggttcattttgtgtatattctgatgattttccatttcattacccatgattatgctactcccaaccgtgctatttccccacaccccaactgtctcaatcctatcagttgtcctaaatcttaaagaccactttctccatgaattctttcttgatgaccctcccagacagaagtagtctcttctgaactcccttaatcttttatttttaatttaattaatttatttattttgaggcagagtctcgctgtgtcgcccgggccggagtgcagtgttgcgatcttggcaccctgcaacctctgcctcccgggttcaagtgattctcctgcctcagcctcccaattagctcccaagtagctcccaagtaactgggactacaggcacctgccaccacacttggaataatttttgtgtttttagtagagacgaggtttcaccatgttagccaggctggtcttgaactcccaacctcaggtgatccacccgcctgggccacccaaaatgctgggattataggtgtgagccaccatgcagtctaatcttttattaagaaagtgtttggtgttgttatggtttcaatgtttgtccactctgaaactcatgttgaactttaattgccattagaacaatattaggaggtgggacctttaagaggtgattaggccatgagggcttcaccctcatggatgggattagtgctgttataaaaggagggggttcattcccttcttgctctctctttgggaagctgaggcaggaggattgcttgaggccaggactttgagactagcctggtcaacataatgagaccctatctgtaccaaaaaaaaaaaaaaaaaaattaactaggcctaatggcacatccctgtaatcccagctacttgggaggctgaggtgggaggagtccttgagcccaggagtttttgaggccgtagtgagctatgagtgcaccactgcattacagcttgagtgacacagtgagaccctatctttaaaaataataataatatgtcatggttcatgtttttattttatttttcaaattctgaaccttttggtaaatttattagaattatggtattgtagttttgcaaagtaacttttcaactgatgagaaagttatatggaactatttatgaagaagtgatttaagacaaaatacctaacattttttgaacacttaatatatgctaagcagtatattcattgccttatgtacactattttatttcttcttaagtacaactcagattcatactgttactgtttctatttacacatgaggaaaatgaaagacaccaaaggcctaagtaacttaagatcacacagttaggtgataagtggctgaacccaggtttaaattcacctatgttgtccgtaaatctcatgtttcgaaccataagaagtactatagtgtctcttgagctgtttgtttaagagatagaagtcttgctctgtcacccaggctgtgtagcagtggtgccatcatagcacactcactgcagccttgatctccttgggcccaagtgatccttcctcctcagcctcccaaggggctgggattacaggcatgagtcacctgacctggctcctcttgagctttcatgatcaatgtcagagatacactaaactgaggacatgaccttttatgaagtagtcatgcataactgcagtttgctgcattacaaagaactccaagaagctttctaaattcttttgatggcttgagttttagtcatattaccacttagaaatttatttattggccgggtgcggtgggtcacgcctgtaatcccaacactttgggaagccgaggcaggcaggcagatcacttgaggtcgtgagtttgagaccagcttggccaacaatggctaaaccctgtctctgctaaaaatacaaaaattagctaggcatggtggtgagcgcctgtagtcccaactacttgggaagctcaggcgggagaatcaattgaacccgggaggcggaggtttcagtgagctgggatcacgccactgtactccagcctgggtgacagagcgagactctgtctcaaaaaaaaaaaaaaaaaaaaggaaaaagaaatattagtatttcttgaaatgaatgaaccatttgcttggaaatggttccacttgagttgatgtgaggattaataaatatactttgaaacaaaaggaagctattgacacatagatatttaagttatatttgaattgaatttaaagatggctggctacttataagcatttgaaaaacagtttaaattccaaattaaagatggaaaattgtaaattactgtatctgtatattttttgaaaggctgcatgacatacaaagactaggagattgaaagatctgctttctgctttctaggttttactttgccacttatttacctcgtcttttcagagttacttcacctctacctctaagcttcagtttcttcatttgtcaaataaaaccccaaatttcagggaaatggtaccgttctgcttacctactagcactgatctgatgattacctcattaatgttatgtaaaattactttataaaccattgatataaagcatttaacacctttgacaggtcacttagaagcaagatttggtatctattttggttatatgggttcttcactagtattggggtatatataaaattagttctgtggattcattacattgagtgcagtcgttgagaagtacctatataaattagtacattacagactttatgaattcaagagcttcagattaggtcttcagatgaaagcctttctttctttgtcaaattcttatacccactgttttatttttgccaatatctacacctgtgcagtgttacttgtttgtagatgagatggtacatgatagtctaattcagttattattggtaatctacattttttaaagtgattaatatttaaaggataaaagatatattttataatgagagtggacttcgtgaagaatctgtgattgggatgaagagagtgttaaatggaagaggcagaaaggaaatcagtatctgtggaaaataactaccaatagattctaggctctaatagggaaatcgcaaaggaataatgagtgaataccttgagtactaagccaacatatttttcacctctaagctatatttactaggacagtctttgtgaaatataaacattacactgtgtcttagtctatttttgctgctataatggaataccacagactggataataggtgatgaacagaaatgtatttcctgtagttctcatggctgcaaagtccaagattgaggggtaggcatctggtgaggacctttttgctgcatcatcccatggcagaagggcaaatggggtggggaagagagagaaagaatgtgcatgtgcgtgagggcatgtgtataagggagggcaaacttgtcctttcataacaaacccactcccaggataacagcattaatccagtcacctctcatgaggccttgcctcctagcaccaagtttccaacacatgctttttgagggatatattcaaaccacagcatgctgttgatagagttacaggaatgctgtcatgcaccctacattgtagagggaaagcatctctttaattccctattctcctccttattcaccaaagctagataaagagatgaaaaaaaatttttttctctttgacaaattatctgttgaattttgtatgaagtgtctcttatattgtatcctagaattccaggatctagggaggtggtaaagaagcaatggtaaatttggggatcttatctccctaaagttcctgacactctatccctgatcctgcagtggctgccagaaaaaatgtaaatttacttaaatcttactctaaaatcattgaaagtccccccaaaaatcatatatttggctgatcaatatatgtatatttgcattagaataataatagttataattttttgagaatacagtgttgctggtcctgttaggcattttatagatttcctttcatttattctttataacacatctggaatttaatatagtttctcctcccattttacatggacattgaggctcagagaagtaacttgccccagatcccacaacagtgaatgatcaaactagcattcaaacccatatctctgggactccaaaatctgcaatttatttttcaaaatgccatactgctacgttgatatgacaattgttttgttttcatagatctggcctagcagcttaattgtgcagccagacctgggtaatcctggagcaagagtactacccctaaattcctaaatgtactaccttaaatgcaaaatatagatgataatgtttaggtgaacatgactttcagccacaaagcttctctgagtttaaaggggaggtattcccttcacttgtggctgctactgtcaggatacctgtccgctaaaatcaaggatgcaaagacccataaccattataagaataaactctagttttcaagaaaagtaagcataaatttctctgatggagattgcttcattgggtgttattgctttcaaaggtatcaaaggaagctcgtacttggctagtgaacacattcgttgttccatcattgagcagctcttgtcagaaagtccttttgcaattctaaactgaggaaaatgtctccttaatgaagggttgatatgtttgttactgtttcattcacaaaagtattttgaattataaaatgctttggccaggcatggtgtacatgaattacatgctcacacctgtaatcccaacactttgggaggccaaggcgggtggattacttgaggtcaggagttcgagaccagcctggccaatatggtaaaaccacatctctactaaaaatacaaaaattagccaggcgtggtggtgggtgcctatagtcccagctactcgggaggctgaggcaggagaattgtttgaacccgggaaggagaggttgcagtgagctgagatcacaccacagcactccagggttccagggtgggtaacagagcgagactctgtctcaaaaaaaaaaaaaaaaaaaaagagaaacctgcttaatatgaatttagataagccctaaattatagagctatgtttcatatttgtctcaaaaaattataaacaataaatcctgtccaagcacggtggctcgcgcctgtaatcccagcactttgggaggccaaggcagatggatcatttgaagtcaggaatttgagaccagtctggccaacatggtgaaactctgtttctactaaaaatgcgaaaaaaatcagctgagtgtggtggtgcatgtttgtaattgtagctattcaggaggctgaggtgagaggaattgcttgaacctgggaggcagatgctgcattgagccaagatcacaccactgcactccagcctgggtggcagagcaagactccatctcaaaaaaaaaaaaaaaacaaaacgagaaaaaaacaacttgtctgtggtaccatcttcataaatcctcatcttcccttaatgtcttataactgtacttattaccataattcattatgttcatgagttgactttgttcacccagtgaaattataagcttggtgacagcagcttcctaatctgaacatttcttttttttttttttttttttttgagacagtgtcactctatcgcctaggctggagcgcagtggcacaatcttggctcactgcaacctccgcctcccaggttcgagcaattctcctgcctcagcctcctgagtagctgggattacaggcgcacaccactacgcctggctaatttttgtatttttagtagagatggggttttaccatgttggtcaggctggtctcgaactctgaccttgtgatccacccacctcggcctcccaaagtgctgggattacaggtgtgagccaccgcacccggccttgaacatttctttatgacctttgaggtgatagttcttgagacctctaaagcaattcatacagtaaagctgtacagtttaaccaaggaaggcatcaatatttttggcttttacttagacaaacttcaacaatgtgataatataacttagtttatgctcattagaagccctgataaaattggaaaccaaattttcatttaataaatgccatttatttaaaaatcagctttttaaatgtaagtctttcatagtgaaagattgggaattactgtttggtagtgtccatccagcccagagttgcataatgtttattaaaaatatgattaattggccgggcgctgtggctcatgcctgtaatcccagcactttgggaggctgaggcaggtggatcatgaggtcaggagatggagaccatcctggctaacacggtgaaaccccgtctccactaaaaatacaaaaaagttagccaggtctggtggcgggcacctgtagtcccacctactcaggaggctgaggcaggagaatggggtgaacctgggaggcggagcttgcagtgagccaagattgcgccactgcactccagcctgggcaacagccagactccgtctcaaaaaaaaaaaaaaaaaaaaaagaaatatgattaatttattgatacaaagtagctaataaacttttttgtttttagggaatgtggtgagcaacttgggacattccttcttcagtcaaagtttccttggcagtaaagaacatggtggattcttatatgtgacatctacctaccagtcactgcaagacctagtactcccaaccccaccttacttgtttgggattcttatccagaaatgggaaactccttgggctaaagtatttcctatccgtctgatgttgagacttggagctgaatatcgacgtaagtagtaaaaacacgtttttcaaggcatgatgactaaaataatgcctgaaatattcagagccctctgtttggtgatataattcagcagaaatagtcttttgaaatagctaaactaaatttggccagtgtctgcgtgtattgggcataatgggaagcactgaaaataacgaatgaggaagttgattatgtattaccttgtaaacttactgcttttatagttcattgataaaaaacacgatcatctttagaaaagtgaatttgaacttaagtaactttattttttatagtttctgtatatgatgagcatattctttgtcacttggttggaaaacagttacgatcaattatattttacttaacatactggaagctagtggaatggaaaccactctcagttggtaagatacaggctacagaagaaggagcttccttgctcatggctttagcagcgtaactaagatgtgatttttaaaaagacattaatggttaaatgcaaactttattttaaattttatatctccatctaattaaaagtgccctgtgctaggaatccgaccacttgagtaagattctcaactctgccacttatgagctctgtaactttgggcaagtcacccaagttctctgattgtgtttcttttgtaaactggaaataataatgcttgccttctattttatattgggttgttaacaggatcaaatgagagaataaatgaaacataattttataaaccataaaacagtttatgttctcagcaagtcaacttcattcttccaccaattatttatttattcagtaagaatttaataaaggcctcccatatatcctgaatcctgggaattctgaaatagctaagatgtgattataggctctcgggaacttttataaggaatacatacagaaataatgattgtagtggtatcttgtattaaaacctgtgctcaaagttaagttcattgggagctccaagacaggctctaacttgaccagaccaggaatgaaggagtagttggaccttcagttttcttggaccagagtgcctctggattaactctgaaggaggcatatgaatcagctaaatgaatcagggaaagggaaggattgtgtgcaaaagaagcaacatgtgtatcttcctattttatacaggcatttcaaaccataaaattcaagagatgagccagactgatttgcctctcctaaggaggatcctggttaggaggtatagaagaatgaactcttggctgagtgcggtggctcatgcctctaattccagcacttttgagaggtggccaaggcaggcagatcatttgaggtcaagagttcaagaccagcctggccaacatggtgaatcccatctctactaaaaatacaaaaaaattagctgggtatggtggcgcatgcctgtaattccagctactggagaggctgaggcaggagaatcgcttgaaccctcctaaggcaggagatcatgccactgcactccagcctgggtgacagagtgagactgtgtctcaaaaaaaaaagagtgaactcttaaacttgttggaaaaagaaaaagtgaactcttaaacttattgagcacagaggaatcaggagatatttatttcctggatcgtatcaattcagtttgaagaagattgctccctaagaccttgtgggtttgtttgtttgtttgtttgtttgtttgtttgttttggagacagggtctcattctgtcaccaaggctggagtgggctccagcccactctgtcacccattctgtcacctgggctcaagccatccttctacctctcagcctcccaagtagatgggactacaggtgcatgctaccacacccagctaatttttttgtttgtttttttgtagagacagggtctccctaggttgcacaggctggtctcaaactcctaggctcaggtgatccttctgcctcagcctcccaaagtgctgggattacaagcatgagccactatgcctggctattgtgtgtcatttttgaaacatttacatcgaaaggcttattctggttatcagaagacttaatatggctcagcatttgtctgctaccatgccaaatactttttgagcccaaaatttgatatgttctaatgagccattataattatattttgaaaattgtattagtcatgaaatctcttttaccaaagttttatgttgccaaatttaagtttgatcatttctcatttccatagtttatccatgcccactattcagtgtcagatttcggaagccattgtttggagagacggggcataccatcatgaatcttcttgcagtaagttgggaattttttttcctttgtccttactggagtttatatgggagaaggaagaaagcaattttattattttcttggtagctgtgcccaagctgcttaaggcaggtaaagatatatgctgaagaaaaagaacagtatatgtatgtgtatatatatatatacacacacacacatatacatatatattcatatgtatacacacacacacacacacatatatatattcttttgcaaacatgaagtgaaatggtacaggattccagcgcctgattatacacttaccgtccaaccttgcagaattattgtgaggactagaagtaatacataaataaaacacctagcattctgtcttgtttttattttaagactggcattctatgagtttctcttgtgtctatataggttattatccaagcaaagattggtcagagattgtacccagataccccaagccagtaaggctactgccctctgctgatggatctgaatatggactggaatttaaacttcattgttttcctttcttctgggctctctcatgtctcctacacacgtgcacaggttctgactctgttggccaagatcattggttggcttgagtccactaagttctctgctgcatatatgcacagactaggatcaatcctggatatttggaccgtttatgaagctccctatggttgtcttacctcccagaacttgccccaaacaggtttggtgaaatcaaggtaatcaagctactgggcctccctttttaataaccaccgagattaccactttgacaatgttccatagcaagtaaactccttcaagtagcaaagctcatttttttgtttgttttgttttattttgtttgagacagagtctctatcgcccaagttggaatgcagtggcacgatctcagctcattgcaacctccacctccgagcaattctcgtgcctgagcctcctgagcagctgtgactatgggagcacactaccacacccagctaatttttgtattttttgtagagagagcgttttgctatgttggccagactgatctcaaactcctggcctcaatgattcacctgcctcagcctcccaaagtgctggtattacaggcatgagccactgctcccagctgcaaagctcattgtttttacaaactaccttgccctggttgaactacctaactacctaatggggctagggggcagccccaggcaagaaggtcacagactcaattcaaagttcagtagttttcatgaaaaaaacatttctttttttttttttttttggagatggagtctcgctctgttgtccaggctggagtgcagtggcacaatcttactgcaacctctgcctcccaggttcaagagagtctcctgcttcagccttcagagcagctgggattacaggcacctgccaccacgcctggctaattttttgtatttttcatagagacagggttttaccttgttggccaggctggtctcaaactcctgacctcaggtgatccacccatctcaacctcctaaagtgctgggattacaggcatgagccaccatgcccagccaaaacacttcttaatgttaatatgcctttgatctaattccagagcactgaaatggttctttttaagccacttatacagcttttcggttgctttttgaggagtgggtttggtgatttcctccctctgtgatgcttaaaagctatatttccagttatctttttttttttatttctttaaaaaattttgttttgttttgttttttgggacagagtctcgcactgtcgcctgggctggagtgcagtggcacgatctcggctcactgcaacctccatctcctgggttcaagcaattcttgtgcctcagcctccccagtagctggaattacaggcacgaaacaccatgcccagctagtttttgtatttttagtagaggcgcatgttggccaggctggtctcaaactcatgacctcgagtgatccacccacctcagcctcccaaagtgccttttgcctgttttttaattgggttgtctttttgctgctaggttaaatttgttatatattctggatattaactccttttcagatgtatggtttgcagatattttccatttctgtaggttgtgtcttcactctgttaatagtttccttttctgtgcaaaatctttttagtttgatgtaattccatttgtctatttttgcttttattgcctgtgcttttgggatcttatctaaaaattcattgcctagcccaatattgtgaagcatttgccctgttttcttctaatagtttcatagttttgggtttaaatttaagtctttaatccgtttttagttgatttttgtatatggggagaggtgggggtctagtttcattcttctgcatgtggatatatccacttttccaagtactatttattgaagagagtcctttctgcagtgtgtgttcttggcacctttgtcgaaaattagttggctgtaggtgtccaaattcatttctgggccttctattctgtactgttggagtatgtgtttgttttggccactactatgctgttttggttattatagttttgtagtatatttggtcaggtagtgtgatatctctagctttgttctttttgctcaggactgttttggccatttgaggccttttgtggttttataagaatattaaggttttggtttttttttctgtttctgtgaagaatatcattggcattttgatagagattgcattaaatctgtagatacctttgggtagtatggctattttcacggtattaattcttccaatccatgaacatggaatcagtttcctttgtcaatgtttttttttttttttttttttgagacggagtcttgctctgttacccaggctggagtgcagtggcgcaatttcggctcactgcaagctccgcctcccgggttcacaccttctcctgcctcagcctgccgagtagctgggactacaggtgcccgccaccacgcctggccaattttttgtacttttagtagagacggggtttcactgtgttagccaggatggtctcgatctcctgacctcatgatccgcccgcctctgcctcctaaagtgctgggattacaggcgtgagccaccttgcccggccctttttcaatgttttagaggtttctttgtaaagatcttttacctcttaactaagtgtattcctaggtatcttattttttttatagctactgtaaatggaattgttttctttattttttattagcgtatagaaacactactgattttacatgctgattttgtatcctacaactttaccgaatttgttcattagctctaacaggtttttggtggcatctttagggttttctatgtatagggtcatgtcatttgcaaacaagcacaatttgactttccagtttggatgccttttatttctttctcttgcctaagtgctctggctaggactatgttgaatagaaaggattaaaatgggcatccatgtcttgttcctgttctttgaggaaaagatttccactgttcccattcagtatgatgttagctgtgggtttgtcacatatggcctttattgtgctgggctgcttgtccagctgggcacagcaggccagccagctgtgtgttggtttctccactgtacaggtctgtctgttccctggggcagggaggtgccatgtgagttcagtgccagggctccctcattctgttgggcctaggctctcagcagctggatgatggtgatacagctacatgtgtgtgttgtggactgacagtggagcttcagagatggagagatgcagtggcaattggcccccaggcaggatgaactctagcagtgggtccagtttcaagatggcaccatgctatgactgggaatgagggctgtatgacatgggctccaactctggagcagtgtagtcctgtgaactgcaggcaactacaaactggattcagggtttgtgaggaccgcgggacgaggctgcagtggtcatggggaccatgggtccccagcttaccctttccccattagaagtagtccttcctgactccaggccactccttgcagggaggcagtgcggcagaggcagagtgcttcgctcccgtctctgtggtgctatctggggcatctggtgctccacaggaatttcagcactcccctggtgctctccagcatacttccacagccactccagttgaaatatagtttgtttattgttgttttggtcccttttgttgagtagaggggagcaagagccagacaactccagtcaaccatcttgctgatgtcactgtcgtttagagagaacaataagaaaaaaaagtcttggctgggcgtagtggctcatgcctgtaatctcagtactttgggaggccaaggcaggcggatcacgatgtcaggagtttgagaccagcctggctgatatggtgtaaccccgtctctactaaaactacaaaacttagctgggcatggtggcacatgcctgtaaatgccagctactcaggaggctgagccaggagaatcttttgaacctgggaggcagaggttgcagtgagccaagatcgtgccactgcattccagcctgggcgacagagtaagactcagtttcaaaagaaaaagaaaaaaaatcttgtagatttacccatctagttgccatttccagtgtttttcattcctttgtataactctgtattttcatctggtgtcattttccttctgccaaaatgattgcctgtaatatttcttacagtgtaggtttgctgctgatgaattattttagcttttgtatttctaacaacatctttatttgatcttcatatttggaagatacttttggtggttggagaagtctaggttgagttttgttgtttaggttttttggttttttttttttttgagacagagtctcactctttcacccaggttgtagtgcagtggcacaatctcggctcactgcaacttccacctcccgggctcaagcaatgctcccacctcagcctcccgagtagctgggattacaggcatgcaccaccatgcccagctaatttttgtatttttagtagagacagggtttcactatgttgctcaggctggtcttgaactcctgacctcaagggatcctcctgccctggcctaccaaagtgctgggattacaggtgtgagccaccatgctcagcccgagttttcttctttgagtgtttttgagatgttgctccactgtcttctgctttgcattgttttccctctcatctttgttcctctctacataacaattttttcttttcttaacgttgtttttctttttccatctttttttttttttttttttttttttttggaaatagggtctcactctgttgcccaggctggagtgcagtggcacaatcacggctcactgcacccttgacccacagggctcaggtgatccccccgaccttggcctaccaagtagctgggactacaggtacgtgccgctatgcccagctaattttgtttattttttatacagacaaggcctcgcagtgtttctcagactggtctccaactcctgggctcaagctatccttccacctcagcctcccaaagtattgggattacatgcatgagccactgtgcctgaccttctctggctagtttcaaaagctttttaaaattacaagtttgaagcaaattgattataatgtgccatagtgtagttttcatgtttcccgtacttggggttcattgagctttttgaatctatgggtttatagttttcatctgatattttttctgttcatccccttctctccctgaaggagattactccaattacatatatatcaggctgcttgaaattgtttcacgtcttactaatgttctttttatttctttttcagtcttttttgtctcttgttttcatttaggatgaattttattgctgtgctctcaatttcactaatcttttattttggtttaagctgctgttaattctatcaatcttttaaacaatctcaatcaaatactttgattttcatctcttgaagttatacttgggtcttttaagatcttttatgtctctgcttaacattttgtacatgtagaatacaatataataactattgtaatgcctttagtaattctaacttcttgtataagttctggctccgtttccatggattgattttttttcctttattttgagttgtattttcctgcttctttgaatgtttggtatttttttattggttgccagacattctgattttaccagttgggtgctggttatcaatattcttgagctttttttgcaagtaatgaagtcaagttacttagaaaaaccctccatctcacatcatattctacatttcagtaaatggcagttccagtcttctagtagccctggctataaaatttagaatcatctttaacttttatcatttgttcacattccacatccacagtggcaaatattatcagattttcctttaaaatatgtctggaaacaggctgggcgcagtggctcacacttgtaatcccagcattttgggaggccaaggtgggcggatcagctgaggtcaggagtttgagaccagcctggccaacatggcaaaaccccatctctactaaaaatacaaaaattatctgggcctggtggtgcattcctgtaatcccagctacttgggaggctgaggcagtagaattgcttgaacctgggaggcagaggattcagtgagccaagattgcgccactgcactccagcctggttaacagagcgagactctgtctcaggaaaaaaaaaaaaatctgtatctatatatctagaaactgacaacttctcatcactttttaaactgttaacatcctggccaggtgcagtggctcacgactgtaattgtagcactttgagagaccgaggcaggtggatcacctgaggttgggagttcaagaccagtctggccaacatggtgaaaccttgtctctactaaaaatacaaaaattagccgagcatggtgacgcacatatgtaatcccagctacttgggaagctgaggcatgagactcgcttgaaccctggaggcggaggttgtactgagccaagatggcaccactgcactccagctcgggcaacagagtgagactccatctcagaataaataaataaactgttaacatcctggtctaagctctcactatctcctaccttgattgtttttatggtatttatctgatcttttcttccattcttcctcccttaccacctattcattaccaaggagtcagatctgttaaaacaggtcaaaagcctcctaaaggcaaaagtcctcacggtgacctataagaacctatgaaatctagccatttgctattactttgaccttgagtccaccactcttgttcattttgtttcacccatactggatagatgatgtgttagtgtgtgtgtgtgtttccttacagatattcattgagtgcctaagatgttccaggcgttaaggatatagcaagaacaacacaactgagagtttgtactctcttggagcttcagagggaggagacagatagttaacaaataaatacagaaaatgttaagtggtggtaaagcagggtagacattcaaaaatattttttaatgttgtgtataagaggtatatgataatgtttggtttacttataagagtttaaagactaaagagctaaaatacatatagtggggctttcattatacatttccttattatttaaataaataggatctttcaatattgacattttttccattcgtgttaattttattactataaattaaaccctaccattgatgaattaatttattctgcttcaatctgctttggcccaggacttcagaaattaccagtataccttgccagtagttcaaggtttggtggttgatatggaagttcggaaaactagcatcaaaattcccagcaacagatacaatgaggtaagatttaccatgaaggcgtatttttcatagttgaaaacatgagtgaaggtgaaaaatgcatgattatatataaattttacttataattaattaacaatgaaatcagttaataatattgtatggcttagttcaattatggggaatttcattacaggaagacaagatgtcaaatttctgacctagtggttcattggatgtgtcattttaccttttgatgttatgataattagtattagatttgcattttgattaggtcatgaaattagccttgtatctgtaatattagtggtgagatttttaaaatgtccccactcctactataaatatttatttatttatttatttattttttgagatggagtctcactgtgtcgcccaggctggagtgcaatggtgtgatctcagctcactgcaacctctgcctcctgggttcaagtgattcttctgcctcagcctcccaagtagctgggattacaggcacccgccaccatgcctggctaatttttgtatttttagtagagacgaggtttcaccatgttagccagactggtctcaaactcttaatctcaggtgatccacccacctcggcctcccaaagtgctgggattacaggcacgagccactgtgcccagccgggtttctttgtataaaataatttttccttcctttttcctttttttttcctttttcatttcattttttcttcatttagccactaaatcatttatgcgttgaataaacattatgtacttggtatgcacgtagaatcacacagatgttttattggatttgtgagctcagttctcagcattattatgagaatgacctctgtgaagaaagcttttagccatgactttccacgtgatttttttttttttaaggatattagaaaatagtagctagaatgtgtgcttacttttttctgggatacaactagcagtcttcagcatttagataatcctgccttggagtatcaaggagtaatcgatgagactaggtagagtcaaatctttaaagtgaactatttgtagttcacagatcttgctctgttgcccaggctggagtgcagtaatgcaatctttcatggcctaaagaattttaaaagagattgtgctttgaaaacctattttatttctcaaatttgaaatattattgtctatttcacaaacatgtattaaatatattctgtgatttgaaatataaagatgagataagaacattaggcctgctggccaagcgcgatggctcacacttgtaatcccagcactttgggaggccaaggcaggtggatcacctgacgtcaggagtttgagaccagcctggccaacgtggtgaaaccccgtctctactaaaaatacaaacattggctgggtgcctgtaatgccagctactcgggaggctgaggcaggagaattgcttgaacatgggaggcagaggttgcagtgagctgagatctcaccattggactccagcctgggcgacaagagcaaaactctgtctcaaaaaaacaaacaaacaaaaaccttatgcctgctttcggagcgtttgctgtccaggaaaatgatggcatcagtggcctgtctggagtggctgctgccatcatgctggctgcagcagggtggtgctgccagggctgcatactccgtggagcctgtaggagccggggacaagtgggagccccaccccttccgagttggtggggtgggcctcccaaggtgcagctgcccaagttatggctgcagacctgggccttctgctccatggagcaggcaggagctccccccttgcaggcacagctgtagctacccgagttgtggctacggacccaggcatcctcgtgcttgggaaggcccccctcccttacagccctggaaatgcctgctcctactgcctggcttttccctgctgtcagcacccactccaatctcagagcaaagtcggggcagtgctgacacaccagtgccctgccgccttggccccctctggactttgggcactgacaaacataggaagtaagctgatgggggatgtgtgcagctcaatgctggcctgcagacaccccatggaacctacagcttgggcaccatgaatagcaggaggcaaacacgttcctgagcagaagaggccaggtccccgatgaggttccaccttcaggctaggaagggcctgaaggctggggggccaggccaccagtcccatggactgtagtgggaacttggggtgccttttctcagcctgcccatggctgtccatgcaccagtcggtgcatgcttcccctcctctgaggcctgtaaaagccctgggatcagctagagctgagcagacatcgggatgaccagctgcagagaggagctgcccactccagggtctcctctctgctgagacctgcagacgctgagatgaccagctgtagagaggagctgctcactccagggccgcctctctgctgagagctgaatactcgatttgacaacctgcctgtagagaggagccacccaccccaggccctcctctattacgtcactcataaagctcctcttcactttgctcaccctccacttgtctgcatacctcattcttcctggatgcaggacaagaactcgggacctgccaaatggcagggctgaaagagctgtgacacaaacaaggctgaaacatgccccttgcttgccacattgcaagtgaagagaaggagagaagagctgcagccctttggggaacccaagcttgggagctccctgagccagggctgtgactccctctttggggccctgtggttactgaagtctccaagcttccgaatgtcaccacattccctggtggcagctgtggaagctgcttgcggtgcacctggtccagctgcagcctggcagagagccagggcctgtgcaggcacctggagctacctgcctcactgcagcagccagcatgcctgactgtgtgcagtggccggaacccacgcttgctttctcacacaccccttgctgctccatgcctggctcacccttgacagacatgggatccaggctggtagtgtaagcctagcacagcctgccaggctgagtggccggaacaagcccagcaggcctgagcaaaactcaggcaaaggcaccactggccacagagctttccagccagaaaagcaacacaccaaggatcctgtaacagttagatgatcagatgtcattcccaagcaaataacatattgctatccttgatgtttgcgaggtagtgctgtgtgtttagaaattttgtttgtacaagtatatctgtaaaagctgaggcgctcatagttatttctttttttttgttttgttttgtttttgagacagagtcctgctctgtcacccaggctggagtgcagtggcacaatcttggctcactgcaacctacgcctccaggattcaagcaattctcctacctgagcctcctgagtagctgggactacaggcatacaccaccatacccagccaaaattttgtatttttaatagagacaggatttcaccctgttggccaggctggtctcaaactcctaactgcaggtcttctacccaccttggcctcccaaagtgctagaattacaggtgtgtgccactgcgttcagcccccatagttacttcagtactgactggacactttcacaacaatagctcctattcatataacctgtttttatctgaactctgttgcctccgtttatggtgtgcaggttcagaatcctttgttctaaaagagtaacagtatttcttgtcatttattttatggattatgtatcaggtctttttcttacctgattagcaaactgaattttcttttttcttctttttttttttttttctgatacggagtcttgctccgccacccaggctggagtgcagtggagcgatctcggctcactgcaagctccgcctcccgggttcacgccattctcttgcctcagcctcccgagtagctgggactacaggtgtccgctaccacgcccggctaatttttttgtatttttagtagatacggggtttcaccgtgttagccaggatggtctcgatctcctgacctcgtgatccacccaccttggcctcccaaagtgctgggattacaggcgtgagccactgtgcccggccacaaacaattttccttctgatttaatttttattttaactcaacataattttatctcctacaatctcatacagttaaattgtgttgtgtctaataattccacttcatagttgaaaaagtaatttcttttttcttttcttttctttttggaaacagggtcttattgtgtcaccaaggctagagtgcagtggcacaatcatggatcactgcagtctcaacttcctgggctcaagtgatcctcccacttcagcctcctaagtagctgggactacaggcgtgtaccatcacacccagctaatttttgtatttttttgttttgtagagagaggatttctccatgttgtctaggctgatcctgaactcctgggcttaagtgatactcccatcttggcttccctaagtgctggaattacaggcatcactacacccggccataattttcttgtacattttatttaatcacaatattcttcttttcctctcattcattttttccatttatactcatagtctttcttattattgcccatattttgtgctcttttgttcatggcttttgcagagctggttccttattgattcatacttcccctactcttcacctgcctaacccccactcattattcaggtgtcaccgtaaatgacatttttttcacatatactttgatttaactcccaactggggtaactctattatatgcattcctagaattctatgcatactatttgtaataatcagtacatttgtaattccttgttgtgtgtctgttttctctgctgtgagttccatgagggactatgtctatcttgtataccacaggtatcatcagcaaacaccctagtacggagtgggttagcaagaaatatctgttggatgaagacatgaaacagatctaatatagataaaacaatatgaaaacaaatggtgaaatttattgcaagtatactaaaggtacagagaaagtagatctctagaggatgaatagaatagacaccaatgtttcttaatttcttattgaccctgaatccctaacagagcaacacattgcatgtaggagatgttcgtaaatgttcaccaaataactagatgaatgaaagatttgaaatggataatgaatgataactaggcactagaaagagaagggcagacggcatggtgactcacgcttgtaatcccagtactttgggaggccaaggtgggcagattgcttgagcctaggatttaaagatcagcctgggcaacatggcaagaccccatttctacaaaaaatacaaaaaattagctgggcatggtggcgcatgccccgtagtcccagctacttgggaggctgaggtgggaggatcacctgagcccaggaagtcgagactgcagtgagctgagatttctccactgcactccagcctgggtgacagagtgagaccctgtctcaaaaacaaaaacaaaagcaaaaaagggcagaaaagaccttaagtgaaaagggggatagatacctgcctacacaaaggaagggaaggagcatagctcatagggaaatgggagacaacaaagtgcctagcaaagagggggttaaagcagactgatggctttgtgggatgtgaggttgtactaagactgctggcttcaaaatccactcagaggaatttagattttaatatgataatttataaagagcttttataggttcttaagcagaaaaagtgacttaatgaaagcaggattttggaaaactgagtttggtggctatatggaaaatgaggagggagggagggactaaggaaagactttaagcttagaaagctagaagatagtacttctgacggcatggaaattttaataagcattgtatataaaatttctaatctcttttgtcaaggccattaaagatccttgttggttaaggtcacctggttcatatatatatgtatttttttgagacagagtcttgctctcgctctgttgcccagctggagtacagtggtggtgtgatctcggctcactgcaacctctgcatcccaggctcaggtgatcttcccacctcagcctcctgagtagctgggactacaggcacacaccatcatgtccggccaaattttctgttaatagggatgagatttccccttgttgcccaggctggtcttgaactcctgggctcaagcgatctgcttgcctcagcctcccaaagtgcttggattgcaccattgcactgggcctcatgttgttacaatgagattattttcaccattgtattaactaataataaatatttagtatgtaccaggcactattctaagcatatatgtatctttacactaactctatgacatgagtatgctaactacctttttacagatgaggaaattaagatacagagaacttagctgggtgccatagtgaatgtgtatagtcctaggtacaggctgaggtgggaggatcacttgaacccaggaggtggaggccagcctaggcaacatagcaagaccccatctcttaaaaaagcaaaaaaagacacatagaacttaagtaacttgcccatgatcgtacagctagcaagtggtggagctgccatcaaacctgggctttctgattctggtgtccctactcttaaccactgcactgtagactttagtttaaataattaccaatttagttttagggctgatgagttaaagtgattgtatgtggttctatttacattttgtatgtaaccagatcactggcatagctagtacatgcacttaaatactgaagtctcatggaacggtagaactaaaattacctctggggcatttcctaatatgtgactagttttttgttgttgttgtcattgttttcttttttgagacagggtcttgctgtgttgcccaggcaggagtgcagtggtgtaatcgtagctcactggtagcctcctgggatcaagggattcccccacttcatcccctgaagaagctgggactacaggtgtgcaccactgtgcgcagctaatttttaaattttttgtagagatgaggtcttactgcgttgcccaggttggtcttgaactcttgagctcaagcagttcttctgccttggcctcctcaaagtgctgagattacaagcatgagccaccatgtctggcaatgactgttatttaatatgtttgtttaagatcagaaaaatgatgagccatagtgaaagaagaagagatgttagaatcaaatagaccttggattgatttttttttttttttttttgagatggagtttcactcttgtcacccaggctggagtgtggtggcacgatcttggctcactgcaaccttcacctcctaggttcaagcgattctcctgcttcagcctcctgagtagctgggattacaagcgtgcaccaccacgcccagctaatttttgtatttttggtagagacagggtttcaccatgttggccaggctggtctcaaactcctgaccttaggtgttctgtccgcctcagcctcccaaagtgctgggattataggcgtgagccaccactcccagctggattgatgtttaattactagctgtattaccttagtgggttaatctctcttctggaatatgggtatgctcatattgtgaagttttgtgacatttcaatcacgtgtcaaataactagtgttgtgtattagcctggtatactataattgtacataaattgtatgctattgttgttgtgttcatttttatcattcagattaattgttcatatggttaatttttatttttatttatttattttttttttagatgaagtctcactccatcgcccaggctggagtgcaatagtacaatcttggctcagtgcaactttcgcttcctggactcaagcagttctcctgcctcagcctcctgagtagctgaaattacaggcaaacgccaccatgcccagctaatttttgtatttttagtagagacggggttttgctgtgttggccaggctggtctcgaactcctgaccttaggtgatctgtccacatcagcctcccaaagagctgggattacagacatgagccaccacacctggcttcatttggttaacttattgaacttgtgttacaaacttctcattttcatgtgcttgtaggatgtatctaacttcccaatatagctaaattcccttaggatgtagagggcatctgggtaaatctataagaaggtgaagtggcgaagactcaaaacatcatttaacaaaatatatattgaatctaactgtaggtatttaatataaggaaaagaagactataaaggaatagcacagcatccaccattaatatgcataggctctattacactttgagactcatgaggttatttggttataggatatacttaaccctagggttcccataaggatgtggaacatgaaccatagcttgatagtagtacagtgtcaggcgtttgttacctttgacagtctttgcaacaacccatgtagcatctaacgtagctaattgggagcatctttttgggccttcctccagccccagataactgctcaaatgacaagattcacatcaggcaggtgtaggagctgtcctggcttagaagtcttattcctgacagcaaccaatatctcttggaaaaacttcataggcatagattccagggtgtctctaggggacttgctctgctacaagagtgactattgaagtaagaccaaagttatggctatctatcaggggtgtacggttctccctgttcaaatataatttattatctttcacttttgcccatgttggaatagtaaggattgattgtatggattgaattgtgtccctctaaagttcatatattgaagttgtaacctcccagtacctcagaatatgactttatttggagagagggtctttacaaaggtaatcaagtttaaatgaagtcattagagcaggtcgaaatccaatatgactggtgtccttataagaaggggaaatatggaaacagacacacatatagggaagatgatgtgaagagacatagggagaagatggccaactacaagccaaggatagaggcctggaaacagatccttctttcacagccctcagacggaactatctctgctgatgttgattttgggcttgattttggacttctagcctccagaaatgtaagacaatgcatttctgttatttaagccatccagcttgtactttgatatagctgtgcaagcatgctatcacaccagtccaccttaaacaactaaatatcaagacaaagtatgataaaaacaaaagataatgggcagagaaggtgagtcttctgcttaccctatcttactgcctgtagttttcaggccatagagcgggtaggggaaacccaaactgacttagaggtctccctgacttgaggagacagagttgagaaatatagagagcctacgatggttagaatttgcaggaccgattgccagaagtgttttaaaaattcaggagatctggaaagatttctggagtcttagctgattacttactagtcagtgtgtctatacgaggaaagcactgcaaagaaatgggtagaacaattctcacagggccaggaatagtttgtattcttaccagccagagtgacaaaggttcttgtactacatgggccacattatgtctaatgactcaaattatgtacagattcaaactgctctgatcctacctaataagctttaaagaaagcttgaaaaggatgaaagaatgggcacattaaggagagctatggaagatataaaaaagacccaaatcaagctttaagaaatgtaggtggcaacgggatgaaaagtatgttggatgaaattaaatgcagtttagacaatgctgaagaaaaaactcgtgatcatgaaaacataacaacagaaatgatccaaaatgaaacacagagaaaaggctgaaaaattaaataaacagcacgtcatcgagttgtggaatgtcaggcagccaaattctgtaattgaagtacccaaaggagagaaaaggtggtggacctaaaaaatatttgaagaaacaatggttaaaaaatttccaaatttaatgaaaattataaacttacagatccaagaagctcaatgaaccccaattgcaagaaacaggataaaaactacattaagaaatgttatgatcataatcaaattgtataaaaattcacataaagagaaccttaaaagcagcttgagggaagaaatcttccttatatacttaggtattttgcaaatacaaaagtgacagcatatttctcatgaaaacaatgcaagttgcaagacagtgcagcaaaatctttaaaatgctgaaaagaaaaactgtcatcctatattttatacccagtaaaaatacgttttaaaaatgaaggcaggctgggcgcagtgactcacacccataatcccagcactttggaaggccaagatgggcggatcacttgaggccaagagttcgagaccaaactggctaacatggtgaaagccccatctctactaaaagtacaaaagtacgccaggtgctgtggctcacgcctgtaatcccagtagtttgggatgccaaggcgggtggatcatctgagctcaggagttcgagaccacctagggcaacgtggtgaaacctggtctctactaaaaatacaaaaaaattaaccgggtgtggtggcgcgcgcctctagtcccagctacttgggaggctaaggcaggagaatcacttgaggcaaaggttgcagtgagccgagattgcaccactgcactccaacttggactacagagtgagacccggtctcaaaaagaaaaaaaaaagcaaaaaccgccaggcgcggtggtgggcgcctgtagtcccagctactcaggaggccgaggcacgagaattgcttgaaatctgggcggcagaggttgcagtgagctgagatcgtgccactgaggcaaagcgttttctcggatacatataatttatcaccaacagacctgttccacaagaaatgtaaagtccatcaaggagaataccaaatattggaaatctggatctacacaaaggaatgaaaagtgacagaaatgataaatttataggtaaacataacatctttttaaaagacaattaactgtttcaaattaaatgtttggccgggtgcagtggctcatgcctgtaatccctgcactttgaggggctgaggtgggaggattgcttgaagccaggagttcaaggacagctaggcaacaaaatgagacaccatctttacaaaaaatacaaaaattagctgggtatggtggcacataccagtattcctagctactctctaggctgaggcaggaggattgcttgagcccagtgattggaggttgcagtgaactatgatcacaccattccactccagcttgggcaatggaatgagaccctgtctctaaaataaaataacatatattaaatagtaatgtattgcggaatttataccatatgtagagacaaaaatgtagaacggtaacaaaaaggccagggaagaggatatggaagtatatgacatgtgatgtggtataattttacttaaaagtttattgataagttaaagatacgtaatataaacccaaaagcaaccactaaaaaaatcaaaatgggtaggtatatctaatcaacaaaaataataaaatggaatcataaaagaaggctgaaaaagataacaagagatgggacaaataataaatagcaagatagtaaatttaaatccagccatattaaaaaaaatgactcaaatataaatgatctaaataccttcaagtaaaaggcagagattgtgagactgaataaggaagattcatctgtatgttgtgtaagaaacatacgtataagaaaaacacggccggggctgggcgtgatggctcacgcctgtaatcccaacactttgggaggccgaggcaggcagatcacttgaggtcaggagttcgagaccagcctggccaacatggcaaaaccccgtctctactaaaaatacaaaattagccaggcatggtggtgcatgcttgtagtcccacctactcgggaggctgaggcaggagaatcacctgaacccagaaggcagaggttgcagtgagccgagatcctgccattgcacttcaggctgggcaacaagagtgaaactccatctcaaaaaaaaaaaaaaaaaaaaaaaaaaagaaaagaaaccacagccgggtgcagtggctgatgcctgtaatcccaacactttggaaggccaaggcgggtgcatcacctgaggtcaggcgtgtgagaccagcctggccaacatggtgaaaccccgtctctagtaaacacaaaaattagctgggctttggtggtgggtgcctgtaatcccagctactcgggaggctgaggcaggagaattgcttgaatctgggaggtggaggttgcactgagccgagatcacgccactgcactccagcctgggcgacagagtgagactggtctcaaaaaaaaaaaaaaaaactaaatgggtagaaaagatagcatagtaatattaattaaagctgaaatggctatattaatatctaggttatttcagaacatatattacaaccagggataaagaaatacataccatatttataaagggatcaatttatcaaaatgatacaacaatttcaaaacatgtatctaaataacagagcttcaaaatgcacagtgagagaactggtaaaacaaaaggttaaatggagaaacccacaataatatttggagatttcaataaccctgtgtcactaattgaaggaagtagtaaatagaaaatcagcgggactatggaaaacttgaagaacacagccaattttacttaattgatttttataaaatgttccgcacaacagcatcagaatgcacattcatttccagtgcacacagaacatttacaaaatagaccattttctgtggtgtaaaagaggtctcaataaatgtaagatgattcaaatcatacagaatgtggtctgtgaccacacagctttaaataagaaaccaatgccagaaagatctctagaaaattcccaaatatttggaaataaagtgtacatttcccaataatccatgggtcaaagaataaaccaaaaggaaaattataaaatattttgaactgcttgaaaatgaaaacatgagatataaaaattggggatacagctaaaacaatgattagagataaatttatagcattaaacccttgtattagaaaaaaaggccaggtgcggtggctcatgcctgtaatctcagcactttgggaggttgaggttggggggatcacttgaggtcaggagtttgagaccaacctggccaacatggtgaaaccccacctctactaaaaatacaaaaaaattatccgggcatgatggtgcgtgtctgtaatcccaggaggtggaggttgcggtaactcgagatcacgccattgcactccagcctgggtgacagagcaagactctgtctcagaaaaaaaaaagaaagaaaaaaagacatctcaaatcaatgacctactcgtctaccttaagtaattagacaacaaagagtaaatgaaatacaaaatagaagaaataataaagataagcaatccataaaatagaagacaaaaacaataaagaaaattaatgaaaccaaaagccagttctttgagaagagcaataaaattgataaacctctagttagactgattagatagggaaagcacaaattacctttttaggatgtaaaagagggaaactatcattacaggtccgatagacagtatgaacatgttttggtcagtgtgcgttcaacttagataaaataggcaaattatttgaacagtaagttttcacagctctcaagattaaatagataacctaaatagccctgtatttattaaaagaattgactttattgtttaaaaccttctcacaaagaaaagtcctagttcagatggtttcactggtaacttaacaatgaaggaagaaataacaccatttctgtgcaaacacaccaagaaaatagaagagaaggaatcttactctatgaggtcagccttatactaataacaaaaccaaaaaaagacattacaaaaaatgaaaactatacatcatacctctcatgaagttatttgcataaatagttaacaaatttttagtaaatccactctaacaatacataaaataataatgtatattatgactaaacatggtttatttcaggaatgctaagttggtttaacattcaaaactcattccatagtttaggatacaggatcctttaacaggatgaaaaaggaaaaccatatgatacagcaaaagcagttgacgaaatcctacttccattcaagattagagagagcatgattgtatgtgtgtgtgtgtgtgtgtgtgtgtgtgtgtgtgtgtatcttggcaatctaagaagagaactttcacaagctaatgattatctatgaaaaatctataacatctctaatggtaacagactgagtgcttcccctttaagattggaaacaagaacgggatgttcactcctgtttttattgagcattgtaatggagcttctagcccatgtaataaggggaaaaaaaataagagtcataaaattatatatataaaaaaagactgtcggtattcatggataacatggctgtctatgtagcaaatccttatggagtctacaaaatggccactagatctactaagtgaagttagcaaagtcgtgagattattgtataaaaatcagtagtattttggtatactagcaatgaacaattgaatatagaaatttaataacgatacagtaggccaggtgtggtggctcacacctgtaattccaacactttggaggacaaggtgagctgattgcttgagcccaggagttctagaccagcctgggcaacacggtgagaacctgtctgtacaaaaaatacaaaaattagccaggtgtcatggcacatgcctgtagttccagctactcaagaggctgaggtgggaggatcacttgagcctaggaggcagaggttgcagtgagctgagattgtgtcactgcacttcactctgggtgacagagtgtgaccctgtctcaaagaaaaaaccacaacatcaaaaatatgacataatttgggataaatttcttaaatgatctgtaatacttatacactgaaaactacaaaatattgttacgagaatttaaagacctaagtagagatatataatatttatggattggtagactcagtactgttaagattgcagtagtccccaaattgatctgtagcttcaacacaatcccaatcaaaatacgagtaggcttttttataaataaaaattggctgggcacagtggctcacacctgtaatcctaacactttgggagcccgatgtgggcggatcacatgaggtcaggagtttgagaccagcctgaccaacatggtgaaaccccatctctactaaaaatacaaaattagctgggcgtgatggcgcatacctataatcccagctactcaggaggttgaggcaggagaatcacttgaacacgggaggtggaggttacagtgagccgagatcgcaccattgtactccagcctgggtaacgagcaaaactccatctcaaaaaaaaaaataaaataaaaacaaataaaaattgaggtactgatcctgaaatttatatggggataaaaagaacctagaagagccaaaacaactttgaaaaagaacataatagccaggcgcagtggctcaggcctgtaatcccagcacttggggaggccaaggtgggcagatcacgaggtcaggagatcgagaccatcctggccaacatggtgaaatcccatctctactaaaaatacaaaaataagctgggcgtggtaatgtgtgcctgtaatctcagctacttgggaggctgaggcaggagaatctcttgaacccgggaggcagaggttgcagtgagctgagattgcgccattgcactccagcctggtgacagagagggggagattctgtctcaaaaaaaaaaaaagagagaaaaagaaaataattccaggacttcttagatgatgttaagaccttttttttttttgacagannnnnnnnnnnnnnnnnnnnttatttttttttgacagagttcgctcttgttgcccaggctggagtgcaatggtgcaatctcagctcactgcaacctccgcatcctgggttcaagtgattctcctgcctcatcctcccgagtacctgggattacaggcacatgccaccacgcccagctaattttgtatttttagtagagacggggtttctccatgttggccaggctggtctcgaactcctgacctcaggtgatccacctacctcggcctcccaatgtgctgggattacaggcattagccaccgtgcccggctgttaagatgtattttaaaagtagagtgatcaaagcagtattgtttgggtgtaaatatatatgaatagaccaatggaacagaacagagagtcaaaacatagatgcttacagatgctcaatagcttttccgtaaagatgccaaggcagttcattagcaaaaggataatcttttgaacaaaaatggtctttataattgtatagccagttgtttgaaaaagaagatgaacctcaacctttacctcataccatgtacaaaaattaattggaaatggttcatagatttatacagagttaaaactaaaacttctgaaagaagacataagataaaaatcttagtgacctttggcttgaaggagggtgagggaaccatatattacaaaggggctcaaggaaattttggggggtgattgcaagtgcctttttatgagtatatgcacatgtcaaaattcatcaaattgtacactttaaatatgtgtaattcatcagttattttaaatataactgtaaaagaaaatacatcattttttttttctggtaatgtaatagacgttcaaactttgatcaggtcactgcagtgatatagccaaagagttaacctatcgaagtctcacacaaaaaggaacaaggttttgttaactctttactcaacaccaaaaagataggaatagagaagtttatgttggttgtgatacaagaatctgtgaaatcatgtatttgtacaattctccatcttgtataggacaggctgaaaaataggctgaatggcctcttgagattctttcccactcttaagcttctaaaataggagttttggtttattttaatttgaaactacacatattcttcagagaagtgtgaaattacaaaagcataatttcataggttctttgtagcactggcgagaacagatggcgctaaaatctgtttgaggaatgtttgattctctggccttcaaggaatacatttcttttagggaattaggagctgatagtcctcttcttaaaggaatgaaaggagttggtcaaaggtcctctggagaatagtgcagaggagagagatgatgttccattgattattggtatagcttttcctagtttatacataaaagacagtatttaacaatagatatgttcaaataaaagaatcctcaagaagaagcccatgatactgtacctccactgactgcaagaggaggccactgctgaaccccacatgcccaggatagtactgtcttctctcttgtgtacatgcccattgacaggagtggttctactacactggacttctagtcaaactcctggctttccctgtctcccagaactcacaacctcgctgccatatttgtccttgagaccatcagctctaatctcattgtgtttatgtcaagcaccacaagaagttctggactcctagggcatccctcatttatcgtaatttaatttctatctctgtacaccctcctttctgaccccatttcgtattcattttggaaaacccaagatattagttcttgtaagtcttatttgcctctatacatttccttggtaatcttatccagttctatgggcttaaatactatttctaagctgacatcttccaaatgtttgttttagcctaaatctctctgctgttttgtagacttgactgtcttattgcccacttgacatctccacttgcatacacatttcaagcttagcaagttcacctttgacatggtcatcttacaggcttctctatctaaattaatgacagtgctgtcatctttccagttacccaagcccaaaactttagagtcatctttgaatcttcttttcctcattccttgatagacaaatctatcaggaaattctgctgcctctactttctaaatatatctataatccagctgcctctcaatcctgggaccagtctggtctctgacctagatttctgcagtggcctcctaactggtcttcctattagtacccttgtcagtctgtttttaatgtagcagcctaagtggtcttttcttttttttttttttttttttgagacagagtctcgctgtgtcgcccagtggagtgcaatggcgcgatctcggctcactgcaacttccgcctcccgggttcaagcgattcttcttcctcagcctcccgagtagctgggactacaggtgtgcaccaccatgcccggctaatttttgtgtttttagtagagacggggtttcactatattggccaggctggtctcgaactcctgaccttgtgacctgcccgccttggcctcccaaagtattgggattacaggagtgagccaccatgcccagcctggtcctttcaaaactaagtcatatcatatcactcctctgcttaaaaccttccacagatttttcatcccaatcagaatgacacaagtcctctacaccatttgtatttctcgactcattatctctgtgatctctttttttcttttttggagacagagtctcgctctatcgcccaggctggagtgcagtggcgcgatctcagctcactgcaaactctgcctcccaggttcacgccattctcctgcctcagcctcctgagtagctgggactataggcgcctgccaccgcacccagctaattttttgtatttttagtagagacagggtttcaccgtgttagccaggatggtcttgatctcctgacctcgtgatccgcccatcttggcctcccaaagtgctgggactacaggtgtgagccaccacgcccggccctctgtgacctcattttttataactattccttttctgtcactcagctctggccacactgtcctcagtgttccttgaaattccagggcatgctaccttactgccctccagggccttgcacgtatccccatgcagtgggataaaagcctttggcttttccctcacttttttcagtaagacatcctctgactctcctatttaaaattgtacccaccaatactcccagtcctccttccatgttttatttttctctgtagcacttgtcattgtataatagttttatgtattttacttatttgtttattgtttttgtctcctcctcctacacacaagaatataagctctgtgagggcaggaatttgtttgcttgtctactactgaataaagcaagcactaaaacagtgtctggcacgtattagatactcaatgcccattggctaaatgaataagtattttctaaatgaatgagtgaaggcagcctgggcacatagcgtgagacctcagctctacaaaataaaagtaggccagagggccaggcactttgcctcatgcctgtaatcccagcacattgggaggccaaggagggagggtcacttcaggtcaggtgtttgagagcagcctggctatcatggtgaaacccatctctaccaaaaaataacaaaaattaggcgggcatggcagcacatgcctataatcccagctattcgggaggctgaggcaggagaatcactcctgaggtccggagttcacaaccaccctgactaacgtggtgaaaccccgtctctactaaatacaaaaaaaaaaaaaaaaaagccaggcgtgatggcgcatgcctgtaatttgagctacttgagaggctgagacaggagaattgcttgtacctggttggcggagattgcagtgaactgagattgtgccattgcactccagcctgggcaacaagagcaagactcagtctcaaaaaaaaaaaataaccacaaaaaaacaaatgaaaataaagatagctgggcatagtggtacatagctatagtctgtgtacctgggaggctgaggtgggaggctcacttgagcccaagagttggagactgcagtaagctatgattatgccactgcactccagccggggcaacagaacaagaccctgtctcaaaaacacacacacacacacacacaaaaacaaaaacaaaaacaaaacaaaacagattgaatgaagactcatagttgtcaatatgtagattcataggacttgaagatggggtctagcctctggacactagtgaatttcagctaactggaagggtacgtatttacatttttcttaaaattactccaagaaagtatattcttccaccttttccatcgttcttcagctcagtgtttctttctcacttctagttctgttcctcacttatgctgtttcctctgtccaaaatattctttttatatacctgatagcctttagcaaacctccctagaattctccatcccctagacagtgtcactgtttttctcctccattttcctgttgttctttatttctgtaacatgcacaggatgatgggtgtgaatcctgtcctctgaattgtgagcctcttgagggcagagagtaagtctttcatgcttccctgtatccttgtagttgttcacttttcatagatttttcacacctttgtactggatcttcctgtctaaagcctttgttaatcacttgataatgtttgtagaactgaatcactaaaacttattttatttggccgggtacagtggctcacgcctgtcgttccagcactttgggaggctgaggagggaggatcactttagccccaagatttgaaaccagccttggcaacatagtaagaaagaccccatccatacaaaattaaaaataaaagaattaggctgggcgtggtggctcacgcctgtaatcccaacactttgggaggctgaggcgggcggatcatgaggtcaggagatcaagaccatcctggctaacatggtgaaaccctatctctactaaaaatacaaaaaattagctggatgtggtggtgggcccctgtagtcccagctactcgggaggctgaggcaggagaatggtgtgaacccgggaggcagagcttgcagtgaggctgaggcaggagaatggtgtgaacgtgggaggcagagcttgcagtgagccgagactgcaccactgcactctagcctgggcgacagagcgagactccatctctaaaaaattaaataaataaataaatacataaaaaataaaagaattagccaggtgtggtggcacatacctgtagtcccaacttcttgggaggttgaggtgggagggtcacctgagccccagaggtcaaggctgcagtgagcagtgatcatgccactgcaccccagcctgaacgagaaggcgagactgtctcaagaaataaaaacaaaaacagaaacttattttattagatacccaatctatgtgacactaattacaagtgaatcaagatttaaaagaaaatcgtgctaaccacattaactctcagtatagttttatgactattacaagccatccaaatctattcctacttattcggtttactaactagtatattcagcaagtatttatggagtgcctgccatgacaaaggccctatgctaagcctaacacatatacaaattgtatccactcctcaacactctgcttaaactcctctataaatcctttccagttcaaatcgaaaggctagtcattttttaaacatgagatctcagagaggaaattggaagtacatgatgtgttaactgaaagatggattaggtgttataactcttcacacacttctgcagcataatcattcatagaactgtgttcttttaattggctcctgtgatttttccgggactccaagggtgggaaacaccgggaggtaaagctcgtgctgtttcacttgatgtgctaaaatggttcttatgagataatgctcctgtagcatttagctcagcttgctcagtgcctggttcatggttggtgctctggaaatgttacgtactttgcacattctgttgttacagcagttgtttctctgccttttactggtatgtcattctcaataatttgtaaacttttaggaaaggtctttaatttcattatcttataagaggtataggagctacctggttgaattatttgctgctgattttaaggttgctgtaaggttcagtaggcagggtagggaagatgagcatacaaattttatttaacaaattgtttgttaaaagagtacttattatatgtttgatgctgtcctaagcactttgtaaatattaatttatctaactctcataactctatgaaatagttacttttattatcacattttatagaagagggtcctgggacacagagaggttaagtaagtttaccaaagacacacagatagttagagcaaggccagtattcagatactgttggtcgaaggccaggcatggtggatcatgcctgtaatcccagcactttgggaggtcaaggtgggtggatcacctaaggtcaggagttcaagaccagcttgaccaacatggtgaaaccctgtctctactcaataccaaaaaaaaaaaaaaaaaaaaatagctggacatggtggcacatgcctgtgcctgtaatcccagctacttgagaggctgaggcaggagaatcacttgaacccaggacgtggaggctgcaatgagccaagactgcaccattgcactccagcctgggcaacaagagtgaaactccatctcaaaaacaaacaaggccgggcacagtggctcatgcctgtaacccagcactttgggaggctgaggtgggtggatcaccaggtcaggagatagagaccatcctggctaacatggtgaaaccccatctctactaaaaatacaaaaattagctgggcatggtggcatgcacctgtagtcccagctactcgggaggctgaggtaggagaatcgcttgaacccaggaggcgaagtttgcagtgagccgagattgcaccactacactccagcctggtgacagagtgagactctgtctcaaaaataaacaaacaaaaatactgttggtcttgcaattaagcattattcaaggttgaatgtgaatgatggcatataaaaagtacagagaatgtgctatggcatttcaaagaaggtaatggtcacattaatgtctcactgggggttaaagaagtcttcatgctggccaggcgcggtggctcacacctgtaatcctagcactttgggaggctgagtcgggcagatcacaaggtcaggagttcgaaaccagcttggccaatatggtgaaaccccatctgtattaaaaatacaaaaattagtggggcgtggtggcgtgtgcctgaagtcccagctactcgggaggctgaggcagaagaattgcttgaatccgggaggcaagaggttgcagtgagccgagatggtgccactgcactccagcctgagtgacagagggagacttgtctcagaaaaaaaaaaagtcttcatgctgaaattggcattttcaggggactactttttcaggtgcttggccatgggagaagaaaagggaaggtaggccgggcgcgatggctcacgcatgtgatcccatcactttgggaggccgaggtgggtgggtcacttaagctcaggagtttgagaccagcctggccaagatggtcaaactccgtctctactaaaaatacaaagaattagcccgggtggtggcgggcgcctgcagtcccagctacttgggatgctgaggaaggagaattgcgtgaactcaggaggcagaggccgcagtgagccaggaccacaccactgcactccagcctggccaacagagcaagactctgtctcaaaaagaaaaaaaaaaaaacccaaaaagaaaatagtaatgcaaagcctcagggatgggaaatggtaggccatcaggaagtagtcctacatgtaagcagcatgtaaggatactgtaggagggaggcaagatttggggttagagcataggaagcttgagattctgaatggaggacaagctggagaagatgtgacatagagctgtgctttgataagtacgaaaacattgtatgtgatgaatcagaactgatagagattcactgtaggaaaaccagttacaaggtcattatgtccagaaaagaggcaattaggccttgaactatggtgaaaataggtatagatacaagaacattacagaatttgaattgacagcagaataacacaaccaaaatggatagtcaaatatttatatcattatatgactagtgtaagtttgttttatggtcagtaaggtcctttgaatctcttgaaaactctgctcttgttgtaactgagcattatcttaagagaaaatatattcatttatctctaaagaaatatgaagtttctttcattggacttgtaatttacatccaaggaaatgatttcctttgaggccagctaatttattcagaatgtctggattgaaaatgtttcttagtctgcttagtgtagacaaaattagaaaccactttagcctaatgattcggaagaaatgatttctttaaaattgtgatcatctcagtttctttcatgtgatacaaatgtaaattgcaaatgagaacctaaatgtgtctgtcagttggctttgctaagcagaaatcttctagctgactcatcctatttacagaagaattatttcaaagtaacctttggaaaacctgggtagaagtggtttggattagtgaggttgataaatatcagtgtaagaggagtattcaattatagtttggatacctctggtgctttggaagagttataataaagtaaagccaagagatgatgatgatgccttagagttgtatggatacaatacctaggagtaaatttaaccaaggaagtaaaagacttgtaccctgagaactacaaaacgttgctgaaagtaattaaagacctgtgtaaatggaaagatgttccatggattagaagacttaatattgttaagatgtcaatattaaaagtgatctacaaatgattcattgcaagccgtatcaaaatttcaatggcctttttgcagcaatggaaaagccaatattcaaatcatctgtaattgcaaggggcccttaatagcccttcgtggatgttcttgaaaaaagaagaacaaaattggtggatttatacttctcaattttaaaacttacccttacctcacattatatataaaaactgactcaaaacaatcaaccaacaaactaaatataagagctaaaaccataaagctattagacgaaaacagtaatctttcgtgaccttggatttggcattggattcttagatatgaccccaaaagcacaagcaacaaaagaaaaaaaatagatgaattggatttaataaaaattagaaattttgtgcatccaaggacattagcaagaaaatgaaaagacaacctataaaatgggagaaaatattttcagatcatatctctcataagggtcttaagaattcttacatatcggccgggcgcggtggcacatgcctataatcccagcactttgggaggccaaggctggcggatcatgaggtcaggagatcgagaccatcatggttaatacggtgaattcccgtctctactaaaaatacaaaaaattagccgggcatggtggccagcacctgtaatcccagctactcgggaggctgaggcaggagaatggcgtgaacctgggaggtggagcttgcagtgagcctagatcgcgccactgcactccagcctgggtgacagagcgagactgtctcaaaaacaaaacaaaaaaaaattcttccgtgtcaacagcaaagacagcaaggcaaagtgggtatgtgcctgtagttccagctacttggaaggataaggtgggaggatcagtgtcaacctggataacataacataacataacatagcaccatagtctctaaaaaaaagacaacccagttaaaaaatgggcaggccaggtgcgatggctcacgcctataatcccagcactttggaagccaaggtgggcggaccacttgaggtcgggagttcgagaccagcctgacgaacatggagaaaccccatttctactaaaaatacaaaattagtgggtgtgctggcacatgccagtaatctcagctactcgggaggctgaggcaggagaatcacttgaacctgggagctggaggttgcggtgagctgagatagtgtcactgcactccagcctgggcaacaagagcgaaactccatctcaaaaaaagaatggctgctccataggcagagcagtgtcatgggctgcctgactgagtatagttacggtatttcctgattatatgctaaacaaagggttttctgggaaaggggtggggaattcctggaactgagggttccttcctttttagatcatatagggtaacttcctgacattgccatggcatttgtaaaactgtcatgtatgggtgggagcgtcatttagcatgctaatgcattataattagtgataatgagcagtgaggacctccagtggtcactttcatcaccatcttggttttggtgggttttggctagcttctttacagcattctgtttttatcagtggggtctttgtgacctgtatcttgtgctttcctcctatcctaagaatgcccaacctcctgggatgcagcccagcaggtttcagcctcattttacccagcccctgttcaagatggagtcaaacaactctgacagcactacaacttttttattttatttttattttttgagatagtctccctgtgttccccaggctggagtgtagtagcgcaatcttggctcactgcagcctccacctgttggggtaaagtgattctcctgcctcagcctcccgagtagctggaattacaggcacccgccaccacacccagctcatttttttgtacttttagtagagatggggttttaccatgttggccaggctggtctcgaactcctgacctcaagtggttcacccacctcggcctcctaaagtgctgggattacaggtgtgagccaccgggcctggcctgcaacactacagcttataggaggaagaggggagtaaaacaaaataagtttccagttagatgtttaaaggctcaattttaaaggattagatcagaaagttggacaaatgggatgacatgaaggaaaaaatgggaaataaaaacaaattatcattaacccagagctgggctaggtggcatgtgcctatataatcccagccattcaagaggctgaggtgggaggatcacctgagccaaggagcttgaatccagcctggacaacatagtgagatccctgtctcttaaaaaaaaaaaaaaagtgtcggccgggtgcagtggctcacacctgtaatcccagcactttgggaggctgaggtgggcggatcacgaggtcaggagatcgagaccatcctggctaacacggtgaaaccttgtctctataaaaatacaaaaaaattagctgggcgtggtagcaggcacttgtagtcccagctactcgggaggctgaggcaggagaatggcgtgaacccaggaggcggaggttgcagtgagccaannnnnnnnnnnnnnnnnnnnaaactcttttttttttttttatttttttttgagacagagtcttgctctttcctcaggctggagtgcagtggtgcgatcttggctcactgcaagctccgcctcccgggttcatgccattcgcctgcctcagcctcctgagtagctgggacaacaggcatctgccaccatgcccagctaaatttttttttatttttagtagagacggggtttcaccgtattaaccatgatggtctcgatctcctgacctcgtgatccgcctgcctcggcctcccaaattgctgggattataggcatgagccaccgtgcctggccccaaactctttatagaaataaataacaacaaatgatcattaacctgtttcagccaagggttggagtttaacatcaaggtgagttcttacatattacatgcaaaacagtggcccatgaatttttttttttttggattaggtcagaattatcatgttaaatcttttgagaagaataaagcaaaatattagtaactaatttcattgaagatctcaaacataagttagtaaaattaagaaacaatttgaatttcatatgtttttagagggaagttcactcctttgaaagttgaaaaagaaagcagatgtacttaaatatgggacattcttttgaacttagaatttcagattatatatcctcagagaatccagtatataggagaaactacaattagctaaactaattttagctacttgagttcaattcagcaataagacaaaaagtgaatgcaaaatgtatcatgtgcttattaggtcatagtacaaatggcttataaaatgtacagggaatttttgtgtacattgatttgttaatggtgacatttttttactttgtttcattatttggtggccctttttgtcactttaatacgtaatattctgttagttttgtttttgagaagatggagttgcaccatgtcagacagaaaaatgcccattcttgtcagaataaggttatctctttgattgcagatgatgaaagccatgaacaagtccaatgagcatgtcctggcaggaggtgcctgcttcaatgaaaaggcagactctcatcttgtgtgtgtacagaatgatgatggaaactatcagacccaggctatcagtattcacaatcagcccagaaaaggtgagcatttgagctggttgagattatgataatggaaaattatactggacttggacagttagatacctcagtcccgtaacactcactttctagataggtgaccacaaacaaattaattaacctttccaaccatattcttcaggattatgttgactccccaagtggccagactcagagttgcaaatgggatatgtgttattgagggaacaattttgaaaatatgcccttaggagggagggatagcattaggagaaatacctaatgtaaatgacgagttgatgggtgcagcaaaactaacatggcatgtgtatacgtatgtaacaaacctgcatgttgtgcacatgtaccctagaacttaaagtataataattaaaaaaaaaaaaaaaaatatgcccttaggatattgacaagggccagctctgacatttgaaggcacgactaggccccataatgagagtatgtttaggtaaatttgaagcttgttggatgaccattcccacagaatgctaattaacttgacaggattctgaaggaggtttcagtgctattcagaatgtggtctccacaccccagattcactaatcaaaatttgcattttaacgagatctctgtgtgattcaagtgcacattcgactttgagaagcattgctcaagaggcgttacccaaagtgttttctcaggcaccatggtgttaaaaacttcacatgaaaaaataagtcttgtttaatagatttaatctaagaaaccccgtgttaggccagccgcggtggctcatgcctgtaatcccagcactttgggaggccagggcgagagcatcatttgagctaaggcgttcaagacaagcctgggcaacatagcaagaccctgtctcttaaaaaaaaaaaaaaaaaagcagggcatggtggctcacgcctgtaatcccaacactttgggaggccgaggtgggtggatcacctaaggtcaggagttcaagaccagcctgaccaacgtggtgaaacttcatctttactaaaaatacaaaaaagttagcggggcatgctggcacatgcctgtagtcccagctactcgggaggctgaggcaggagaatggcgtgaacccaggaggtggagcttgcagtgagcagagatagcaccgctgcacgtcagcctgggtgacagagcgagactccgtctcaaaaaaaaaaaaaaaaacttagcagataaaatagttggcaaccatatttctatcttcagaatatatttgatctaaaaaaatctgaaaatcaatggattagattgggggtggcaaactttttttgtgaagggccaaatgataaatattttagactttgcaagctgtggtttttgtcaacaactattcggctctagtattatagtgcaaaaactgccatagacaataagtaaatgaatggacatggctgtgtttcaataaaattttatttacaaaagcaggctggaggccaggcaggctatagcttgccaaccccctgacctcaaccattaagattccttttcttgtaagatacttggattcttaattagaggaagaacaaaacaaaatgggggagtgtatcttaaaacctagttcccaaagctgttgtaagcatcagaattgttggttacatgtttattgtggaatatagatttgattttttaaaattttctgtgtgatgatggtcggaattctcaacttctgaatattttgttattattttcaatccctccagcttagggtctgtcttactaaactatttctattgctgttttagtgactggtgccagtttctttgtgttcagtggcgctctgaaatcctcttctggataccttgccaagtccagtattgtggaaggtaaagaatgaattgttcagtcctcataataaggactgaacttatgtacataaagggaatcctttacacttctgctgtagatgtctgactcctactgttttttcagtagcatctcttcagcaaattaaaactgccatgagagtgcttagttctctgaagaaaggagtaagtggtagggataccatgtgacaatgacattaaaactaggagatggcctttcagagctctgggataaggtacctgagggcatgtagtctgagttcaaatatatcattgggtggaaatattaatatctaaatgtgtagatgaaagtcctgtccacaagaatgctgtggtcatcatttggagtacaaaatggcatgtgcttgctgctagtgtgctataattagacatgacacatatgttgacaaaagttaattaaactaaaagctaattggcacaccgtttattttctttgttggttattcattgtgttttgattttgctactcttatttcataacagatggcttaaaacaaccattttatcatgcttgcttatcctctagatcagtaatcttgacagggcaatgcagggatggcttaacactgcttcatgatgtttggagtcttagttgggatgacttgaagttatctgatgactgggagctagaattatatgaaggtttgttcacacacacgtctgaggcctggcctgggatgatttaaagactaggagtggtgactggggtacttacgtggggactccttaacatggcttgataccattgggatagctggactttttacatggtggttcaggactccaaacatgaatgttctagcaagaaggtggaagctgcattgccttttgtgacccaccctttaaagttatattgtgtcatttccaccatactctggtgttggaaaaagggagggaaattagacttcacttctacatgggagaatgggaagatagcattgtagaaaaatgagatgggagatatgaccatttatggaaaatgtagtctgcctcacatgatgacaggttttcatttttacagtagctcactccaaagctctgtgtaaaaacagtcctttcttaggccgggtgcggtggctcacgcctgtaatctcagcactttgggaggccgaggggggcagatcacttgaggtcaggagttggagaccagcctggccgacatggtgaaaccccatctcaactaaaaatacaaaaaacagccaagcgtggtggcgcatgcctgtaatcccagctacttgggaggctgaggcaggagaatcacttgaacctgggaagcagaggttgcagtgagctgagattgtgccattgtactccagcctgggcgacagagtgagactctatctttaaaaaaaaaaaaggtcctttcttagggctggattccagtgtgttgattgaaatacgtagataatcttacatatatttatagatactagctttggtcttcttttggtaaatttaataaaacagtgagtgaaacacagagtgcactaatattttacaactaaaatttacaactcttgactacaaaacagaaacatgccgttaacaaattgttatgaaatctaagaggtttttttttttttttttttttttttttttaagatggaggcttgtagcccaggctggagtacagtggcacaatcttggctcactgcaacttctacctcaagtgattctcctgcctcagtctcctgagtagctgaaattacagttgtgcgccaacacgcccagctaatttttttgtatttttagtagagatggggttccaccatgttggtcaggctggtcttgaactcctgacctcaaatgatccaccaggctcagcctcccgaagtgctgggattacaggtgtgaaccaccacacccagcttaaaatctaggagttaaacagtcatttggtctaaagcaactagttaaagcctatatgatgaagtgttgactatagttgaaattgtgacttcacaaggtgattttaaaacaccccttaaatgttgttaaatgataaaatgagctgggcatggtggcatacacctatagtaccagctacttgggaggctgaggtgggaggaccctgtgaggccaggagcttgaggctgcagtgcattatgatcgtccctgtgaatagtcactgcgctccaacctgggcagtcatctcttaaaaaaaaaaaaaaaaaaaaaaagataaattgacctgacacagatccttaccaattcaaagcagtgtgtttaaaaattatgtgtttatgtgtctggcttgggaatttcttgggtcttgcatttcacttgtgtgtttcagtggagcgattggctgactatgaaattgttattgagactctttagaaattatttcattgtgtgtcagtgaagcagagtaattgctcagcatgtgacaacttttactgtcaatttcagtgtttgccttcaactcaggtaggtagcagctgaaaaagttaccatctgttggttatctggtagcccatatgaaactctgtggtaggtttgccttatttgctagtcaataaatggatttatctccaagcccactactataatttattcagtgatttatttagcaaacatttattgggcattcactgtatgccaggcagtcatagtaaggtgagagagatggagatgcaaacaaatgaatatgaccagaggatgataaatgcaggagtgaaaacaggaacaaaatattcagtgtgtccagaagaagaatgtgactgtgtttaagttttccccttaagtagtctcaggagaaattcttagttgtgtctgaagtgaaatcaacaagcatgtgttttaatcttggcattgcttctcacaacactttcagtaagaggttcagctcaaagagcaaaacctctgtatcagtcagctttggaaagcagagctaaggtttacatttaactcggaggaatttgctagatgccaggtgctgtgtttcatttgcctctcctttggctttgtactgattcttagatggtgttatggtccagattactgcagagaacatggattccttgaggcaggcactgcgagagatgaaggacttcaccatcacctgtgggaaggcggacgcggaggaaccccaggagcacatccacatccagtgggtggatgatgacaagaacgttagcaaggggtaaatgcagcacatgtccccctttgtggcttttagttataggttaggctctgggttttgtctgctgtctacattggtgttttatagttttactgaaagccctgcctaagagaaagactgctttgtatgcttaacgtagaattttaaatttctggttttgtaagttagtttctgaaggagtttctgtatgtatttttgagggaagtataagtagagggattgatgaaacaaaaaagtccctctatagttattgagataacagtaatacctgagccttttaagatttacaacacatttttgccaacattgttttgtttgatacaataacaggtgttaacatttccattctataaatgagtaaacaagtaccaaaaggctaagtgacttttcaggtctacaaagctaggaagtgataagactagctctgaaaaccaccttcttgggcttcaaactctgtattctttctcagtgttcggcaactctattctaatggttcaagccaaaaccttggagacatctttgacacttttctttccccctcacccctttcttcctctcatacccagacattcagggacaagctggaaaacattgcatttatacattacaaactgaactttgtatcctttctcaaaggattctacacaacaaagggtgctctttttttgttttgtttttaacattgctatttgatgaattagaaattaaacttaaattcaagtaattttgactaaatgaagtgaatgcctgatatggaagtttaagttagattcgacttttaatacatagagatttggccgggtgtggtggctcacgcctgtaatcccagcactttgggaggctgaggcaggtggatcgcctgaggttgggagttcaagaccagcctgaccaacatggaaaaaccccgtctctactaaaaatacaaaatcagctgggcgtggtggtacatgcctgtaatcccagctactcaggaggctgaggcaggagactcacttgaatcgggaggcggaggtttcggtgagccgagatcatgccactgcattccggcctggacaacaagagcgaaactctgtctcaagaaaaaaaaatagagattcaagaacataaacaggtttgaaaattgttagggaaagtttagaatctgtgtgccaattattttgaatcctaatcagaatgaatgtgtatctccatgtatttatacttgtatttcagggaggaaatgactatcagaagtggcctttttgtttaggaatctaggagtgataatttagcactaaagggaaggtgttatgacagatacatagatacttgtttacactagcactgtcataattagcaacttggtcaaataattcctttttttttttttggagacagagtcttgctctgtaacccaggctggagtacagtggtgcgatcgcagctcactgcaacctccgcctcccaggttcaaggtgattctcatgcctcagcctgcccagtagctgggattacaggcatgtaccactattgcctggctaattttttgtgtttttagtagaggtagggttttgctatgttgctgatgctggtctcgaactcctgagctcagacagtctacccacctcagcctcccaaagtgctgggattacaggcgtgagccaccatgcccagcaaatgattcttaataaatatttattagactcctaagttccaagcagtgggtcagtaatgggaatataagcacatagaggggaatatatcatattccctccccttcagaagttcatttgtaagtcaggtatgcaaacatgaagaatatatcatgacaagtatcattacagagtcaggagcagagtgaaaacaagattgagtgggtgaccatgcattcactgaaagaagggatactggaagaagagcaggtttgattaatcaatttctttacgttaaagagaactagctcctggaaaaatgattccttttttgcatgtgtgttctttgaactatttcagtgcatagattctttcccaagagctcagttcatgtacatttttatacagtggctgcttcttgctatgatgtgctgcacaggtgtgttcagcagggtacccagtgtaattagcaggaagacttctgcagcaaaacgtgataggaaaaatggcttttctaacttcaagagctgcttctatctttcctttgcctctattttagtgtcgtaagtcctatagatgggaagtccatggagactataacaaatgtgaagatattccatggatcagaatataaagcaaatggaaaagtaatcagatggacagaggtaaggaaatgaaacttggcatacttgacccactttgagcacaactttttgctaggccaagagccacattctgggttgactttgtaggataagaaaaaaatatctctgagaaaaatctttctcgtttatactacaattcctatctgaaatcaccaggaagaaatgctgccagttgcagcctgcacctgtctgatgtatcctccttcctgtgaactaacttttagatatttctttgcattggaactccagaagagtagatctctgagtggtacattccatctttgctgtattcttcagaaagctgggtcagttattctgtacttataaactattttagataacatgacggtctttaaaaaatacttatttcactaataagaaaactaggccaggcacagtggcttacacctgtaatcccagcattttgggaggctgaggtgggtggatcacttgaggtcaggaattcaagaccagcctgggtaacatggtgaaaccccatacccactaaaaatacaaaaattagccgaggcatggtggtgcacacctgtagtcccagctgcctgagaggctgaggcatgggaatcacttgaacccgggaggcagaggttacagtgagccgagatcacgccactgcactccatccagcctaggcaacagagcaagactccgtctcaaaaaaaaaaaacaaaaaaaaaaaaaactaggccgggtgtggtggctcacgcctgtaatcccagcactttgggggagaccaaggtgagcagatcacctgaggtctggagtttgagaccagccctaccaacatggagaaaccccgtctctactaaaaatacaaaattagccgggcatggtggtgcatgcctgtaatcccagctactcaggaggctgaggtgggagaatcgcttgaacctgggtggtggaggttgtggtgagccgagattgtgccattgcacgccagcctgggcaacaagagcgaaactccgtctccaaaaacaaacaaacaaaactaaagctcagagactaattaacttgctcaagattacaaggcaaataaataatgataaaatcctgattaaaacccagatctggccaactcctaagctctttcccactgtattaatttgctccttaacttgaaagctgtattagaggctcacctgggaatgagaggagcagggcagtgacccttttttgtatgtacatgtcatatagatcagaaagtttattctcttcatccccaagaggtctgagaaaaaataaaatacgaaaaaaattttaaaagttctcgtaagctggtagatcttagatccctttattacttttgaacctcatgtatgctcatttgtaaaggattaaattataagatctctaggattcttttcagctttgaaactcttatgtttttttaaaaaaattctacgacttctggcttttccatttcacacaaaaggaaacagagacccagggttgttaaatctcttactcaaattcatatggctagttcctgatagcagagatgagacctggttctccagttctgagcagtagtcctaagggactcatcctgcataacaggctccatgatttcatatgcagccaagggattttagttgcttgctatgtaatgattcgtccctttgacacattttgagcagtgcagagtctggaacgtgtaaaacactttatggcttataaagcagtttgacctctgttccctcctttttgctccccagtagcagtgaggtaggcaagctacccatcctaagatgcagatgagaagacaggctcaaacaggtcatgtgactgtaactttgtgactgatgttggttaatggcagagcaggggccagcgctcaggtctcctgactcccactctgtcatttcatgccaccactctccagtgcatccaggtacggggcttcggagctgcctcctttgtagtcctctcagtgtaagttccttatggagcagtaagctaggggttgctatatagaaacatcgtgtatttgcatttctgtgtcttttatattttgcctttttttttttttttttgagacagagtctcgctctgtcgcccagacggcagtgcagtggcgcaatctcggctcactgcaagctccgcctcccgggtacacaccattctcctgcctcagcctcctgagtagctgggattacaggcgcccgctaccacgcccgactaatttttttttttgtatttttagtagagatgaggtttcaccgtgttagccaggatggtctcgatctcctgacctcgcaatccgcccgtcttggcctcccaaagtgccttttttttttttttgagacggagtctcgctcttgtcacccaggctggattgcaatggtgcaatctcggctgactgcaacctctgcctcctgggttcaggcgattctcctgcctcagctttctgagtagctgggactacaggcatgtgccactacacccagctaacttttgtatttttagtagacagggtttcaccatgttggccaggctggtctcaaactcctgaccttgtgatctgcccgcctcggcctcccaaagtactgggattacaggtgtgagccaccgcacccggccttatattttgcctttatatagttttatctttacaataaccagagaagtcaggtgctttccactttacagaggcaaattaatttttttttttttgagacggagtctcactctgtcacccaggctggagtgcagtggtgtgatcttggctcactgcaagctccacctcccaggtccacgccattctcctgcctcagcctcctgagcagctgggaccataggcacctgccaccacgcccggctaattttttttgttttttgttttttgtatttttagtagaaacggggtttcaccgtgttagccaggatgatcttgatctcatgaccttgtgatccaccctccttggcctcccaaagtgctgggattacaggcatgagccaccgtgcccggccgagacaaattaattattaagaagtcctcagcctggccagcatggtgaaaccccatctctactaaaaatacaaaaattagtctggcttggtggcaggctcctgtaatcctagctacttgggaagctgaggcaggagaatcgcttgaacctgggaggtggaggctgcagtgagccgagatcgtgccattgcactccagcctgggcaatagagcgagactccatctcaaaaaaaaagaaaaaaagaagtcctttgggccgggtgcggtggctcacacctgtaatcgtagcactttgggaggctgaggcaggaggatcacctaaggtcaggagttcaaggccaacctggccaacatggtgaaaccccgtctctactaaaaatataaaaattagccaggtgtggtggtgcacacttgtagtcccagttacttgggaggctaaggcaagagaattgctggaacccaggaggtggaggttgcactgaactgagatcgcaccaccgcactccagcctgggcggtgggcaacagagttgagactccatctcaaaaaaaaaataaagtaagtcctttgggccaggtgcggtggttcatgcctgtaatcccagctctttgggaggccgaggtggacagatcacctgaggtcaggagttcaagaccagcctggccaacatggtgaaaccccatctctactaaaaatacaaaaattagccaggcatggcggcacatgcctgtaatcccagctactcaggaggctgaagcaggagaatcacttgaacctaagaggcaaaggttgcagtgggcagaggtcatgccactgcactccagcctggtgacagagtgagactttgtttccaaaaaaaaaaaaaaaaagtcctttaacttcctttagtcctctaacggacttgctcatgacccttcctctatggtgctaggacttaggtcatcagttccaagtgtgttccacttctgcctgtgcacagtgctgacacagttcccgcctctatagtggcagggctgtgtggtggaaaaagctctgcaataaaaggctcagatgccaggctcagcctggctcttcctctgtctcttaaattcttctgtgcccttgagccagtcaattcccttctaagactaattgtaaaataaagcagctgggtcacgtcagctataagagccattctcttagacttaagatcattttctaggtaaattgtccacatacagggattaccttttagtggcatacaatgcaaaatggaggccttttctagttctgagaagaatgtgccattgcaaccatggaggcttgcagggagttaggcaggctgctgctgtcattttgtggatgcagagatggagagacagggattgttttttttttaggtggaagacaaatgcccaacttttcctggaccagggactttatggtgtcctgttcctgtcatgtcttcttgcacatcttggagaatcagggtgctcatatacagtgagctaatctacttctcccaaaatctaggcacaagtttaaaagtctcttttgtttggggaacaggtgtttttcctagaaaacgatgaccagcacaattgcctcagtgatcctgcagatcacagtagattgactgagcatgttgccaaagctttttgccttgctctctgtcctcacctgaaacttctgaaggaagatggaatgaccaaactgggactacgtgtgacacttgactcagatcaggtatgatgtgtcttccgcagcttttaaagctggccttgggcaacgtctgtatttctgacgtgagtttttctgcatcaccccagagagcttaattctccgaccttctggcctgactggatatagtgtttttggccctctctttaatagtactatacccacatgtgatgcttggtcagattctctcagaaccatttgaactgtggcttcttcacctgcatgccttccaaggagctggtttccttcttagtgtggggtaaagaggggagcatgtggtaggacctgccaggtcctgccttgatgtttacaaattgccagacctctctgttccctcaaccctttagctccgagtcacttggaacttgggtgtaggctcagcttgatcccccttccccactgagtgagtgttaattctgcccagcaagctgcttctggcctgagtgcttatgaggagaaactggttcctgatcacagggttgtgccattatcagggaatgatgaaaggttctgtgtctggccccagttcctgactagtcatcaatcaacaaatatttattttctgcttaacggcttgcccaatgctatactaatgaagtattctggtcctatctcacataaaacaaagaacaagcatttttctgctaaatatgtgagcctcttgagggcagggccctgttacattcatctttggatccctgcatttgtagttgctcagaatggtgcatggatgaacagatggatgcaagaacaaatattcagttcctactaggttagggagctgtacattgtgtatttctcattttaattttcacaaccaaagattaaggtattatttctgatactccatacctttttacacacctctacccttccccagaaaactaagaccataacaggttaagtggcttacccagtgcctcatggttgtcaagtggtcaggaggagtaaacaacaggataagtgatcacccagaaaagaggataaatttgtattcactgccatatgtttagcctatggccaaaaaggacatctcctttcctgctcagcctccttgccctcagccctggagaggccttctctgttcagtaacctctcctccttttctctctgtggtataggttggctatcaagcagggagcaatggccagccccttccctcgcagtacatgaatgatctggacagcgccttggtgccggtgatccatggaggggcctgccagcttagtgagggccccgttgtcatggaactcatcttttatattctggaaaacatcgtataaacagagaagacttcatttttttctgttcagacttgttgcaacagcagtcatacccaaatcatttgcactttaaaactggaagattaagcttttgttaacactattaatggggtggggaatagggtgggagtgggggtttgggagacgggtgggaaagggtggttggggggaccgatgttccataattctaagtcttctatgcattgtccaccaagaagatctgggcagcttctgttcctgcacaacagttatgctatccttgcagctaatccccttctgttactgtttagacaagaattccgctcctctctcaagatttacttatggtcatgtgctcagaaatgctcaaatgggtacaaccatcaccaagggtgggatgggagggcagaggggaaataaaatataaagcatcagttcttgcactctttgtacagaattggtataaaaaggataattccacactgatcttgtcccagttacatcacagctgtttatcaagtagaagtcacacttagatttttgtttttaccagattattcattgaagtgaatcgaagactcaagggcttaatctactcttccagtttcggaagggcaactcagtgtaaatgtcatgtggagagcagaggtgagttcaggattgctggagatctgcccgtgtggatggcaggtattcaactgggtatttctgtgaatgctgatggaatacacccaggacatttttagttataaatactggaggaatttaaaaatacattttattgagaaataatttaaacttctaggaagttgaaagtacaaaaaaccccacgcacactttacccagattcccctcttgttcacttattaacattttgtcccatttgatttgtcagggtttctctctccctttctccttctccataaaaaattgaggcatttgagagtaaattgcgtacatcataggcctttcctcctaaatgcttatttcctaaaaataaggatattctcttacacaactgtaggacagttctctacttcagtcaaacatggatttgatactttaacctggcatctgcccagtgatgttctttgtagcattttttccctccagtaaaccttccagtatagaatcagacatggctatggctgtcatgactcatcttgatcttttatgtcattgatatgtattttttttgagacggagtctcgctctgtcacccaggctggagtgcagtggtgcaatctcggctcactgcaatctccgcctcccaggttgaagcgattctcctgcttcagcctccggagtagctgggattacagacgcccgccaccacccccagataatttttttgtatttttagtagagacagggtttcaccatgttggccaggcctgagctcaagtgatccgccatcctctgcctcccaactcctgatctcaagtgatccgccatcctctgcctcccaaactgctaggattacaggtgtgagccaccgcactcagcctcattgatatttttggtgaatgtagccacccccaaccccaccctgtttttttttttttaacagaaaacaactcagtttgatatttcctcatatttagaatcagtttatgtgtttttgcccataatgacttgatatccatctgccccctcattgatagtggtaaattttgatcacttggtcaaggtgtccaacttctctgtatatccccctacctggaacttataaccagtatatgtagactttcagaccatgcaaatctcttgcctatgaaagtgtcccgttaaattagcatgcattgatgtttcttacctgcactgatcttttactatgtttgcaaaatgattttccaattctagcgcattctccagctttacaggttgcacttggtaatctactataagcagaagcccttccttcccaatttattcatttaattttcattatacactcatggactgttgttttgctttgttttgttttgaaacagtgtctcactctgtcacccatgctggagtgcagtggcacaatcttagctcactgcagcctcaaacttctgggctcaagcaaaccccccaccttggcctcccaaagtgctgggattacaggcatgagccaccaagcctggcctttttcagtggttccaattcattattttggtgcacaaatggtctcagctttagctagacaagagacccttcaagctggctcctacatcctggtgatatgctattttttttttttttttttttgagtacttcttttttatttctatcctaacaagatgcttcaggcttatcttgtgcttatcctgccctagccctggaatcagctatttctgcaaggagccctggcttcttttaatgggagtggtattagaaaccaaaatctggtttatccatgatatgtgtgatgcactctgaccttttt

SEQ ID NO: 15814 - DNA, 134242 bp, Human; identical to SEQ ID NO: 15813
  misc_feature (1)...(134242): n = A,T,C or G

SEQ ID NO: 15815 - DNA, 134242 bp, Human; identical to SEQ ID NO: 15813
  misc_feature (1)...(134242): n = A,T,C or G

SEQ ID NO: 15816 - DNA, 84839 bp, Human
tgttgtttaagctgcccagtctatggcatttgttatggcagcctgagctaaggcagctgggaagaggtgaacagtatgcttgctaggccgtagaagccaattgtagcacacccttcctgggagaagagtaagtagttccctaaatcctgagcataggcatccagggagtgaaggacacaagtgatgcagaaaaattagatggggcaggagtataaaagggcttggacgacttgctaaataacttgggacctcatttaactaaattccctcattaaagaccctatcttcaaatacagtcacattctgaggtcccggggtgggggtggggagtggcggttaggactccagcatatgaattttggggaggggacacaattcggcccttaatagctccagttgtgccaccctgagttgttttcctgaaccccgcccacgtctttgtaaataataactctcaacttccccttttgagtggaccattttttcctgtccaaattctgatataggaagggtctccaaaatagctgcaaagggaacctcagtctcaaaagttgggatccactatatatctgcttttactttcaagcattgaaactaatgtcaatcaactgcctttctattcttaatattttatccaagaaatcgctagaattctttctcctttaaaaaaaaaaaaaagcaagttacaagccgggcgtggtggctcacacctgtaatcccagaactctaggaggccgaggcgggtggatcacctgaggtcaggagttcgcggacagcttggctaacatgacgaaaccccgtctctactaaaaacacaaaaattagctgggcatggtggcaggcgcctgtaatcccagctacccggcaggctgaggcaggagaatcgcttgaacctgggaggaggaggttgcagtgagcccacatcgtgccattgtactccatcctgggcgacaagagcaaaactccgtctcaaaaacaaaaacaaaaacaaaacaaacaaaaaaacccactaccaccaacaaaaacaagttacattgtgggttggggccgctgacaggaggaataagatgatgttatggagcatttcctagtcccctttccgaccccatttccctattgtccgacttcaggcttccaagtgaggacagcacttcccaggcagtgacccgcagtcactgccctcccagaggacgtcctgcctcgcggccctggaaagtccaccttctcctagcaccgatcctgagctgagaagctctgtctggtacagccatcctgcatcgtgggctgcttctttccccaggcgaagctcaacttcctcccattgttctgaacctctgtgtggacatcttctttcttcaaacgcaccacggtaaaattctcgcctgcctcgaaaccccgcctacctctgagatctgaggacggatactaaacgctggacttaaggcaatgtacacatgtaagcaggctctgtaggcactcactccgcccaggtgcgcgcgtggcggagggggaacagagaagcaggacagctctgcatccttcccgtgttcagtcgtgggagacaacaagagaggtcacagcctggcgaccaaaaagtgcggctaacttccctgcccaagctgactttctctgcagggttcaaggttaattgtgaggatttacattcgcatggcacacccgcatccccctctacgtggaaatatgtcttaactttcataactgccttgccagcagggtatttttcgctaggggcgaagcgtccttcgcaagccacccagctgaccggcagcggagacagctttctcgccctgctcgcacgcaagtagaaaggcgctgctgagcccgtccctccaaaccacgtggtcttgcccgtgcttaaaaacaaacgctgagccaggcgcatgcgccacgggcctccccgcaccagcagaagtcggagtcgctgttgggggcggtgtctatggttgagctgagggcgcaggcgccacggcccgtcgagctgggttccaaggcggctggcggcggtagcgtctctgtttccttgtgggcgctcgcgcggccctgggtgagtgttcgggggtcccggccgaatgtcgggcagggggtgtcggggcccagctcaggcttctcgggcggccgcggccccgcgccttggcctcgccgtggtgattgagcctgtcagcgaggacgcactgtagcgggtcttagggccaagcgcccgcttccggcggcctcacctgagaccggaagtagcgccaaggagcgctcacctgaggcggcttgagtccctggccggccagcgacccagctacttctccgactttgtataaggccccctgcgcgcagggtcagctgggtcctttttgatctcgattaaaatgctggagctgttattttaaagagagtcgggctagatgtacgtccgacgttttgggcgttgatagagtcaaattgataagagtgtgggcggatgaggcaggccgcctgtaaatgctgctgttacgtgacttccacgcagcgtcttaactgctgtcatcctgtgacaggcagccctcgcttttctcctcaacttttcccatcatcttcttgttgctttgtctcctccaatccattatccgcacagttgtccaggtggtctctggcataaagtaggtcatgccatcatcagcctacttaacagttttcagagtcattccattgcactgggagtggaatccatgctcgtgttttcccaggccttgtgtgatttggcccttgcctgtcccctctcagaactgtgcctgtgtccgaccaaccctccaaatgagacccagcttgcccctggctgcgggagccccagtgatgggggaggacggtgaagatactagtgtcccagatgattaagccttagaagatactctgcaagacttaggccatgaacggagcccttctctgctcttcttaactcaaagttaaaaataaagtcaaaaattcggtgttccagccttcttgcattttcacaagtgcatcagctctttctagtcttaaaagttacgcacgttgttgggaggccgaggtgggtggatcacccgaggtcaggagttcgagaccagccttaccaacgtggtgaaaccctgtctttactaaatacgaaaaattagccgggcatgatggcatatgcctgtaatcccagctaatcgggaggccaaggcaggagaatcgcttgaacccggaaggcggaggttgcagtgagcctggcggagcctggcggaggttgcactccagcctgggcaaccggagcgaaattccgtctcaaaaaaaaaaaaaatttcacacgttgtttccttgcaagacgttcactttactttcgacctgactgacttatcagatgtcactttatcagagaggcctccttgaccccacatctacctccacaatttcaatttggtttctctcattttgtcagaaagccttgtactttcctcttaacagcagtcaccacaattatatttgtgtgtgtgtgtgtgtgtgtgtgtgtatgtgtatatatatatatatagtttttaaatgtctgtttttcccatgagactctaagctctttggggacaggaattagttaacctagtacattgcctggtgtaattaactctcagtaactatttgttaaatgtatgatttctttctttctttttttttttttttttgagacggagtcttgccctgtcgcccaggctggagtgcagtggtgcgatctcgctcactgcggcctccgcctcctgggttcaagcgattctcctgccccagcctctcgagtagctgggattacaggcgcgcgcctccatgcccagctaatttttgcatttttagtagagacggggtttcactatgttggtcaggctggtctcgaacttctgacctcgtgatcctcccgcctcggcctcccaaagtgctgggattacaggcatgagccaccgctcccggcaaatgtatgatttatttcacttctgaaattctttaacctgataagagccttctggtttccaactctcacttccagaagacttggttttctggccattgccagatactaagtgacttcttgaaccctttctcccatttccaggccccttctgtttttttgtttgtttgtttttgtttttttaaacctacccagcttggaccctgaagtcagttgcttcagctactcttctcagcatcttcaaccccgtgactcttttgcgctaccatttctgctctgaaaaccctcaatagtgacatttcccccaggactactgaaggaggagattgttcagccctggagattgttagcagtctatggctttgcagggctggggagatcctcaggtaggtcctccacagcaatcatcagtgtttgttccctgtcaactcccttttctcttgtacaggacatttattccagactcttagtctttagccccagtgccaactttgtctcctgactcaggaactgcccaacttgctgctttgtgggatattttgtctgtaatccacttcagcttccctcctttccacctgcaaatttagatctatcaggaatcctccttctgccagagtccgagaaagatgtgttgtgcctcctgttcatttctgcttgcgaccttccacttttgctgtctcttttggtacacctttctgggttatctcctctgtctccctccagccattacgtgctctagtttttcttgccctagttctctccctacccccaacaaatccattattactttatcactgtagctgtctccctgccagaggcaagctctttaaaggacaggccactctcttgtggcctccatttcctcatccactccttacacaccaactacatttcaaccactacagtctggtttttggccctatcgctccactgaaacttttttattttttcgagacagagtttcactcttgttgcccaggctggagttctgcggtgtgatctcagctcactgcaacctctgcctcctgggttcaagcgattctcgtgcctcagcctcccgagtagctgggattacaggcatgcaccaccacgcctggctaatttttgtattttagtagagatggggtttcaccatgttgggtcaggctggtcacgaactcaggtgatccacccgccttggcctcccaaagtgctgggattacaggtgtgagccaccaagcctggcctgaaacttcttttaccaaggtaaatggtgacccattggtatccaaattcactcagccttttctcattcactggacgctcttcctccttttttattattagaagttttccccaaacttctttatttttaaccttgtctttacactacaatactattgctttttgatattattttacagaaatagaaaaatggttacttaatatttttggttgaattggcatccttttttcttaaaaagaaatcctcatgtgtgtacaaataagaaaaatgaaaacagaattgttaactgccagctagtacagacactctgagctggaatcctgctctctctgttggaaagtgaggtgagctgagccttcctcttgaaaataatcagcaggccccaaaagaaggaactttctcactgtgttgttcactttttaacctttccaatgttagcctcctcgtaccctccaaaatgaccttaggtacctgtcagagccttgggaaccctggaactgctcactctgctgatgtgtccacatgtcacccagactttcccttgagctcagatttgcatttctgactgcatgctgcaaatggtactgattacatgtaagctgcttgccagtcctgcttcctatctgcttcctttttgagagtctcatttttgtgactgaattcactggtgactcatttgtccagaccaaactttttattattttagacttagctctgaacctcacttcctttcagcagatattgagcacctcctatatatcagaccatgcatggcccatgtgttcaaatctcagttcctctgtgatatttcttgggccccagacaccatatatagttcgctcgatgctcgtgtgacctcttgtccgtgtcccgggctagctgacctgccctgctctgttgttaactgacatgctgctgctccagtggatagccactcgggtgtagatgatgctgaattctttgtatcccggtgctttattgctgggcttattttacttaataagggatgagtggggcccactgggggaacttgtcatttaacagaaaagttacagtgctcaaagaaatcttattcacagttaaacaaaaagcaagactgatttttggttatcgttttgctttttaatatatttattagatgtgatagttgtataggtaatatagtgaatatattctccttaaagcagcaggtcctgagtatgtggagtacaatgtgaacattcccccttatttttccctgtgctttctcttccccatcctgatttgcaggcttagtttgtatcctgccagatcattctgtgtgcaggatagatacttttttcagcataagtgtgttcataccatgaattttttcacttaacatggcttttatatcagtatacagaatatacttagtagttacattaaactattaaaaatgtgctgcactaaacattcttgcacctgtgtgtgactagttctctggaataaatacctagaattgcttgacaaaggtcatgtgcctttaatttaatagatattgctaagttgtccctacaaggggctttactaatttatattctcagcagcactatgtgaggggggatccttctccttgtctgtattggatttatctatcaggctttgaattcttgctaacctgatgggtgagaaattatactgtgtattaaaatggagttttttttttgtttttttttttttttttttttgagattgagtctcactctgttgcctatgctggaatgcagtggtgagatctcatctcactgcaacctccgcctcctgggttcaagtgattctcctgcttcagcctcccgagtggctgggattacaggtgctcaccatcatacccagccaattattgtatttttagtagagatcgggtttcaccatgtttgccaggctggtctcaaacacctgaccttaagtaatctgcccgcttcagcctcccaaagtgttgggattacagatgtgagccatcgtgcccagcctatttttgagaatattttaattaatcttttaaaaaaactttaaatttattttacaaggtcttgctcttttgcccaggctagagtgcagttgtgcaatcatggctcactgcagcctccatctcccaggctcaagtgatcctcctgcctcagccccttgagtaactgggactataggtgcacatcaccaggcctggctaaggttttaaatttttagtagagacaaggtctcattatctttcccaggctggtctcgaagtcctgagctcgctgtgtttccctggctggtctctatcctcccgctttggcctcccaaagtgctgggattacaggactgagccacgtgcctggcctaattaatcttctgagcttctgatttgttcaaagctcctatttactggataggtattcagcctaggagtttctagtctcagattcacacagaagctctttcctaacatcgctgttcctatgcattacagttgatcttgccactatattataaatcatttgtgtcataatgaaatgaagatgctaacttggaaaacagcagccaaatgacttcagctgttttgaagaatattccatggccatcaccccaggattttggtggctggctttcttagctggctgcctaaatgtcctttgttgatgatactgcatttctttttctggttaatttttcttatttattatcagaactcaagaagatacgttgtccctttttagtaaattaatacttggaaacttgaatttatgtagttggaagattattacttgatcttttgagaaatcagtctgctctaattataaaatatttaagaactacaatgaatcctatataacgaaaaggcttataaatttttttccttttaggtagtctgtagagaatgccaaatgagggaatcccccactcaagtcaaactcaggagcaagactgtttacagagtcaacctgtcagtaataatgaagaaatggcaatcaagcaagaaagtggtggtgatggggaggtggaggagtacctctcctttcgttctgtgggtgacgggctgtccacctctgctgtggggtgcgcatcagcagctccgaggagagggccagccctgctgcacatcgaccgacatcagatccaggcagtagagcctagcgcccaggcccttgagctgcagggtttgggtgtggacgtctatgaccaggacgtgctggaacagggagtgcttcagcaggtggacaatgccatccatgaggccagccgtgcctcccagctcgttgacgtggagaaggagtatcggtcggtcctggatgacctcacgtgagtgcagcccatcttcttcctttcaaagtggtggtaaaacatgacagggatattcaggtaatggaaagctctagtattccagaagtttaggagatgtgtagaaccttttatttggaggacagagtcaataagggcagtcctcaacctcatctttgagtcccagcccttccccttaggagtggcattgtacatggtagttagagtctctgtccagctcgtgaaagccagttgcatgcataatgtccagaagagaagggctgttcaccagcatgtgcacaaagtgatctcaggagaggtgcacctaaattcaggtgtttcctattcgagatgccaggaatacattgcgcccccttcacatttttctctgtgcggtagcttctttctagcttactgtccccaaacttagtgttcagtccttgggcaatttttcagatttgcatttttagaaataataaagactccccggttttcttttcttccatccttgttctgactctggaaatggagattttatttgtgtcttagagagggagaagacttgagctgttttgagcatagcacgttaatggggaagaaggggaggctgtagacctgagcaagggtaggaggtgaggacaggagaggggaagtgggaggggttgagctcacttatcattgctgcttggcccccgttgggcagtgttctgggcagtgtcaggtaagcaagaaagaaggcgagggctgaacgggatggaggatggagcagtgtcacagaggatagctggggagggtggagtgtggcgctgtcatgaatgtggttgttggtacttcaaagacatgttttctgctaaccattccctggtgtgttcttttggcctcctcaggagcaggtgctcgttcatggttatagtctgagtgttgaggacctcaactctttgtaatgatacttttacatttgatcttggaaatgtgtcctctttctccagaggtgacagaggagagttgtggggtctccatgcagagtgatgctagatggctggtggcatgtggtgtctcagccagtaatacgcattgtttatcctgtaatccacagaggatacaaacagcaaattacacaatcatcaagaagattgaatttgtgttttgaaaattggaagctacaattctatggtgtctattttaggagtaatttattttaaattgatttgttttctttgcaccacaaagtttagtgctgtagtaagtgaatcttccatttatgtagaagaaaaatattgtcgcagatgtgtgatttatataaaaaaatgtttaagcatatttaggatgcttccagactttggaaggcttccgtaacgggcttaaaaaacccatgtatgcattttttcatgtaaaaggacaacttattgcacattgttctagcatagtgtgttgaataaagtaggcacttaaataatgcttgtagaatgactgaagcagcttacaaatgggaacgagctgatctaaatcagctagataaaagaaaacactagcagtcatcttaaacctctaatgatcctacaagttttatttgtggccaataagggtatgtattctggtttagtttcctttatcttttagttaataagaagtaaaagggacatgtttttagcatttttctctttatattatgctataaaaatgttatcagagtgcaaaatagacaatttatcttatttttcaggtcatgtacgacatccctaaggcaaatcaataaaattattgaacagcttagccctcaagctgccaccagcagagacatcaacaggaaactagattctgtaaaacgacagaagtataataaggtgattcagaataacattcagtattgcatttttgaaaaagtcatcatttaggggcacttaatttaggaagtattttaaaaagtgcttataagatgtgaagcaaatacttataattacaatagagaaattttgggtttcttttgtatgtttaatctttctgctgttttcctttaacatcccattctattgcatttaaaaaaacacacatacatagacacacacatccatacgtatacagttgctccttgatttacaacagggttacatcccgacaaacccatcgtaaattgaaaatattgttagtcaaaaatgcattaaatacactgaaaaacctatcttaaagtcaaaatattgtaagtcaaaccatagttaagtccagaggctcctcagtttataatggggttatgccctgataaacccatcacaaagttgaaaaattgcaagtcagaccatgataagttggagaccatctgtgtatttgagaaaagttcctttttggtgttgcttgcctcacttgggcgcacttccttagttttcctgcatcaccatttctttggcctggcttagggtcacactggcctcagtctcctggtctcctgtgaactcttttctgcttagcccttgcttcctctaattgtctccactctgtttcttggtggtgcagccattgaccctcacacacctttgctgacagttgcgagagcttggcccttcctcccaccttgggtgttacagtcagcacccagccacactggggttgtacttagctttggaaaacttaagggtagggaatatttgttacttaggatattatttttatgaagtttgaaactttttttaaggatttatgtacagctttgtgaggtctgaaacattttttatgatttatgtacccctttgtgaaaatacattgcaatagataggaatgactagctgtaaccatttcagttctgccatcccaacttgtgcttacagttgattcactgcagtgagtagagtccttgcatcttttctttaagctctccaggggcagggctgtgcgttggttcagttcacgtggccctccttttattatactttccactcaccagtctgttacctgcactaccccatcttctctcacttgcttccagaatagcagcccaaaggtcaaagctagcagttgcccaaggcaggtgggtcctcccaaatcagagagaggacatctggtctcttgtgggagcatgtgaaattgatgtgcagagaccttcttgggcttctagtgggctggaatttcaagggtgtagagcatcaaacttgagaccacttcaggtcctagtctaacttaattatgcattcttgtctttagcagctctttgatggttagaggtagactattcagagggaaagtgctttagacagaatgttgctgagagaaaaactgagaaaaaacaaattgcaagtcattgcagtgtggcatttatgttcaggatttccccttgtcccacactcgtatttgaagttgaaacattcttgaccttggaaagatgaaccaggtaccacaagcccagttcattgggcctccccagtgaagcccaagggcacatatctgagttctggtgatgtggaagggaacaagacaaagaggagtctggcgtggccagggtggagaggcatggcaagatatatttttttcttaaagctttttgattaggtagaatactaaaaggacagtcataaatatagtaggttatcaaaggagactaactttttcaattgaacatttgtgtttttatttcttatcttatggcctgttgacttccatagcccattggttctgaatcagaaatacagagtagtttagggatttgcccagtgtgtaagggggaaaccaagtagaacaagtccacctttcaggtcagtgcccatgtatttaagggctcgggcacatagaaggcagtctgccgtcctcaggagagcatgggggtgcaggcatgcctgtctgctgggaatattcacggcccctttactcctagaaaagtggtagttgctcacatagggctctctagtaatagtaatgtatggaatttttatgtaatgtatattatttttattttactttggatttaagtttaaaatttcataatgctatcttttgtatttaacaataaatcacttcattgctgttttctgtcttctatatttaccattcaaggaacaacagctaaaaaagatcactgcaaaacaaaagcatctccaggccatccttggaggagcagaggtgaaaattgaactagatcacgccagtctggaggaggatgcaggtgaggatgctaggagcagtttctctgtgttcttgaattgatgcctgatgcctgtagtcagtggagggtgtctctttagtctttgcctgggttttgagaaaaatacgtttctttgccttagtgtcaaaacagatttaggaaaattttattctctacacctgcagaaccaaatccctctcaaagagaattaaagtaaacttttaactcagttcataggaggctgctggtacacatttattattacatttaatacactggaaatcttaaacattcttattttgttaatttgataaagacaactagcatcatgattaaattacatgttggaagcccaacatcattaatcgcatttgtagaatggctctcacgtgtctttaaagagcgtatttggcaggctttccaagcatcagtttaagaaaagacatcttcattcaggtactctgggcagtatttcatttacattactgtcttggatggttgtcttttggaaaactttttgggaaaattcgtaagctctggaactaaattatctttgcagtcattgtgtgtgtgtatgtgtgtgtgtgtgtacaaattgttggtggctgcataggcattgactatttgaaatacagattaaagctgcttagcattaaattctctaagcaactattttctactagctttagaagtttattcagtaagatgagaattgttatgaagaattaattgaagcaatagaaaaaaatatgtatatttttgaaacagagtttcgttcttgttgcccaagtttggagtgcaatggcaccatctcagctcactgcaacctctgcctcccgggttcaagctattctcctgcctcagcctcccaagtagctggattacaggcgcataccaccatgcccagctaattttttgtatttttagtagaaacagggtttcaccatgttagccaagctggtctcgaactcctgacgtcaggtgatctgctcaccttggcctcccaaagtactgggattacaggtgtgagccactgcacccagcccaaaagtacgtggttttaaagttcagcctctcagaattcattaggcctatgaccagtgcttttaactgctgtgtactatgtttctcattgataacagatgtttgttcctgtctggccgtctcagatctgctgttgtctttcacctcctactgtgactttggtagtagggttaatagctacctcttagggttaatagctaaaactttggtagtagggttaatagctacattgtctagggttaatagctacctcctcaaatccaagagcccctttttatccttgttccactctgcctgtccacagcagctgacacttctgttccttgtgggatccctgcttctctactggttttctttttagccctctgactacttctgcatagttatttctggccatatcttaaatattgatgtttctcaggatttctttgagccctcttcttgttctactgcctctccctggttatctattccccatggcttttgcagccacctaggttctactagtaccttatacagatctgtagacatctggctttgctctttttttgagttcctggttcctattatatctctctgtctggacaccagccaacacttgaagacatgaactgaaattggaagttacaccataactgtaaagtcacccagaaagtatccctctttcattagttgaaattcatctccggcaaaattaccacataaccaaaataccaaaagacctaaggcttaataggaagcaaaatactcagtgtaaagacctaaggcttaattgaggcaaaatactcagtgtaaaggaaaagatttgttaaatggactatatataaaaccaagaacttctgttcatcagaagatagcatttagggcaagatactgagctggggaagatatttgcaatacatgtgtgaatcaaaggactcaaatctaggatgtataaagaactagaaatcatttaaagaaacagacaaacaaaaatgggcgaaagactggaacacttcctacacaaaaaaggctgtccaaaagataaattcatgaaaggcacctattttgttagtcatcagggaaatgtaaattatagccataatgtggtaccactacacatctaccaaaatagctaacatggaatggcaagaatatacaccagttggaactttctgacacagttgatggggactttggaacgtaacactttggaaaactgacagtgtctactaaagcttagcatacccagatatatatatatatatatatatatatatatatatatatatatataaaaatatataaatatataaatatataaatataaataaaaccaaaagatgtgcatcagaatattcatagcaacattattcctagtagccaaaacctggaagccactcaaatgtgcattaacagtgagagttaacaaactacagctacattcaacagtaaggatgcagctcaaaagcataatgttgggtgaaggaaggtggacacagggcacaaacatttccacttacgtagcgttcagagacaggcacaacttgtctgtacgttaggagtccaggtccatcattatcttggggggcgtagaggctgggaggtagcctgaagggctcatctggtggtgctagtaattctgttagttgatatggctgctagtttatgagtacattttttctgaatattcactgagttctacacttaatgatttgtgcactttcagatgtatgttttatttcagtgcaagtttaatgaaaaactgggtatcattggcctgcaagaattgtagattttagaatatggattccttcctattaagccttaggtcttttggtattttggttatgtggtaattttgccagagatgaatttcaactaatgaaagagggatactttctggtgactttacacttatggtgtaatgtcttcaagtcagttaacttcacatatctaacacagtgctgctgtccaatagacctttttgcagtgatgaaaatgttctctgtgttgcccattatagtagccattagtcacgtgtagctcttgagcacttgaaaaagggcaaatgcaactgtggaactgagtttttaacttaatgtaatttaaatttaaatagctgcaggtgactggtaactgccatgctgggcagcatagagctgacatttatgtttttcctttttaggtacatggtgatccctgtttttggttttactgtctcttgaatttaagtccatctgaatgttggttttagcaatgacgtgagaacttcggagcttgcttcctcatggacgactactcagctgataaggaaacacagctaaacttgactatttataactgtatttatacagtaataagcctatctttggatggcagagagtatatttatagtgaaatattttggggaaaagttactgagaagttgtctttttgaacaggaatatattaaatatagcatgatgctataattttattctgtccttcatatgtaacatgctttagtacatggatgattctttttttatatgagttatttgtagctgcctaatatttcttgaaagagtgagcatttcttttgtaccctcggaaagtttcatgctagtgcgaaacgcattgctattgttctttcagagccggggccatccagtcttggcagcatgctcatgcctgtccaggagactgcctgggaagagctcatccgcactggccagatgacaccttttggtacccagatccctcagaaacaggagaaaaagcccagaaaaatcatgcttaatgaagcatcaggcttcgaaaagtatttggcagatcaagcaaaactgtcttttgaaaggaagaagcaaggttgtaataaaagagcagctagaaaagctccagccccagtcacgcctccagccccagtgcaaaataaaaacaaaccaaacaagaaagccagagttctgtccaaaaaagaggagcgtttgaaaaagcacatcaagaaactccagaagagggctttgcagttccaggggaaagtgggattgccaaaggcaaggagaccttgggagtcagacatgaggccagaggcagagggagactctgagggtgaagagtctgagtatttccccacagaggaggaggaagaggaggaagatgacgaggtggagggggcagaggcggacctgtctggagatggtactgactatgagctgaagcctctgcccaagggcgggaaacggcagaagaaagtgccagtgcaggagattgatgatgactttttcccaagttctggggaagaagctgaagctgcttctgtaggagaaggaggaggaggaggtcggaaagtgggaagataccgagatgatggagatgaagattattataagcagcggttaaggtcggtctgtggggattataaatacattgtactgtttgctttatcttaggtgacaggtttattaatatgtaagcattctagatccagcttaatatattagacccccccgattatacagaggttggatttctgcagccttaacctgctagaagcagtggggcccctgagtccttaatgatgctggccccaaatgcatgtacttctaggtctttagttggatttggaggcaagtctaagatgaaaaacttaagggaaggctggggcaagaggcatacagagggctgagtgtgagctgtgtcgcctttataccgacagtcaccctagaatgagtatcaggaaaaagaaaagggtgaattaatgcatactggataggggtttctgttttcccttttgaagcaggaaagtaattttagagaacttttcttcaaaaaagagctgaaacttaagctttggcatagaaagaataagcttgcttttgtaaatccttcctttgtcttgagaaaatagtcatctgcataattataagccaccatcatgcaaaaagtgtactttgtatgcacagcatacctttcttttcactgttgttttttatgttagagactgactttggcttttagctccatgacattgtcattgtataaagcaagcaccataaaagggaaggtgaacatgtgaaacatgaagtctgaattgcatattgccacacgttttctgagagccaggaaaaataatctgtattgcaggcctccccatggtggcccactgaacactgtgctactgccgcgcatttcaagtctccttgacttagagctcacttagctctaaggaagtcaaagggaaaaaggaaccttattacttttaaaatacttgatagtgggatggctttttcccaatcctcaacagttttttcttatttctcaaggtgaagagacctagtttgttgtatttattggcctttgtgagtgaaggttgacctggtgttttttcttgttacttagaactgctcattaacccccgtccagacactacagacattccataacctttccaaaatagatgtgtcaattcttttaaacagtaatttgaggacctgtgacttaaatcctgttctttagagttgcggcactcacattctagtagcaccttatgtagtaatgcacagatgagggctggcttatatttgtcatccctcagcacagctttcgtttctgtgcacgtttattacctgtgaagttgtttgaggaatgttgcccagtactcttgaacagtgagcggtgtcagactttttcttaactactgcaaggaattaataaaagtgttaatctcaacatattgattataaatggagcaatatatatttttccaattaaattgggtcaatattaaatatgtttaaaatatatcagtattttgatcaagagcaatttattttgattgaattttaaatgtgggtttagttaatttgatggcaataagtttttcttaataatgttaagattgtaaaacaatttattatttccagagccaatattttgctaaagctacagtgaaatctcaaatgaatttcagaaatatcaataactcttaattgccaccaaaatacgatagctcttaacattttatagctacagttattaaggctgttaaactgcagatatccacattgaaatatttgttattacatctcctttggtgctgtttggtttgggggatgaaagaaaataaaatgctcaggattgagaagcatattagaactgccagtctctctatattttgttactcattgctgatctttgtagactaattgaaatggtaatgctattcccttgagaaacagaaagacctttagggttgcttgtcttagcagtggtttgacgatggatgattagaataaagtcatagagtttacaacatagaaaattagtttttttttagtggttagaatttaggagtagttcccagggtaggcaccctttgctgaacttaacaccttttactgagggtatagcctgttaattataatgctcttttcaactctaggaagtgagagtgggtgacttctggatatctcatcctctttattctctcagcttgagagccatcggcctttcactggcactaggttcaccctaactaggtgcctttgttttagctgatacttactaggaattttccgtcaagccctttccatagcttttttaatggaactgggcagtcgccctttggatcctgctttccttcatttggctcaagccctcagctcagtctttgaagttttaaccatttttcaaaccgtgtattcccccttctcatgtgtttctcctgcctcctcctctgcactgaactgtatctggaggctgactcctcagtgggttccctggttttcataccctttcatgtcatacaggatggatgagccactgcttagaagtaaatgttctgtcggttctatggtcagtggtatacaggtcttgtaaaacatacattattttttcattttactttgtgctaccacggtttccatttgcttatggctgttggttgtgaggtctagtgctttcttaaaatatactactgctttgcacattgtgggcctgggagctccgggtgccaaataaagattaggactaacacaccttcagtgtttgagtgatgtgggttcccggtgagcacctacatgctgcttacctagtacaggctgtgcagccaagacagccctgtgtggcccagaagaccaaacatttcatgtgaacctttccccttcagggtgataaagatcaggtcgcttgtccccagtccttgttacctccatgttattgattcacttcccagttgccatattcgaggtaagcctccatagctttatctttgctttcatgtcaacaatgcatgtctgcatccttggactggcttcaagggtttctggcaaaaaatttgcagtctgttaatagacttgggcacaaataggacctaaccaagtgtgaagggaataatgaattcagactgaggcatttgggagagactgttggggaagttcatccagtgcagggccttgtcttgttgggtggctcagatatattaatatgacccttatccaaattaacaatgttacgcatttgcccctaaactccaggtgcatcattgagaagggaaggaatttgctttgctttggaggcacattatttcctcagggttctcatttggattgccttggaggttggtgtgatgccacaatgtgcagagaggctgaggacagggagggcaggtgggcttcactttccagccagctctgatttctggggagtggtagtctattcagggggctccgaggccctgtttgggtggattgggaagagtgtgcagttccttagtgatgtctatcataggcacagtggggaactagcaacattcatgctaggtatttgccagccttgacataataaaacagatgtcactgactcctgcctctttgtccagcagtggtcagcactgcttggtcaggctgcagggcatagatgggttgcatcctgagtgagaaaatgcatttccagatatgtttttgtctcttcttgctggcaggactagggttagtgtttatcatttgacttaaactcattcccccaagttcttactctattttcatgtatcggcagttactatttaagttgctgccctcgcagactacagtgagggcaacgagcacagactagagcaaagcttccccacccacagactgattatgcagtgtcactgggagcccctaacactggagacgctgacttaggaagtgtagcgtggggtcaccgggcaggacttttaaaaaatgttcccagatggctctgatcactgtcaggtttgggagctagggatggaaataagtcagtcttatgtatttctcttttttggggctgcagcttttggctgatgcagtttgtatatcagtttctcaaaaatcctcttttatgtgccctgcacagttgtatgtacacaggggagggcctggcagggagccttagctaaatgctgtatgtcatagatcatctggttcttgtggggtgtgtgtgtcagaatcacatgggaaacaccttcagagggtaggggcctgggctcagcgtggggagtctgaggcagcaggtgcagagtgggaggagctgggcactgcacttgtgctttggctgagctcccgctgactctgaggggagcttggtgacattcttcatggtccacaggaccttgctcagaaagaactatgttctcatttaggagagctttgaggcagttgggaagcattgttggtaaggatgttgaggcttgagaatgtaatgcttttttctttactatggcccacactcagcaaataattgcctctgggataaatccccgacccatgcccaccccgatcagggaaacatagtggggagttcagaaacggactcttcagtaggcggtgcctgagtctcctcagatgacctggtgcattgggctaagctgctaaatgcatagcctgaagtggatttgagttggttcctctgcatggtttgaaggctccctcgccacctttcagcacttctgatgagtccctatttttattgtaaaagtatgacaacaatattaagatgaaaaaatgacctcttttatgtttttattttctacatgtcattccagtctttggttctgtgaatacacatctttacatggttataatcacggcccctccagttagttggcttgcccacagttttactgtgaagtagagctgagatttgaagtcggctgggccctctacatacatgtttccttccctttgtgggattgagtagaaggtgcaatatttaggtatgaccacagggtggtgccaaaaatcaacacatagctgcccccacctccattggactgaaaaccaaaccaaaaacctaagcctgtaatctgggaatttggatgaggatatagggagatggctcaggagtctagaagacctggcaagtatggtgtggatggggacagaatttacttcatggtctggtgtaacctgaatctgtagacttgatgcctgttgatataattggtttttaataaatttttgatcctaaaggtttttcttgtgccctattttttaccttttttacatgagtaactctgagatgtaaaggggtgataaagattccattcattgtgtaagtcttacagaatgtcttctaatagtctgtgagacataatctcctgcgaagataatactcttcattgtccttcccctgagcactgggcctctgtggccagggccccattgaaccctggcttgggagggttgggttgtgcacatccactgttctgaggagggagctgtcagcatttcagatgctaggggtcaagccaagtagaatgactgttatgaagagagtcttgtggatttggaacgttgcagcctttagggcctgagcaaaggtggcatcaagtggaggtgggggcaggggcgggagtggtgcacaagaacaatgatggctgacatgtttgaatgcgtacgacttagtggttcttgtggttcttcttgttatataggttaattcgtttaatccttacagccacccaggagataggactttgagcccagagagatgaagtcatttgctcaaggcagcagtcagtggaagggcttggagaaggagaaggggtctgaaggtggtgtgggacacatgagagtgatctcgcagcttggtttgctgcagcagactcggacaagcattgtttcagtgcctggtttctccctccacttgatgggggccaactccaacccaatgtcccattcctatcctgaaatgcttctaaaggcagtgccctgagaaccaccaacctcacagcctgtctccattttattgtcttctgggaacttctcccttctgtctagcacctgtttgcactgggattgtcctgtctgtccttcagttggatcctggtttgcacccgatgaggatttagcaattttaggctgtgcttcggcaaaggccaactcacaatgtggaggttgatttgattgtgccttttttttaaagcccaaattaaagagaaaaaacaaaactctcccaaaatctgaatttagtaaaagtttgagattttatccagaaacctaaatacaattattttaagaatgttcttaacatctctgagagttcatttttctcaagaaataagcctggccgggcacaatggctcatacctgtaatcccagcactttaggaggccaaggcaggaggattgcttgagctcaagagttcgagaccagcctgggcaacatggtgaaaccccaaaaatagaaaaagttagctgggtgtggtgatgtgcgcctgtagtcccagctacccaggaggctgaggtgggtggatcactggagcctgagagaaaaaaaaaaaagaaagaagactgtgttcattttcttttaggaatctataagttgaaagaaaaagttacacttttaaaacctatttatgcctagtgttccattattggaacgctaagcatgtgggagttattcatgccctactgctcaaggtcattgccaaggtctgatttttcacacatgtctgcctcctgagggtacatgttatcacttggtgcacagagttagttactgctacagatactggcatgctgggagcttgtcaaaaagtgatgtgagttttcagaaacatttttgagtatccaaagacaggtacatataactttactgcactacatcctatactagtaatttttaagaaataacttctctactagttatgctattgtgcggtaaaaagaaaatacagaaagtattattattgcattagttatgggtttgacatttttcatgttccatttttggaacactaggcaaaaccactaccactaggactaataataccttttttccgttttagtcccaagatgcctcgaacactaagtttacatgaaataactgaccttttagagacagatgacagcatagaagcaagtgctatagtgatacaaccacctgaaaatgctacagcacctgtttctgatgaggaatcaggagatgaagaaggtggaacaataaataatctgccaggttctttgttgcacacagctgcgtatcttattcaagatggctctgatgctgagtctgactcagatgatccctcatacgcacctaaagatgactctcctgatgaagttccatctacgtttactgtgcagcaacctccaccatcaaggaggaggaaaatgacaaaaattctttgcaaatggaaaaaagccgacctaactgtacaacccgtagcaggtagagttacagcaccaccaaacgatttcttcaccgtaatgagaactcccacagaaattcttgaactttttcttgatgacgaggtcattgaactcattgtcaagtactccaacttatatgcttgcagtaaaggtgtacatcttggcttgactagctctgaattcaaatgttttctgggaattatttttctgagtggttatgtctcagttcctagaaggcgtatgttttgggaacaaagaacagatgtgcataatgtactggttagtgctgccatgagacgtgaccggtttgaaactatattttctaatttgcatgttgctgacaatgcaaatttggatccagtggacaaattttccaaattgcgacctctcataagcaaacttaatgagagatgcatgaaatttgttccaaatgaaacatatttcagctttgatgaattcatggttccttattttggtcgtcacgggtgcaaacaatttattcggggaaagcccattcggtttggctataagttttggtgtggtgccacctgtctgggctacatttgctggtttcagccgtatcagggtaaaaacccaaatactaaacatgaggaatatggtgtcggtgcgtcacttgtccttcagtttagtgaggcacttacagaggcacaccctggacaataccattttgtattcaataactttttcaccagtattgcacttcttgataagctcagttcaatgggacatcaggcaacaggtacagtgagaaaggatcacattgacagagttccactggaatcagatgtagctttaaagaaaaaagaaagaggcacatttgattatcgaattgatggcaaaggcaatattgtctgcagatggaatgataacagtgttgtcactgttgcctcatctggtgctggtatccatcccctgtgtcttgtcagtcgttactcccagaaactgaaaaagaagatacaagttcagcagccaaacatgatcaaagtgtataaccagttcatgggaggcgtagacagagctgatgaaaacattgataagtatcgggcatcaatccgtggaaagaaatggtattcaagccctcttttgttctgtttcgaattggtcttacaaaatgcttggcaattgcataaaacatatgatgagaaaccagtggattttctggagtttcgtcgacgtgtggtatgccattatctggagacccatggtcatcctccagaacctggccaaaaaggaagacctcagaagcgtaacattgactcacgttatgatggcataaatcatgtgatagtcaaacagggaaagcaaacgcgatgcgctgaatgtcataagaacacaacttttcgatgtgaaaaatgtgatgttgccttacatgtgaagtgttccgttgaatatcacactgaatagcaggtgtcaccacctcctgagataagaaacatagttttatacattatgtacagtgtagcagtggttttgcctagtgttccaattttggaacgtcacataacaatggaacataataaatttttttttctcttcaaatttttgttccttgaatttttctaggtaacatatatgaatttcatgcaaaaattcaaaaaattgtaacctcagacataaatgggttaaagatgttttcttagagagcacattgccttcttttaaataacaaagctgagacacaaatgaagactaattctgcttcctgctctgcacacacctttcattcttggctctgggcataattgtctatatcagtcttaatttactccatgagatctgcactcctaactgagggtatttcatctgctcagatgtgccaattaagtttacccagatagaccataaaaaggaagataagaaaagtaaaacaccaagtatctcaatttagcaaattagactaatctgtaagggattcttagctgtctgaaatagaaaacctatcatactacagaatgcaaactatattaaatacccagcttggtgcctgaatatatttttaaaaatcaaattgtactcattgtgcctctgttgttgaatttcttaaatggatattgcaataggtagagaatgatcttgaggttgaaatgtcactctgtattaagaatgatttaactgtatgatacacagctttttccttacagacggtgtagatttaaactgctctgtgtacaatgatccttgcaacataaaaatattacaatagagcagtaaggtctgttttgaattttgagcaccacggtaggtgacctccttgaagttttggagagggcatgtttattttattaatatgatctcaggcaactaatatttgataattcccattaatatgtgtattttgtcccttttgtgtgttggtatgggcagttgtgtacattgatttgtctagtataaaatgtgtattacatgattgttcagcctatattatgtatagttcaaagaactgctaaactgattttactgttacttggaaaagtttgcaggggtgtagtgaagagtgagttttgacttactttgcacactattaaggtggggaaggaatcatgttattgtacaaaaatgaaggcaatctttcccttctttaaaccttagtcctgatgtttttttaagacaacatttggattgaagttttagaatttggtttgttcttgtgcaattgctttcgttctgtggcagttagaggacccttcgctggcactgtgagaaaaggggtggtactagggagtttggaaaatacttttttgaagacagtattatgtaacagataggaatatagactctggaacttgattatctgggtttgaatcttttcccttaactcattggtaatcttggacagcttcctttctttctccctgtctgctttaattgttaaaaaaaaaagagagagagagagaataacaatagtattgatatggtttggctttctgtccccacccaaatctcatcttgaattgtagtccccatatgtcaagggaggaacctgatgggaagtgattggattatgggggcggtttcccccatgctgttctcacgatagttagttttcatgagagcttatggttttaaaagtggaagtttttcctgtgcttgcactcacttcctcctgccgccttgtgaagaaggtgcccttcaccttccaccatgattataagtttcctgaggcctcccagccgtgccgaattgtgagtcaattaaacctctttccttataaattacccagtctcgggtatttctttatagcagtgaaaatggactcatacaatatagtatctcccttattaggttgtaaagattaaatgaattaataaatgtgaaatacttaaaatagtgcccagtacccagtatcactgtcagtcataattactatttgttttctgacccaattaagaaatatgtatgtatgtgtgtatatgtaatctcaaaacaaaacttgtccagagctagctgactttccttaaggaggcagtatatagcataggggttagacaccacgggccatggagtgagtgccagagcctagccgagtagctctgaggtcttgtgtatccactcacctgtaagatggggatcacagcagtaccttcttcatgggtgatgatatgtataagatatttggcatacatcaggcactccgtaagtattagctattcttgttacatgcccactagctaaaagttaccacaaagattccaccaaggcagtaagatgcttgaaatgagggtctgtgagaaccgtgaaggagggtgtataatgaatactcatacgtatgaaaaggtgacctttcacaagtaaaggcagtttaacaattgatattacaggttgaccatccctagtccgaaaatccaaaatctgaaaattttttagcaacgtgatgccacaagtggaaaattccatatttgacctcatatgttgggtctcagtcaagacacagtcaaaacttcgtttcatgcacaaaatattgtataaaattaccttcagcctatgtgtataagttatatatgaaacataaatgaattcgtatttagtcttgggtcccatcccaacatatctcattgtgtatatgcaaatattccaaaatccaaaacacttcttgtcccaagcattttggataagggctgttcaacgtatcataggcatagtaaaatcattagctgttacaaactttgttttattgatgttatgcttttggtacctttcatacttttttaaaataagcttaaggcccacttaatgataaaatatctataaaaatataagtacagtatcaatattgggaagaaatgtaattatttctcctttgaacacactagggggcactagacatctgtctaggggacaaaccgtgcaacatgccccttggttctaagtgtaggtaggtcaggattgcagtatggtttctcacagttgtattctgaggtagatgtaccagatccttctcttgtatctcttttgtgtcttctcttttggcttgatttccagcctccttgctgtcctggatgataggatgtcctgactggaatgtcctgctgatcttgactgaccagtatggagtgagctagcatgacagtctgctatgcttgggggttgaactgagctcctgctggctcaagactgcaataggtgttttgacatttgttattttttattcacatttaacctgcaattaattaaaatttctcaatctttttgtgtaatctgccaactgttatagcatctgaaatttatgtagtttcaaaagtataatgtacatacgtaatttcatttagtcctcataaaaagtcattatttggctcattttgtggtggaggaggcagattcaacaatgttacattatattttctaaagttcaggcctccccttaccagttaaatgcctgtaatgcacctcttttgcctacattcggttttcacttctctgtggttatcttaaatctgtgtctgttgttgggttctcttctagtgaccaccactggagcctgagacgggctttaggagttagaaaatgccctgatgggtcgggaatggtggctcacgcctgcaatcctagcactttggaaggcaaggcaggcagatcacttgaggtcagtagtctgagaccagcttggccaatatggcaaaaccccatctacaccaaaaaatacaaaacttagccggacatggtggcgcatgcctgtagtcctagctattctggaggctgaggcacaaggattgcttgaatctggaaagtggaggttgcagtgagctgagatcgtgccactgtactccagctgacgtgacagagtgcgactttgtctcaaaaaaaaaaaaaagtaaaaaagaagatgaacaacacacttactttatttgggtgcagctgtgacttttacatgtatagattaaagaaaaaaatgaaagtgggaacatcaaaaacactatttccttcctagtaatgtaaatatagtttaagtctagacttttttcccatcataagaattctttcataagaaggtgcttcttttgtccagcctttcccacctggtcctggggaagcttgggagcaaactcagggctcctggttctttccatcagctggcgtgcagaaaccaggctccttacagaggagacctactggtgatgaacccaaaaaatggagctcagacttaaatcactcacacaatttttatttatttacctttttattgttcaaaatgatgagctttccttctccttatctttttttttttttgttataagattctaaattaagaacttctctgatgttgcagccaccctcattatgggtcatttttttgtagcgaaccttaaccatttttatccagtggacagagctaggagcagtgctttaaagtcatatgggtagaaggagtaggaaatgcagcaagaggtaggctctaaatgagacagaacagaaagtttccagaacccatttctggatgaccccatttgaccattttcaagtcacgcttctctgtctgtgtcttccttttccctaaccgaattatgaacttcattcattcattcagcacttaacggtctgccatgaggaggcattataccagtctctagtgctataaaaatggctaagacagtgtttgtccccaggtggcttccagtccagtggaggacactggtatggatttcacaatatgctacacttgatgggcactgtagtagagatcccaggtgtgtccaagatgtcacgggattgggagggcccttggaagacaggacacctaagtctggctggtcatgggaggtttctgtgcatggtggtgctgcatgagtgagggtttgaaaggtctgctgaatgtgtggatatgtaaggggaaggatttggggacagtacaggaatgcaggtgcacagagatgaggaggctgcatacatggtatggcacggtggtagctagctgtgtctttccacttatttattttgaacatccttggaatgctgaaaattcttctaaaataaattaactttaaatggcagcaactagctttcagggttccattgatgcggcaccctaataggttacaactgggggaagcattgttcctggtgtcgttcaactggttgtgctgggtctgagttgcttctgacagatgattattgcagtctcagccccaggccccacagcctgggccagattctcattcctacctgaatgtagggaaaccagggagtgttttctctgtctgcatctgactggaattgtaggtttatgtttgttcccagcttctcttgtaattggctgccagtggagttgacagcaggctgaatctggcagttgtgtgaggagctagaaacacagccagtgaacaccatgcccaccacttcgttttatgtggctgcagctgtgactattacgtgtgtggattttttaaaatgagagaatagagaacatgaaaaagttatttgttttctaaaagggtaaatattggactatttactgcccccttctgctttttctcagttaactggtctactttttgaaataacagaatttagacattttgaggtcatttctaatttttaagatttcagctcacttggcccagattttaattcttacccactccctaccaattttaagtcaatctgtatctatttttgttactatcatgtaaaagactgccatacttaatgacagtttactatttacaaatttgtgacagaatttttaaattgagatattccagcaggtaccatctgaagactaggtatctttactcctatggtgagcacattattcataataattaactgagcatccatttgatgagctatcatagtttctgtttaagtatacatgttcaggtagttctgttaaacagagtacgttgcaatatgcacattgcattgggccacatacgtaacttgctttctcttctttcagtgaacatagtaatagtatctgctgcagggttgtcgtgaggatttcagaaaatgtatgtggttttatataatactatagtagtttattaagcacttcctaatctaggttctgtgctaaggtgctttatatgtgacaccttatttaatccttcccagaacccagtgaagtaggtgctgctgttctccccatctcagtggaggaaacttagatgctgatgaagttaagttacttgctgagggttcatgagctagtaaatggcaccaggatttgactatagctagtctgagctcagacttttgtgcctgggcctgcacttctgcatatgtcaaacccaggatgtttatatacagaatcctttatatctgctggccagacagactactcagcctgccagactacagtacaggctggttagacatgttaaagagagcccttaaagtctcttggcagcgtctgggatgaggaaggcacgtttctgtgtatgtgcagatgaacctggttctccccctttccctagtgtgttgtggtgtacttgtcggccccatctttagctgtgctgcttcagtggaccctcatcagatggtcaggtctattttggctacaagtcacatgaggaagtattgcttatgtaacagaagaatctcttcgcctgagctctgtatgcatgtggttttataaccatgatattttctgtctttaatatgtgtataattctactggggcaatttgtcttcacaatgatacaaatacttgcaggcaataatgattttccccaccacttttagtcatcctttagccaaactgaataaatgtttggcccttttcatctttctttatgaagcggaaggcactagaatgcaatcgtttctgtagtggcttatgtggtttcctaggtgctgagttctgtggcgacaagatgcctgtatattttaggagggagggaggaggaggaaactgaatcttgtcgatgcagagtgatgtggtgggaaatttagcagccacaaagattgactggctaagtctaaggaaatggtcatcatatatcaatgaagtttaaaaagtgataccctgtatataaaatatttaatggccttgtgccaaacttcaaaaggcaatatattctggtgtttttatttctccttctgtaaaattatcttggagaaattgcaaagtgaagtatgtttaagtggctgtgattcttccaaggtttatgttatccacaagtttgctaaatacaagtatcctttgttatgcagaagtttggctctgcgttcatagttttgataccgaggactctctcattatgtaaactcctcgactgctgaatttcagagtgagtagcaagaattcagatatgtgtatcaggaaagtgtatatatatcgttcagtttgttcagtttctaagttttgatagtaagggatacctatatgccagggcttcttggctttgacattattgacatttgagacttgataactttttaccgaggggtttgggggctgtcctgtgtggtgtaggatgtttagcagcatacctggactcacctgcaagatgccagtagtagtatatcctcccgactccttccacagttctaacaaccaagaatatctctgggcattgtcagattaccccagggtggggttgaagggacagaattgccccctgtcaagaacgattgttgtacaccattgcatttaactaaatttgtaaataacatgaaacccagaagacttttatagccacctagagataattcattttgtccattgcatggagataatttttaaggaaaaaaaataccagtggagaagaagagattgcctttagaagttaagcacaaaaaggacattaaatttttttataaaaagtatcacttattaaactgttgttagatgatagctatttccttagacttggccatatactgcctcttccatttgctgttcttctctggaaatgaccaacagtgcttcattgatcttatttataggtcctttactaccgtgtagtgcaatttcagataaccagttcttgttgatcacaagtaaatttcagctagcccttccttttgttaccttgaagagttgaaattttcaacaaggcaagagtttatcagaggatgtgctttaaggtccaccagtagctacctacatactagcattgggctctgtgtggttttgtaatggatactggacaacacaccatacctttggccaggcagcatgtgtagtattaccctttcattttctcttgccttccctcggacattctctcttactcttgcatagtcagtggcagataaatgccttatatgtgttgctgctcttactcgcttcctatgagttttttttttattgtagtttgaaagcatttctctgtattattgttttattccatttccaccattttgtgaaattcagagcatcagttgcaccatgctgaatgaaaacatcatctttttattttgaaagtgaatagaatttgaggctttttttttttccccactcacgacaactagagtccattatagttatgtaaatgcaaaattagtctggttaaatgggtgcaccttctccacaaccttggtgtattgctaagactttcagatatttagatgaaatatatttccttctgaaatataagtgttcaccttattttatatctgaaagtatcatattactaaatttgtaacttagattttattcagtgaacacatttttttgagtggtagcactatcagtgcttgtatattgctgatgcctcttcccccagttaagtaatcagtaatgtgaacctgattcagtgattttgaccccaaatttgctttatgtttaaggggctttgttgttttatgctgtgactatcatatctttagaacagaaatagtaattataaatctattttttgttacatagtattgcggttgtgaagacactcaattatattgaaatttttactgaatcttttctaggactaatttcatgtcttacgaaccagcagagaaattttcccttagggtatgccagaagaggagcaagtagttttgataatgaaatgagaccttaaagaaatatttctagagcagctataataatttacataagaaatgaattgagatggctggagaagagaattgtttttcctctttgaatatcagtgttttgggtaataatggcagcattaacctaagagaccgttctaatttgcctgttttttcttgtacattatcaggagctatctttttaaatctgtcttgtgatcaaaataatggaaatgtgatttttattttcatggtaggagatggaataaactgagactgcaggacaaagagaaacgtctgaagctggaggacgattctgaggaaagtgatgctgaatttgacgaaggttttaaagtgccaggttttctgttcaaaaagctttttaagtatgtaccatatgttctttcctttctatttgctatcaagccattatgtacaaattaacattttaggaattacatagtagttacctgtgggccctgaaggtacttgcagcaatttgttgcaaaaacagatactgtcaaatgaaattatagccacgtgctgttcattaaaattggatgataataagttgactaaaatgtgcattgggtatgtttgtaaactgatgaatctatatggacctgcctcagcagactaaaagcaacacatttaaaagccatttatgttgaataatttttttgttcttagtaattttaaggtgccaaactcctaatttcttaaataagattaataggaagagttgcatattaaaatcaatattgggaaggattttttttcttctatgtggaaataaaaaacttttgacattttttttgagtgtcttatattgtacctgagggtataatatttttgagctgaccaaatgtgcatctaaatattttatgtaggatgtcattctaatgtcaaaagagaagatatgggcaacaccttgatgattaagttgctatttgaagccaggtttcatgtgtaagtggccaagcattggagatgaccggatgctgcctgatagatgtgttcatgttgtctctaagggctggccagtctcccgtgatgaatgtaaatactgaggaacattttcagtctcgtcactcctgggatttacttaacaagatactttaggaaggcttcttagatgcatataggaagttaaaccattacatagcttctttctgtctcttttgtataatcaatttgtagttgggagcaggatgcaaagttctttgttcgagatgattaagtttggtctcctttatagattcagctgtcagccatgccctaaacttgtggaagaagtctacttaaaaacagcatgctctttatattttctctcaaagagcttatattatagttttaatttttctctccattggggtaggggagagtgaagagtagtttttttatcccactaaacattatagaaagccaaactctaaagatgtgaagtgacttgatgtgattgctttaactggacagaggaacagccgtgtagaagttgaaatctgaatctgtagtaatatttacagaggtggttgctttgtttattgcttctcccaaatgagaattaactatggaaaggtaaataaaggccacttttattggcaactctttttgttttctctacagtgattctttgttaagaaacaagccaaataccatcagtgttgtactagcaaaaggaatacccaaattatagattaaattgatttaaaaaagacaggatacttctgtgtatttgtagtaagtgatttggcagatatcctcaaggatcaagttgagtctgcatttttgtataaatgtcagattttctagcaaagatatttcacaattaatagtactaaactttgcttactaaaagtatttaggattcagtgtattaacaaaactctatagtagttaatataaataatattcgttttttaaaaattagtcttaattgcacattcctggaaagtattgtgtttttttaatctctgcaaaaacaggattttaaatattttatgtcataaaacttctgttcattttcttttgctgtatgaaaaaaattaataggattgatagagtctccatttttcttttatgattgcgttttagcggggccaatttaattttaaactgtagatatatttttttactgtatttgctgcattctgtggaattgaattgacagggtatagagttgtacacaagggagtcagaaggtacaattagccatttaagtacattttctgcaagatagtgtttaacttttaaatttctgttttgaaagtttgcccagcaagtatatttgtctatctaatttagcagtcaaatgacaaacttcaatcttttgaccttattttcagccacactagtaaatgcaatcttgggttagtgtggcaatgccaatgtacaccaattatttgtggtcacattgtgatgcctcagtctcaagggatagcagaataaatttttttatgttgtatattcataaaaatctttaactgtccctaaagagtaatttttatatgcttttcaaaaattttgaaaactagattctataatatgtttttatttaaactatgtaattggtttacactgtttattattaggaaggtaaagcaataaaaccaaagtcagttagtggcacagctgaaacctgagctcaggcccttatattcctcatctagcaacaccagctatgtatatcatctaccagctgtgtggctagtgcttttaatctgcaagtgaatttcctttaaataccatctgagggccttcgtgtattgtgtggaaagaaagagccactctttgctatctttgtaactatccctagtttttggggatcctgctagagatatgacttacatgctgcctagtaagattttttttaatgtcattttcttagtgctgttcatcttcttgtaaacacactcacatgctgtttgaaagccgtcgaagattagatttgtagatgaggaaacacccagcacattgtatgctgcctttcctgggccacacagaatctagttgtcttaaccccctctcaggttccttttgggatcctatgctgtttaccatttctttaataatttctcaactgctcctttccgcactctccctactttagttaagttgatgagccccaagcaaaaagagttgttggacccatgtaggatggaggcagtgtggtgtaggagtaatacactagaataatcactgggagattttgttccccgactggaggagctggtccagttgttctgtatctcagcaaaaagaggtcaactgactagaatgtagtgattctggaaactaattgcacatcagttttttggagagctttttgcagtgtgtctttttcaaaagttgagattattctagtgtagccagttcatgaaccagcttttgttctaaatgagggtttctcgaccttgacacaattgacacttagggctaaataatttgttgctgtggggactgtcctgtgcagtatcagatattgaacagcttctctggcctctactattgcacttctctggttgtaacaaaaatgtctttagacattgccaaatgtcccatagggagaagaattacccctggctgagaactattggtctagatcatttccagaatcactttggaaacatacagttctggatttcagctctggcttgctcatttttttctagcgatgtcacctttggcaagttacttaaccattctgagcttttgtttcctaattataaagtgtgctgataatctcctttgtgcaagttgattgtgaggctgtgtccaaaccacctggcctggtgcctcctcagcagttggttccttaagtggtagccattattctctgattacataccacatattttcggaatttgtccttcttcccaaattaaatgatcttgtatctgtactacacttcatcgtgttttgatttttagttcttttctccaaggtgcatatccagtgtgtgtattataattagcaaacttaataagcagcaaagttctcatttagagttttccttatgtaataggtaataatggaacagctagagtcaaacttctagaattgctttgcaaaatactgggagaaagttaattatgacgtatttactgagaggagattaaataaaaccagttaaatgagctgaagtccaaaatgagattttaggtagacatacctataggtaccagatagtaaatatttggacagcaaaacaacaaaactatcttcttttaaggtgggtagcccatcagccttgatattttctttgaaaaaaaaatgccttatcttgcatcatctttttatttatttattagagatggggtctcactctgttgcccagtttggaatccggtggtgcaatcatggttcattgcagcctcaacctccatggctcaagcaatcctctcaccttagcctcccaagtagctaggactacaggcacgtgccaccactcctggctaaattttttttttttttcttgtagagatgaggtcttactatgttgcccatgctggtcttgaactcctgggcttaaatgatcctcctgcctcggcttcccaaagtgctgggatttacaggcatgagccacctcatctaacctatcatcttttaattcaagtggtttttgctttagattttgtaacttgggatataatcttcataccattccctgttgttaagtgtttcttccactctccgaaaatttttttgtatttttccttttttaactttatttttaggttatagattaaacatatcattgatggagaaagaaaaatatcaacttctgttttttgcagggggaggggttaaggttaaattatttctctttgacccatattccttatttaaaatcttaatagctatgatcttttcgtacctttggtaaactccctgaatcaatttctgctttgaaatattaaaaagaccttttgtattgttgagtctttaaactgtgcttttttttgcatctgctagtaatatgacagaatcatctgttatgttctaattttgagagcagacctattattcagacttgtttatggccttaaaatttaattttttctattaaaagataatatgatcaccaagtgacttttcaacagtataagctataggttgtggtgttctctgtcctgcttttttgatgctattcagattgaaaaaataaacattagtgccccttttttatagaaaaattaatggaactttatatatgaaaaatatttgggattttttcccccagaaagtgagtaaaaaatagtaagtttatgcttgtttagcaagctatttctaatgttgaaaagaaaggaaatagtctctaattaccccatctatcagtttaattagaaatgtgttaatgttttgtaaagaaaaatttgtgatttttatgcctaggtgatcaaaaatgtatgaccttataaatataatactcatgtaaaacacacatcccgcatgtttctctgactggtactagaacctagccaaatgattaattcatgagtactttctgttatgatctgtattatccaccatttgccattttctcttttcttgttggtgtttgttgtcataggtaccagcagacaggtgttaggtggctgtgggaattgcactgccagcaggcaggaggaattctgggagatgaaatgggattgggcaagaccatccagataattgccttcttggcaggtctgagctacagcaagatcaggactcgtggttcaaattacaggcaagtgctcctctgcagactgtcagtctgtggagctcaattaatatttcatcagatgtattgctgtggaggagggtcttgtgaattattgatgacatttcaattacaatattcctttaattcttttagtgggggacatcaaaggaaaaattttacgagacaatggagctgtagggcaggagaaattaaacatgtaacacttttaatgaattccaggcattgatgcttcattttgcagatgagccccactagatattttgggtcaatacgatgtctaaggttagcttctacaaagggattgtttacaaactcaattatgttaatatcaatagtttacacaatatggaattttaaattagacataatacctttagttccatttattaaattttacattaaaatatttgttctggcaggagaccaggtgagcattacagtaagtacaaagtctattcatggggagagttggagctttgaagaagccattctccctaatttcctttataatgagtgtgcatgatagcatttctagatagcttgctctctctcttgtttttgaatgaagttacttgtctgatccctgtgttttctgcccttcccaatctatgaactttatgtaataaattctaatgccaaaacgtaagcgactacctaaaatggtagaaaactatgtttagatgttaatctttattctctttagaaatttaaataaactattaaggcttttgtattccagaagaataagcatttaatctatttgatatggtaggactgaaatactttattttgaaagaaagtactatgagcacttccatatttaaactgtaaattgactctgtagaaatcagtattggtaaaaatattggtcggtaaattatgtaggatatttcatcatactgaacccagataagtccgagctccttgtgtttcagtaggcttatataaagagtaagagcaaggtagttgctagaggggtgtgcccaggaaacctcagacactccctatatatgatttggagataacctttacagtagtgtcagtgtgcctgaagtcagcaactgccgaaagttcttcctactctccagctcatcagcagcgaaatgcttagtagagagccaaatatgaaccataaactgagtcaagatcatgtttctttagtctccagagtttagtgttttatttcttactctttcgttaagttagcagatcaatacttctgtgaggagtgtttggagttttagaatattttagaacgccagttgcatttatatagatgtaggaaggggaagaaaacacttggagatttttaaatgctaaacatcgtgttgttgttgttacaaggaagttatattgaagcaggggattttttcaaagatgagaattctattacattttgcttggaagcatgtgaaaacattccagaccaaaggaaaagttgaagttccaagtgggcatttagtgtggtcttatctatgactgttaatttttttaatatgctttttctgtttcaaataaaatgctttttctgtttcaaataagctctttggttggcttgttttctgcaactctgttgggtgtttttggtaactagacaaccccaaactcctccaaatggtttctaggactctttctttccttaaatggtttctgggattttcttatttcccatttcatttcttttctttgcttcccttcctattatcatcacacttatgtggagtccagtgctcaggtcctaggagaactaaagtcatccctgcagtgtagttttgatctaaaaattaaaacatgctctcttgggtggtgacaatcctactaagaatgaagtcaaggctaataatgaacagcagctgtaatcaattaactatcaatgctcatatcctcttctctataatgaaataatgtggcatattggactacatcccagattgtctttattaagatggtattggtggaagtggcttgtgagaatgtggtgctgcaccacaaacacctgggctcctcatgagtggaagtttacagaggagtgtggtcccccccgctcatatgtaccagggcggactggaccacatcttcctaacaactttataacacatcctcctctggaaccagatgaacttgggagttctctatatttatgtcttacagaaaaatagctcttaaggtcaaatgaagttctgtgtgagctgttattgcctcattggctatgtatatttcctgtgaactcttacaaactgtagaggggccctaatttgagatgattttggtgttgtaattttaaggaccatgaacattgaaatgggaacagtgtctctgtgataccaagaaacttcatggtaaaagaagtttgatttgttattttttaaaaaatgtgtgttgtatgtgtgtttctagaagacagagaaacatattgcttatggttaataaacatctgtactggttgctgtgttccccttcataatggatacaccaccttcttttcactttgccattcatattataatgataggcccctcaatcttataatgaaaaggaaataaattgactttcaaactcagttaattttttaaagtcttggatatcatttggtaattcctaatgttattgaatttaataaactttcaaggataaatattttactttgtagttcctggtaagttctgggtatgactagcagatttccatcctgcaggttgatatatttgaccatggagctattggctttccctaaatttattaggtaatcaatggtaatcaaagattaaaggaattgtagtctgtttggtaattgatgctaatcactgtagtacacttagccattactcatgttcatctcactggtattaagagttaggaaagggtggttcagttgacgatgtgactgttaatggagttgattgtcctgctgtggtccagcaacagtctaggtctgctcctagatctcaactcagcgtgaaaatctccaattttttctactaaaggggaaaatggcagaaattaaagggcatcttgataatgccagatagatgttcagccagaagaatatactagccttagataacaaaatgtgagtcatcaatgtagcagtttgcagaaggcacattataaaagagaaaaaaatactgtataacctgaaaaaacatatgcatgtgtttatgcttatttgaatgtgagtttgttgtaaaaatattttagacagcttttgattggttgtttcctaatccctgctaagtgcatattgatgataactcttttattccccttggaggatagaaagaagctggtgcatttaatccttttagaaaggcttgctgccatggaaggggccaggcagagtcccactctccttggggagctcaaggggcacctggacaggccctgccttggtgaggagcatggcttagaaactctgtaggaagagtgtcggagtctcttgtagcctctggcttcttgtagtctggccctttccacccagttgaagggcagggacagtgactgtagctggaggcagggagggtttcaaagtggacataggttattttgttacgttggagtataagggtaggcctcatttaagttagggctttaccaaaatttcattgtttttctatagaactacaaattatttttcagttgtgtagtagatgatttttaatatttcaagcattgtatgatttactcttcagttatttgtaaaaattgtattttgtttgtttgtttgtttgttctgagacagagtctcgctcttgtcgcccaggctggagtgcagtggcacaatctcagctcactgcaacctccgcctcccgggttcaagtgattctcctgcctcagcctcccaagtagctgggattacagacactcaccaccatacccggctaatttttatagtttaggtagagacggggtttcaccatgttggccaggctggtctcaaactcctgacttcaggtgatccacccgcctcggcctcccaaagtgttgggattataggtgtgagccactgtacccggccaaaaattgttttaagttcaggaataatttatttctgagctctagtaagaaaacaaaaatcacttatgattccccaactctgaaataatctcttttagcatgttgatatattttcttccaatcttaaaaaatgttttaatttaataaagccagcattcattaattgcttgctattaggtaggcattgagatcatttgaagaagagattatctctgctctcacagagtttagggaggatctcatacaattacagtaaaggtgatttgtgttttgtcagggttaatgtggagtgcactaaggaagagtcgttaacttgtttacagagaaagggacagggaaggctttgtcgaggaagctagagatctgaatgttgagtagaaggtagctggaggggtaagagggtaaccaggacatggtgaaggtcgattggaggaagggaagacggttcaggctggtgggctgctagccacaggagcaagtggtaggataatggcagtgagaggtaaggcaggagagatgagcagaggtcagtcttcgtggcctcgtaggccacgtccaggtgtttaatctctgtcccaagagcagtgggcagtcattagaggctttgaagtgagaggatgaggaattcaaattttactgtttgaaataatcatcctcggagatgcagtaacccagatgagagaggagagtggctggacctggcatagcaacagtgtagacggagagacatggcgactgaaaggattcaggaggtaaaaatgatgtgaactcagtgtaggttgctcgtggtggagagcaagcaggtctgctcaaggatgaggcctaggtttctgatttgggcacctggacagtgggacaaaattctttccattggtttggaagcacggggacaggggacagccaggtaggggaggatggcgtgtggtgctttggggatatcggcagtgagatttctagtgtgtggtggtttggagttccgaagagtgatctgggctggagacttagatttggcattaccagcatctagaattgaaattgtgggaattagtgagatagaaggggtagtgtatacagtggagtaatgtatgtgcattttgcttcacacagtcaacatctttgtggggcaggaaaagggagtggaggagaggaatgacagtgtgcagagtgcagtgactctgctccaggtgtgtgagaggcaggcgtgtggccctgtgatgccctcagtcaatcccagtttttagttgcctcttgtagcatgagctgagtgttgttgaagaggttgccacggttagttttgacttctgcttaattttcttcttatgcactgactggcacccaactcccagcaagactgaaggttaatgggctacagtaatgggagtgccgcttgtggagatacaagctcaagagcttagctaaagggattggtctcaaacaagaaaagggacactgtccctttgtcccagaagggcaggaggagtgcagatgcagacagggaatacagtgtaggatgtatcaggatatttgactgcacctaagtgaaacctggcctcaaattgggttaaacattcacaaatgtatggtacacctagaaacctacagagggggaggctgtggacacagcatgatcagcagctcaatgatgtcttcagggacccagatactttaatttttgcctaaggccaggtgtccttgtaatcattagatctccttatcactgtaacccagtgaccattggtctgtacatgtagccagaaagaccaggagagaaaagtctctcccaacccagaatgtaatttttccttacaaagttggtcagtcttgccaggccagcttcatggactagtgagagtttcaggggagtaccatgcactgacaggttatagatgagccaggattcctgcttctgagccaggcagtggtcagagtcccataaactgtgtgtctgcagtaaggaagaaggagggcacctgcagagatctgattcttcaggaaaaagggagaggggaatgcatgttgagacaatggccacaaccagtttttctacgtatacctatgtctaaggaaattggggtgattccataaataatttttaaaaattatgatgaacatttttctagtttattaacttcttcaaaatgattttaatagttatatgatattccatcttatttaacagaatcttatagtattttctgtatggtcctgttctaagcactttacagatgttaactgatttaatcttcgtaataaccctataagatcaatactgttattattcccatttgaaaatgaaaaactgacgttcccagaggttaaatggtgtgcccgagatcatacaatgtgtgcagagttggattcagatccaggcagtgcctctaaccactggcccatgctttgttaaagaaatgggatagttcattcagctttcctcttctccatggacataggtagcacccactttttctgcagtataaagaatgctccagtgtgtatcccagtgtgtaaatgtttttattgggattgctgggtcaatgcatgggtgctgttgaggctcttgattttgctgccgaactacctgcccacacagcagtgacagcttgtacactgtcggtgtgggcttcccaggagagaacactcgctcggatgctcctccatggtgctttggtggtgtagaggagcaggcagggtggtgtagtgaggacaggctgcagtaagtgaagactggctgctaggcagccctctgtcccctggtagccatgtcacctgggccatgccagccttatgagcccccatcagtggagcatttctggcctacttgcttcctagggcagtgagattgaaattctgtggcttgaaaactcttggtagactataaaacttcagacaaatttaagattctattatgttcacttaggttaagatacactgtataaaaacttcactaatctgtagtagaagggaaaagagtatttttgttaaataatatttgattatcttttatgttactatagatgttatatctcttaatatattattaagtgttttctcttaacacctacatccactaattgatgaatgagattatggagattttacttactgggttttaacatcagtaactttttcttaaagaaaatatcaataaatttccatagttagcattgtttttttgaactaagttttttgtttgttgttttgggggatcttttgagcagttgatgactgtatatgctctttcatggttgttttcttcttggacgtttggatgcaggtttgaggggttgggtccaactgtaattgtctgtccaacaacagtgatgcatcagtgggtgaaggaatttcacacgtggtggcctccgttcagagtggcaattctacatgaaaccggttcctatacccacaaaaaggtaacataatatttcagtacctttttgttttgttttaatgccctccattttacatatttggtttttctctgatccatgtgtttctcaaatgtatattcctgtgttttttttcctgcatttaaagttaatttattattattgacttactttagagctctgtgttttcagaacagttatgaatataggtcttattgttctaacagtctgtggtggtgttgtgacaatgtctgttgtccagtaaaatacgaatcatctcagacagggcacaagcctggcagtgtgggttggagtcataagtcaggtggctgcgtccagtaaggagagactttgcgcattagtggcttcaaacagttttaggaaggtggatacagaagtaaaataacaactcttaattggtaaatgcatttgttagtatgcatttaaccttccatcttgagaatttcgcaagtattgttgctttttagttgtgttttgttccttgaatccttgatcgtcatgtattgacagttgtatttcttcacttagagtttggtaatatcacagtatcaaaaaagagctttatctgtgctcctgtgggtagcatagatacgttgtattcttccttttttcttctcatctgtctaaccatccagactgtgagctctgttgagtagggactgtgtctgattcatttttatatcccgggtgacccataagcatttgctgaataaataataatcacgcagtttcactgtgaatttgcaggttacattattggggagaagcagcagtctcttaggagctagttctttctttcctgagtcttctgagctcttgagttcgttctcggggcccaggaaagcagtgccggctgcaagggctatggagtgtttgcctcacggagtcagatgcacggggaccacgaaactccaggattcctgttgtgtttgtgttcatggaaaagcaaacttttgatagaagtgactcagaaaaatctatggtttggtagcacaaataaggcgagatggaattttgcttacactgttattgttaaaaccaactgactttgcccagaattttaagtgataaatggaaaataaactggataagataattaataaattagggtaaatgctgtgagttataaaaagtgatttttagcagtatgaagataatagcagtatagattgttgtctagtcaaaccttaaattgtttgtcaaaccttaaactatcctgtcactacccttgtaaaacatttgtggttcctttttcatttctgttatctgttaacatctcttagtgttttgtgctgcaaaatcctgtggcaggactcattagctgatgtttgtcttataaaggcaatttaaaaaaatgttattcctttcattttcttttggggtagtaaagtgtgtgtattggacaccttcacctggatcatggcttgcctccagttcctttgtcaccatagtttgaagaactgccttcgtgtaaaccacatacatggactcattatggaaatagaattgacagtaaatttggtgaaatttgtctccttgactttggagggcaaacttctaagaagagatatttcacttttggttgcagtggctttaccttctgaggttgttttaccttcacagacacttgcatacatatggttgttaataattttttcagtgttttacagtttaccaaggactctaacttgaagattcttaattaacttttgaggaaaaacagcattacagtttccttgtgtttttactcaaactcttaactcttcctactgttccttttccattataaagtatcttagatcactaaagatgtaaactgttaggcaaaagatcaaaaatatgtacttttatatgtatcaaactatattcttaacttagaagccctatatttattacttttcattaatgttaatattggcttatttgtggtgacgacacattggaaatgtattaatagttcctttccataggccttactattgacatttctaagatcataactttggtttctggattcaactactgaaggggtatttgcttcctctgcaccttcgatcttctgtgtatgtgcagatctctgtcaccacacatgcatacctgctggcttacacgtgtgttaaattacaatagagtctatgtttcttattcatatttcaaaaattctgtttgtggtgattcgtcctctaactcagcgtctaatgcctgacttccttatcagctgtgatttctttttacagtggatgagctttctgtgcccaccagctgttctgtctgaatttaataatggtactctgacattgggacattcaatactggatgtattaggaacagggaagagaagagaatttctctttagaaatatttaaaagaataataatgccagaattgttttgtttatcgttcaagtagattatctttattttccaaatgctttgttgtagctggtatgacataaattttgaaaattggccgggcgtggtggctcatgcctgtaatcccagcactttgggaggccgaggcgggtggatcacgaggtcaggggtttgagaccagcctggccaatgtggtgaaaccctgtctgtactaaaaatacaaaaattagctggttgtggtggcacatgcctatagtcctagctactcgggaggctgaggcaggagaatctcttgaaccctagaggcggaggttgcagtgagcctggactgtgccactgcactctagcctgggcgacagagcgagactctgtctcaaaaaaaaaaaaaaaaggaaaatttttcatttggaaaaatatcaaatggtcaatttctcaattaagcacatctatcattcttcttccccaagttgccctttagcttcccacctctctcaccctttgatcctatgttatctttgttaatagtctctgattggcagcataatttagaattgtcaaatgtacacccagcagccatgcaaaaaaatatacaactgatagtttcaaccaaatgatgaaatctgataaagaaatttttaggcttctgaatctcttttaatggtcacttgaaatcgcatttaataaaagttcaagatttcctttttctgattatatttcgtgatccttttttctaatatagagcaactttcatgtgagttgattaatatttatttgttaaaacaacaataaacactgcatttcaggtgtttgatgttgctagggctcaaaaaaaataaaggatgtttttaactaaccttaaaaagccaactctttccttggggaaagaaaatgtagtaaatgaagagataaagaaggcagtcttgtgatacctatcccataactcacagtaggtggtgacatctttagcactgtcttgtaaagtttatttaatgattaaggatttttttttcaatttattggaagatacataatgataaattgcttatgttctgaaacagttgtctctctcctacctttttttgctacgtagtctctagtagttctgtaacatcttaggtaatttaaagagttttgtttcgttttgatcaattcatgacatgtagatgcataagagtgggaaaagcaacaagagcatgcagttttaagtgcattggttttgtgcttacaagaccagggttcgaatcttggatctgctgttttataactttgcaagcttgggcgaatcacttgccttcctgagcctgatttgatcacttataaaatgggtaaattttggtaaacttgttaggactttttgggttaatatgtatgtatgaagagcttagtgtggtccctaataggtaacatttactcaggtaattcttgctgttgttagaaacaaagaatatttaggcctcttcacctcagtagttgggaaaagaaaagatgctgaatgaggcattgctgattgactcagtatgtagtctagagagaaggtacacatctactttatcaaaaatgttcatggtcattcaagatcatctagaccttttattctcatgttcagatacatttggccccagatggaaacagtgaagtgcagggcgtggttaaaaaagcaaataatggcctggcacggtggctcacgcctataatcccagcactttgggaggctgaggccggcggatcatgaggtcagaagatcgagaccatcctggccacatggtgaaaccccgtctctactaaaaatacaaaaaattagccaggcgtggtggcaggcaccttgtagtcccagctactcgggaggctgaggcaggagaatggcgtgaacctgggaggcggaacttgcagtgagctgagatcacgccactgcactccagtctgggcgacagagcgagactctgtctcaaaaagaaaaaaagcaaataacacaaaaacttggccatccgatgaaactcccatcaacatgttctttaaaagggcctgttttctgaaacactagagcaaaaagacgtggctttaaaaaaagctagaagggagtaaaaaactttaaaaaaaaaaaaaaaagaaagaggccacattattccttaagcatctgaaatatttcagacacattctgagtacacaaattataatagaatgcaaagtggtatcattcctattaactttagagtcagtgtatacaccttatagaagacatgatagatgctgggcttgttctgcgaggtatgttgtaaaattgtgttgctggagcccttttttttcttattgtcagcacaaatccttgtttattaaagatttagcttgaaggaaattttaattaattacaggtgcagtaaatcctgcctaggaagcggctgtactgtgtttcctgtgaatggccttcatgtgcctgtgcttcgctcctctccccgccgcctgacagtgtgatttatggctgttgttttccaccagtccactgtttgccctctaggagggattggtctcttgagcctccataataacagcagccctttcacagacatcttctaatgacaacagcactgcattcagtaagtcaggctaattgcagatgtaccctattaattgcaaaaactaggagaggttacatattttacaagcttttaatttgaaaccgcccgagatgatttgtcttaagtgtttggatagagccgtccataatattcaacaattcaccattattgaaactccagtctaggcagctatagaattctgcgattgaatcaggtgataacaaatagtcttagatggggttttgcccagtggctaagtggagattatattttcaactgggacattttgaacaatttcttgttctttttacataagcatctttttaattcttgttaatcattaatacatcttcctgaacacaggaagttttgtatttctatagctaacatttctatacctataataatatttagaattttccagataaatttcaatccttaagcaagcataagaaactaaacatcattccagtggtatacatttgggaagcttggtgtctcatttggtaactgtgggaaagctccagctacactaggtgatgtccagaattcatttcggctttggcttctaaaggtcgcaggtctgaccaggtgaggtgctaaaggtggatggtttttctctgggcagactgctttcttcactggcaccagcagctaagtggggctggtggcgagggagtcctgagggaacccgtacgtgtgtttttaaggccgttgtgcaccccaaggcgtttattgctgtattcttgtgaggtcaaaagtcaggaaatgggtctttcagatgtggccttcaatatggtattgtgcaggtgtcgaattttgtgaatgggaagatggaagatgagtagtcataatagtaataaaagtatggcacacacctgtcaaattattaataggtccaggcattgtggttattctctgcagcaattgtattaactctttgaatgttacatgaattacaacatatgagaagacaatgtctctttattttgttccttcagattttcttagcctttcttgtacccttttatactctgttgaattaaaacacattttaatcctagttctttaagaagatataaaattaccattttttgaagatgttgaattttataaaatttgtattagatgattgtgattacatgaattatattaggcttcctgatagctattcttgtattcctgtgataagcctttagtaggttaatatattactaggttttatctgtaaagtagtggatctctagtttagaggcgtgtatgcacactcataagtgtgctgtgtcagttttgaaaacagggtttgctagccttgtaacaatgattggaatccattctttttctatattttggaacaatttcagtaataggatctagtcctactttactcataaaacccctttgggtctggtagacttttggtgagaagagtataacatctttttcacattgttcagtattggtttgttctgttggtctgatttttcttgggtccatttttgcaacgaactttttagctatcatatctgtcaaaatgttcagattttgtagcatgtatattggttaacacttttgtattctctacatctgtaattgtgttcctttgacatttctgatgctgtacatctcagtctgttattttggctcacttttcagaggtttgtttggtttagtctttccaaagagttattattattttgctttatcaattctaccagtttttttaatacccactaatttttatcttactaattctctcattttccttttttgggaggctaagttgactgctctctttgatttcagcttttcttaatagagtgtttgtaaagaatgaatattctttgtatagtctaaagtgctgctgatcactgttgaaaggaggtctgatggtgatactcaaatcctttgcatcctctttgtaaatgttttattttctttgatctgactttctctcagagaggctgtggtcagctctctgggtaggctgtggatgtgtcattttgacagctctaagggccctgcttttgtgtttattgctgtgcgttttggtaggtaaaggttcatggttcttttttcttattgtggcatccccattaaaatataaaatatccctctttctgttcactcctttttgtttcatatttacattgctaagcctgcccttttttggttggcatttctttgatatatctttgataattcccatattacaactttcagtgccagtctggtttgggtctcttttaaacagatggctaggtttttgccttacccagtggaatgtctccctgttaataactcactgtcttgtggtgggttactaggtttagtttgaaacctggtattttgttttctgttttatattgtcctgatttttgctattttctattattttcctctgtaatggtttgatagttctacattctattttctagtttttaggtggaagtagcaactgttactcagtaatcagcataaagttttggcaaatgtattttaacatatttttctcacatagttaagaattaaatatctattgcctgtgtacctttctaccattggacagggtggaatttttagttcacttttattttcccttaatctcaatccagcttttatgaaactgaacaggaattacagtaacatttaaaaatatataccttttaatattttagatcccctcttaacagtttcattcatatttaagtgtttaatatttaggctttgttgttatgctttaatgatttattttaaatggtatgtatatcacatacaatcttctttttaaactttttcttttatattttagtaggaggtagtgtagcctagtgtcaatagtactagctttggatttggctgcctttctccattcgaattctgactccaccacttagcagctgcgtgacctggtacattagttaccatttccaagccccagttccctcatctgtaaaatggggttagtgatggcccctctgtccttccttggggagctgctgtgagcatggtctgtggtgagaatgtggtgcaggagcattgctgtctttccttcttcagggcatggcatttgtgcatgccttcctctttgtccacgactgcaccactccactgtctgggtgcagtgcactgtagttagccaatctcttggtgactgatcttccaagtccttgcctatctgaagctggaatttgtttattttattcatcaagcatgactgctagtttggattgatgtagaatccatggtcaccacttttccttcttagaattacgtaaagattttcctctttgccttcggacatttttagtgttgcagaaaagatgtctgatgcaggtagtctttttcctctgaagggaatattttctttttctgttttgttctgactagaatctatgacattttctccttatttttaaaaacatttttctcttttgagtcaggatcttgcgccgttgtctagcctggaatgcagtggtgagattatagctcactgtagactctaactcctgagctcaagggatcttcttgcctgagcctgctaagtagctggcactgcagctgtgcaccaccatgcagtgctaatttttttattttttgtagagacagggtcttgctttgttgttcaggctagtcttgaactcctggcctcaagcgattctcctccctcagcctcccaaagtgctgagattacagacataagccactttgcctggctgtttttatttatttttggaattcagacatctagtaagatatgtctacagatgcgtctttttcttagtgtctctgcctgacactctgggagatgttttgttctgtagattcaaatctcggctccatttatggtgattgttttctaacattttctttttctttttttctttttttttttttgaggcagagtctgactgtcacccaggctggagtgtagtggtgccatcactgctcactgtagccttgacctcctgggctcaagggatcctcccacctcagcctcctgagtagatgggactacaggtgcttggcaccacatccagctaacttttaaaatttttttttagagataggctttcaccatgttgcgtaggctggtctcgaactcctgggctcaagcaatccacccacctcagcctcccaaagtgctgggattacagttgtgagccactgtacccggctttttttctatcattttaaaatcattgcttttatatccttttcactctgtcctggaattcttgttatacattgttagagatcctagatttgtctgccttgtctctttggattttctcttattttcttgcttttgttttaaattaatatattttccatccacattgttgttttgacaagaatggacacaaaggatgttttgaaaaaataaaaataataatttaatatatgtatatatttataaatatatgtattataactttgtcatctttttgagagtctccttcccctaataacggctgtattagtcagcgtttactacttgccaggttaacaagtacacttccagtgctgataatgtctgtgattgtgcatgttatgtttgtatttgtgcatttttataaagtactttagattgtgtcatgattgaaagggtgtcacttcttatttaaaactgactttaccattttattgtggtctcaggagaaactaattcgagatgttgctcattgtcatggaattttgatcacatcttactcctacattcgattgatgcaggatgacattagcaggtatgactggcactatgtgatcttggacgaaggacacaaaattcgaaatccaaatgctgctgtcacccttgcttgcaaacaggtatgacctcttttaacaagggagatttccaggtggagaagaataattaattcagaataaactatctgcttttagtaacacatttattgaatctttccttgtgccaactgcacaagaaatttaaaatgtgcattttccttaatgcagaaaactctttatttttgcccttaatcatgtctttaattctgattgttcatgttatttaatgtctcttgtaggggccagttgttagaatgtaaccaaacccaactctaatctatagtattcagcttcaacaataagaaaaaattctttctcattttttcatctaaatgtaattaaggatttgtaattgcataaaatgtgtatgttttggagagtaccaaaatgatgcaagaatgataagtaaatgtgtaaataatttgcagaggagcgttttagggtaggaatggcgattgctaaaaggtaaatttaataaaaaggtgcttcctttcctcaaatagtttcgcacccctcatcggatcattctgtctggctcaccgatgcaaaataacctccgagagctgtggtcgctctttgacttcatcttcccgggaaagttaggcacgttgcctgtgtttatggagcagttctccgtccccatcaccatggggggatattcaaatgcttccccagtacaggtaaaatattaggatgataatacttttggcattttaatatttaaagtgctcctattaaatactataatttgtagccaagtcattcagaatgtgagaaagatggccaggctcataaattggtatctggttaaaaaaaaaaaaaaaaaatcacaaaattatctttgcttgatcatattttttcacttaaaacatcatgaaaactattcacagagaggaaagccctagaataaaatatctccttgtttaatggaaattaaacagttttggcattgttcctgggatgtttaaaaagatgtcacatgtggtcagaagagcagttagaaattatgaaacaaggacaaatcagtttggaacagcatgtaatttagtcctgcaaactggggtagtgcatcttataaagtagtggagaaacttagaaaaggggacactaggaggattggactgttcagggatgatttaatgagacatgccccttaacctgattctgggaatgtaggccatggagagtgagggcattcttgattagggcaacagtgtggatgcagccaccatatgtggcagggcgcagtgaagagacccacttgactggattggagatgcttgtgggggcatagctaaaaagctgtggatgctagaactgtggggccttgaaagggaagcagtggcactcagggagggctgggttactgaaagtgtctgagcaggactctggaggatgctggttctcaggggttcctcaggctacagggtagtcacaagagggaggctggcactgagtgacctgcaggaaccactggggtgagggccatgaggacctggacctgatcttgggtggtggtctgagaaagatggtggggcaggagacgcaggtggcatttttaggcagaacaaacaaggtttggaggctgacaggatcgaggagatggagtaggggctaagcttgctgtgaatgactgactgactcctgaggtttcaggcccgggtgcctgatggaatggggtggtcacaggcagaaatgccaggaggtgaagttagccatagggtggtttgtggcctgtatggcaggctgcagcctgggtgggaggcacggtttctgtgcatcccttcttgggtgggcctgtgcctaccaggtcatggctgagccagggatgagaccttccaccaaaagggaagctctcgtattttggagtatttaattagaaaaagaattttagacctttaagattaaaagattgtcaaaaacaattttaatatattttacattttgagattgaatgattttcagttaacttttgtaaggagtctcttctttctctgaatctcctgttataccattcttttttttaaaaaaatttattttgaaataatttcaaacttaacagaaagttgcaagaattttaaaagaacaaacaaacaagaaaaccttcttaacacttcacccagattcactgattgttagcattttgcaaacattttgccacattggctttaccattcctcccctccctctcccacacctctttccatgtagattcacagctgaggttactgttttctaaccacctgagggcaggttgcagatctgatgcccctttctccaaatccctcagtgtgtatttccaaaaacaaggatcgcctcttacatagccagtgtaagcaacaaaatcagaacgaagtttaacattaataggagtctgttatctagtctataatcactcatattttgtcagttccagtagtttccgtgtctctagtctcctttaatctgggactgtttctttgcccttcattaccttgacatttttaaagactataggcctgttagtttgtagaatgtacctcagtttgggtttgccttacatttcttcatgattggattcaggttatacattttggctaggaatatcacagaagtgatgtgtcttcctcagtgcatggtatctggaggaacatgctgtctgtttgttccactatgggtgatgttaactctgattactttaaggtggtgttggccagatctaaactctgtgagattaccacttctcctttggcattaataagtcatttatagaaaaatgatttgagaacatgtcattatgatctgtttttttccttgaagttcttgtttcaggaatttgtgtacttatctttctccccttcctagcgggtgagatctttggaagcagagtattggttgtatttgctcctttttgtttgagaccatgttgccttgcattattgaattctaagaagatagtctgtgtgccggtatttattctgtcatgctggtgctaaaatgatggcaggggctagaaaccagaaccttcccatgaaggtatttccagtccagtaggggtgggcacaggggaaaatggcaaataaacctggtcccagtacagggcagtgaggactgtgatcaggggagatgcccagtgtcagagcttatggggctcagaaaggcttctcggagaagggatgactcacctggggcctgaaaggtgaggaaggtgatggggagcatgtcagcagcccaaatatagactgctgctggggttggtgtgctcagctggggcagggcatgtgagaactgagaagagcctgcagggacgcctagttgaccctctttattccacatgcaaggtttttgattctcagcgttctggtgacttgcctaaggtcactgtgctcaggaagaggcagagctctgccttgtcagaatgggaaggagcatgggcatgctcagcaagttgtctgttttccacagcactgggatgtgagcattggtagagaaatctagctgaatccccaccttgtgtttttatgaatagaggaacagactgggagccagttgggagtgaaacagaagatcatctccatggggtggcatgcaggagagagcaggagccacagcccggccgttccccagcctagccctggtttagttgaccagcacctccaaccagcatgctcgctcttctgcggaagggggtgtgggtggagggaggatgtgggggcagttttctttatagactgtacattcgtgcttcctcagtgggactatgtttttaaattctgaaatttcatcatctctgcatcagaaatcataatatgtacctcatcatcatcttcaaggtgatattcatcagtctgaatgatatatttaaggagttatatataactaaaagtcattgattagttgagcttcttttttatgtattattcaaagtaaagcctattttaatatttacgcacatgcattcatacaacagatacacacacatacatatatgtgcatgagtgaggtatttttagcgttctttaagaacattttttaacaagttaattttttaacttttttttctgtgtgtgtggtcaagctcttttttattatcattcattttacagctgactttcttaaatttaaactttggttggaattttttccatgaaatagtaatttactaagttgttaagcctatttagattttttttgaagtagcaataatttattgactactttgcctgtaagtgaattgcagagggagtggttttctgggctgtggggctttttttttttgcgtatatttagtactcatctcatgtggccgtgctccattacagaaccatatgctgcattttagggcagagtgacctttcgtttctgggatcagagggctcttgttgaacttactcttgtaagtctccagtggacagtaatctctgcttattggctggctgctccatcactgtagcttttccccagagttagcttttgatcttcagctttgcagagttcctttgtagcttttggagaatacaagatcataaacagagatttgtacaaaagcagtttttcccctagggctggtggtcaagaacccagtaagtctctactttagggtttaactgtatagtaataattaaaggaaagtgtataagagaaataaggcacaaaattatcagtttttcttttgttgtacattttggttaatgagataatttttttaactgataatattatgaaagctaccaccccttggagtatatggaacttatgctagctttttcaaaccattttgcaatcatttcccactgactttatacagctgttggttattctttttttttttttaaggaatggaagcaattgagaggtaagaacaaatgcgttccttaaatatatatagtaatgttcccttctctgctcttattaaaggtcaaaactgcttacaagtgtgcatgtgtcttacgagataccataaatccatacctactgcggagaatgaagtcagatgtcaagatgagcctttctttgccagataaaaatgaacaggtctgtaaatccaggagttaacgaagcattcctaaagcacaagtgtgtctttcccttcactctgattctcctctgcggatgagagagtctggtgaggtatgatcctggaactgtgggcaggctaggcccgctgtggcgtctgccctcagtggattcttctctagtccacaggctttgacctccctcttactgacacatggattcctatagctactcttttaaacatctccattctccttaagcccctaattcattcatgctacaaattgtattaggtgccaaccatatgcctgtcgtgatcctaggctctgagatacagcagtgaacaaagcaagttttgttctcatggggactcacatttattcttgagggagagtgtcacaaaaaggtatagaagatgtcaggtggcagcattaagtgtggagacaaatgaagcagggttgaaggataagctgggaatgctgagggcaaggatttggggaagtgggccatttgtaagggttggtcagagaagacctttgatgaactgacacctgagcagaggcctaaagaaggcgaaggagcaagtcttgtaggttttgaaggcagagcattgcagatggtgagctgtggcagtgctttggggccttcatagacagcagggaggccagtgtggtcagggctgggagcaaggaggagggtagaagaggaggagctagctgggaagactggggaggctggcacagacaggtgcatgaacagaagtgaagacctgggcatcggaaggtgagtagggtgacctggaaaggacccagtgtgtttggccactaggaagtcatgagtgatgcctcagtggcatcaacagaggtgcccgtgaggcttgctctgggtgcgggcttcaggagtgactggaggtgaggaagtggaggtggggatggtacctaattttctcaggaatgcccccatcttccacttggaggctaatgggtgaggcactgtactggggagaatgagtgggtcttcagatacagtgcagaggtggaagggttgccctccatcctgtacaagaacctcttcctctgggaataaaggaaaatgaggtggatgcagaagtagagacatgttagggagtgaaaaccagggaatcatgcctgatcctggtaggttcaggtttgattttcattttgtttttatttgtctgattgtttttaagtagaagttgagacagagttgcgggtggcttgggtggtgaggagcatgggcacagttgctctgggcttgtggaagatgctgggcgggcatgcgtagaggaccccctggagcaggacaggccatggcaggatgctgccatgtatgagcttttctccagcagcaccggcactgaccataggtctgcagaagactgatggttgagttgacctacctttggatgtttacagggaagatgcagggggttgaaaggggtccaggtaggtggcagaggggtggctaaatgagcatccgtgggaatgtaactggcggtggtggactttgcgaaggagggagggttgagaggtgaagggtcacagagcacgatcgcatggagtggttggtgcagtgggctgggagggtaagggttgccgtccaaggcaagtctggtaactcatgggcctgcacttagagctccaggagagggagagctccaggtgaggttgtggtctctggtcaggtctgccgagtagagcatggcatgggtcatgggaggtgggatggtttgagcacttggaggctaacgtggaggatggtctgtgcacctgggcactgaacttgcccgtgagcaggaagccagtctttggggactgtgggatgggccctggaggtagacaagtgacagagatggaggggctggtgagcagggtatggtgagaagtattgtcaccctttgttgttttaatattaataatagggatatcattaaaatcgcatgcattgtgctcttttgatcaggaagttttgttgatattttaattatttctgttaattttttttttgaaattatagtttccttgtttttcccgtccgtaggtcttattttgccgtcttacagatgagcagcataaagtctaccaaaatttcgttgattccaaagaagtttacaggattctcaatggagagatgcaggtcagctaaaaaatagaagctggagaaatgaattgtggaccaagagaagtgagggaggaaaagaaactaggatctacattgtgccaggcttttcacgtactgtcatctcacttcacttgcatgaagtcccgcatggtagatgtgcagtcagcctatggcctggagccgtaaggtgcagaggagtaggtaactggtgaaaggtggaaagttgcagagctgtgtgctgtggatctgaacccagacgcaaatgcagctgcgagctgtgcagttactgttacttccgagggtcttacctggtaggtgggcgggtgtcaggtacatagctgcattttcccagatattatgaccagaattatatatcttgtggagaggatcatgaggattcataactttcatcagcttcctaaaggagccccattccccaataaatgtttatgaaccattgccatgttaggaaccagatataaatctggttcaaatgtccctggctctaattctcattgtccccagggtaggacagtaatttatttatggtgattctgttcctttcaatactgagaaagctctctttctactagtgtccagaattcagaagttcctagctagtgtcttctccaaaagactctattgtataaataatgtgagtgtgattaggtcatttcagttcttttaaccatctctcacaatttcttatttcatttcttattggttgctacaggaggttcttcagtcattcacatctattcatctccatgaatctccccttaacttcttcaggtctttccaagttagggggtctagatcacactatccaggaaagggaatgcaaactacacttggaattgtaaattttctagtagtcacattaaaaaggaaaaagagaaacaggtgaaattaattttgatatatattttatttcatatatctaaaatacattttaatatgtaatcaaaaattaaaaatgattaaaaagatattttactccttttttgttctgtcttcaaaattgggtatgtattttacatatgcagcacatcacaatttggactagccacacttcatgtgctcagtagccacgtgtgactagtgactactgcattggacagtgcagattgaaaggaagaagaatgagtcacggatgactctggggaggtttaccaatgttcctgacttattcagatcatttattgttaatctgtttactgttgtttactagtgatagctaccctaccctttgattattggcttaatggtgatttctcctctgctcaagcttttagaccagtgagtttgatttgaatcatcctctcaaggctggaagagccccattattgaagttttgttaatgttcttttgtggggatgggccggggcactcaccccttgtcttctgtgcccttctgcatggaccatatctttcccattcgtgcattcctattcgtgcatttttcatgcagttttttttctgatataataataatctaaaggtaaatggatcctcaacctctgactcatattaaactgcagaacttttagtgaggtaattaggagtgtaatatttaaatgcatttgataagtcacatgactgatgtctccaaatttaggttgataggacatttctgatccatatttaaaaggcgaattccttttttatattaggtttataataccgtgaactgcataccttttttctagtgagggaaaatgaattatcagcaattgaatatgacccctgtagacgtgttcagtccagtagaatttttttgtttctgagaacttgttctatcagggaaacaagatgagtgaaagttaatttctcccagctcatgataatgctgtgactagagaagaaactaagaagctggtggagaactgttttttagtctgtgttataggttaaacagcctccttgcctagggaatcttactttacatggggtcatctgagtgtacatgtactctttcttaccacagattttctccggacttatagccctaagaaaaatttgcaaccaccctgatctcttttctggaggtcccaagaatctcaaaggtcttcctgatgatgaactagaagaagatcagtttgggtactggaaacgttctgggaaaatgattgttgttgagtctttgttgaaaatatggcacaagcagggtcagcgagtattgctgttttctcagtcaaggcaggtgagtgcacagacttcagacgggaaacaggctggttctttatgacagccatcaactcacaaaatgggattcaatctaaagtaatgattctgaagcaagtctaccactgatgctgaggtggcagtctaccgatttctttgggagtttagatctttctctagagttggtgtctaaaagttgactttttaaaaaagctcaccatgtgattctagtctgcaagtaagtttaggcctgagctttggctgtttacaaaagtaagaattaaccatacggaaataccaaaaatactcttttaacagttctgtttatctgtcctaaagcaagaaactccttttaacataggcctgttggggaaggtgttaccatttacacaaatagagaagcactcactgggaatgtgtatttgctttgcaaactcctatcccccacctccaaacagatgctggacatacttgaagtattccttagagcccaaaagtatacctatctcaagatggatggtaccactacaatagcttcaagacagccactgattacgagatacaatgaggtaacatgtgaatgtaacagggaagttgagtggtgctgctgtacgtggagggaaaggactaagcgtatccacacccttacccaccaaagcagcattgacatctgggcttgggagggggcctaaggggagacttgttgtttttaactctatgccctacttctggatatttgggggcggggattgtgggcatgtgtatgttcaaacaaagaatgcgttttctacagcatgtattttcctcctaaaaacccaatttttaaatatttctattaaatattaaaagtaaaagctgtgaaatgagattttgattcaccagaggtctctaggacattaccattccttatattgggaacagcccagtaattccatgtgtacaatatgtggaggcagaggctgagaactgtaactggtcttaagtgtgtgtgctcagtgttgtgtgtcttacctctaggacacatccatatttgtgtttcttctgaccacgcgggtgggtggcttaggtgtcaacctgacgggggcaaacagagttgtcatctatgacccagactggaacccaagcacggacacgcaggtttgtttttattttttttttaaaagaatgtattagtagaaatatagtttcatggttagcgcttttgactgtcctttgatgttctggttggcttcagcatacgtttcacattttgattgtctcctgttcttcaacgtgaaagaagacacccttcagagtcaaatggacaggaaccatcttcagcagtttatccatagcattcattcctagagttggggtaaaaagaacataggcaaagttacaaacattttttcaagtagagatgtcttgtcaactggctgttcatcttcctgagtaggccttaggtgtacttgacgtcatgagtcaaaattctaactctgggagtgacaggtagtgaccagctagctttgtttcttatagtcagtgcttgtcattgggaaggattctcgttgagaggtctctctctctctgttgcaggcccgggagcgagcatggagaataggccagaagaagcaagtgactgtgtacaggctcctgactgcgggcaccattgaagaaaagatctaccaccggtcagtgcacacagtggccactcttggctgtgcgttcccagagtcttgagcagggaatttttccaaagtgttgtttttaaaagtcttaacatcttagaataatagttgctataacttaaggctttggtttttgttttgtattttttctttccctttaaaatatgcttagatgtcttactgtgagttgtcaaaaaatgtctttgaacctgataatttttgtaccttattctacctcaagaatcacatacatgtaaacttcatattgttatttgaaaggaatatttctgcctgctatggtgtgttgccttcagaaaaattttaaaaaatgacaaggttgaatgttaccatattggtgtttacataccacattatgcaggtaggatcagtgtgggtgttctggcagtctttgactctgatgccccttacaaagaagtcgacaggatggctgtttcgtcctctgtctttccataatgactaggggattttagacagtggtaacttcaacagtagaatcaagacattgccagcttctcccactcccccaccacagactttatccttgagccatagcccagcttttataggaagctctgtgccctttaccacatgctgggccattcctggaacattacatcttcctcgagggagtgttgtgtgagggtggaggacgagttggatcctgtgagaagagagcttccttttatagattcatgctttagctgggagaataaatgacagggagggacagggtggctggtggaggtgcctgttccagagtggcagtggtgtggggcttcagcagagtgtggacctgcaggtgggagcagggagagagaggtcagagtggagacattgcaaagcccaggtaagagagtttgctgagccctatgataggaaggttctaggcagggcaggacccttggtattcaagtcaaggaggctaagagagactatgagtcacatgatggcatgtgaaaaggtgtttcttgaaatgtgttagatcttggaggttgaaaaagctcattcggtgtaaataataaggtattatttctaatttaaattctgcaagacctgggagattaactgatgtattatatatttcctgaattgtaattttccaaggctgaaagtttgggggattatttagccattcatgcagcagctgttatcatctctctcttatattgctttataacttgaatttttaggtagagctacacattgttttataccagcttatcttttatttttttagacaaatcttcaagcagtttttgacaaatagagtgctaaaagacccaaaacaaaggcggtttttcaaatccaatgatctctatgagctatttactctgactagtcctgatgcatcccagagcactgaaacaagtgcaatttttgcaggtattacataaaatcatttaatttaaagtaatcaattgcacaagatgatacaatatagtattagtggtgtttttcctctttacaggaactggatcagatgttcagacacccaaatgccatctaaaaagaaggattcaaccagcctttggagcagaccatgatgttccaaaacgcaagaagttccctgcttctaacatatctgtaaatgatgccacatcatctgaagagaaatctgaggctaaaggagctgaagtaaatgcagtaacttctaatcgaagtgatcctttgaaagatgaccctcacatgagtagtaatgtaactagcaatgataggcttggagaagagacaaatgcagtatctggaccagaagagttgtcagtgattagtggaaatggggaatgttcaaattcttcaggaacaggcaaaacttctatgccatctggtgatgaaagcattgatgaaaagttaggtctttcttacaaaagagaaagacccagccaggctcaaacagaagctttttgggagaataaacaaatggaaaataatttttataagcacaagtcaaaaacaaaacatcatagtgtggcagaagaagagaccctggagaaacatctgagaccaaagcaaaagcctaagaactctaagcattgcagagacgccaagtttgaaggaactcgaattccacacctggtgaagaaaaggcgttaccagaagcaagacagtgaaaacaagagtgaggccaaggaacagagcaatgacgattatgttttggaaaagcttttcaaaaaatcaggtaatccatttgatacgtttgccacagggatgctaggattagaaaatgagtaggctgtttctagcagtagcagtctttaactgatggtgcatagagggctgtcagccattagtgtttttcttcaaaaatttagatttgaaatatattgacattttaaaaattgtatttacacctcttttctgaagacctagaataatttgaaactttggaaaacaatagtacttatggccactcatgggaggtgtgcaattcttaaatcgatgtgtactacctgaacattagtaggcagttactttacatgctatatgctacattaatctgattttccaaccacaggagattaaagtaacatcataagggagagggacaagcgtgtggctagagacagacattctagaagtatgaaagctgatagcttatgtcaagggagaaaagttaggagatgtagactcaacaattgctcaagaccatggagtatatagatagccctgcttagtgatcccttagcagtcactgtgttcacaatgtgatggccttgagttaccaaagattgctgcttatggtactcagtttaagaaggcaggtttatgtgtagcatttcagaaagacttttatttagcatggttaatttttttgttaatttcatattttgaagtaatttcaaacttaaatcagttgggtctcaaaaaaaaatcagttggaataatacgaagaactctcctatatcctttatctaagttattaacatttttcagcttttgctttatcattcacacacacacccatctatgcatacattttttttttggtaggaatgccacagaggtgataccgtatcttactcagtgcatctatcaggagacacatgctggtttgacctattacaagttgatttttaagatcacttggttaaggtggagtctgccaggtttctcaatgctaaggttaatatttttacctttgtaattaatttgtgctttcaaggaatatgctttgagactgtgtaaatatcctgtttctcatcaaacttttatccactagttttaatatctattgatgattctttcctcagtcagttattactacaatggttgccaaatggtgattaacattctattgtaaggaaggttttccttctctcttatttatttattaatttatttttagatcagtgtggactaatggattcttttttttccatgactgtaatccattagtaggggtattatgatgctcgtattgtcttagatttgcctcatgggtgggagctccttcaagctggctcctttgtccctctggtatgtccccaccattctttgagcacctcctttcttcttggcatactaatatatgctgagctcaatttgtattctgtgccagccctggaatcagccatttcttcaaggaaccctggagaatggtatttaggaactaggatccgggttctcagagtgttcattgctgctattatgtcattgctttcgtagccaatagtatcaggaaatagatgtatgtatgtgtgtgtatgtgtttgttgtgtacatacatatacacatacatacgtgcatatatatgcacaacaaattgcacagatacacctgtctctatgtctgtgaaaaccatgaatttggcttccagcaaaggcagattaacatttacccttccatgtgaaacaatgaaaacaatgacaaaacatatgaagcaatggttttcagacaccaaagggcagtgatctcttgagagatgggaaacaaatgaactgagctctccagttgccctgccctactgccttgagagaattttcgtgctgtaacagaaagagggagaacccagatgggagtccaggcagaccctctgttgaaaaggcagagctgagcatcaggggaggccagggtggctggcattcacatgcaagagacgatagcggagacagctctgcacagggagagaaccccacaggtctgcagagtctccactggcactcagctgaatactgaccagcacattgtgcaagaaaactacttaaggtcagtgaaaaggcctttcctctttaacttttcgaattagaggaaacatgtctggtgctcacccatggccagggatagtgcctgttcccaccagctaagactggaaaaatatttcatggggcattgggtatgatacagagtagggggtcttgcctctgtagtagggaatgatcagccttagagtgagcactgcttcagccctacctgagtgtttacaggaatatacaaatacccaacatccaacaagatgaaattcacaatgtctggaacccaatcaaaaattactggctgggtgtggtggctcagcctgtaatcccagtgctttgagaggctgaggtgggttgattgcttgagcctaggagttcaaaaccagcctgggcaacatagtgagatcctatctctacaaaaaataaaaaaaaaaatagccgggtgtggtagcatacacctgtggtcccagctacttgcgaggctgagctgggaggattgctcgagcctgggaggttgaggctgtggtgagctgtgatcatgccactgcactccagcctgggcagcagagcgagaccccatgtcaaaaaataataaaatgtataacccaattttttaaatggacaaataatttgaacagacttcaccaagaaagatatgtagatggcaaataaatatatgaaacttgttaatattattagttattagggaaatgccaattagaaccataacgagataccactatacaccctctagaatggctaaaatgaaagaagactgaccatactaagtgttggtaaagatgtgaagcagttgggtctcatacacgcctggtgggaatgtaaaatggcacaatcactttggaaaacagtttggcagttgcatgcgctttccttgtgatatagctttttcagtcctgggtgtgtatttgcccaagagaaatggaaaaatatgtccatacgaaggcttgtacatgaatattcgtagcagctttattagtaatagccaaaaatgtagaaatcaaatgtctaccaacaagtaaatagttaaactaaccatggcatatccatatgatcaaatactagtcgacaggtggggcttggctcacgcctgtaatcccagcactttgggaggccgaggtgggtgaatcacctgaggtcaggagttcgagaccaacctggacaacatggtgaaactccatctctacaaaaatacaaaaattaggcatgatggtgggtgtctggaatcccagctacttgggaagctgagcgggagaatcgcttgaacctgggaagtggaggttgcagtgagccgagatcacaccattgtactcctgcctgtgcgacagagcaagactccgtctcaaaaaatatatatactaatcaacaataaaaggaagtagagtattgatacatgctacagcatggatgactttcggactagtaagattagtacatactctgatgccgtttgcataaaattctagaaaacacacagtcatgacagaaattggattggttgtctgggcatggggtatttgacggtgggattacaaagggacatgagttttgcaggtgacggctatgttcattgtcttgattgtagtgatagtttcatggtatgtacataatgtcacaacttaccaaatactgtactttagcagttattgcatatcagttacactctaataagctccaaaaagcaaaataagatgagggaatactgttgtctccaatttcatttcagcaccctagggccctttccatgtttgtagcttccttcttcaagaccttcattcacaacgtactgagttacttgtcaatcctaggatacatggtagctttttacaatttctgacctgaactatggcaagaaacagttatactaactagaattcaatatttgtttttatttatactaactaaagttcaatatttgtttttatttctttttgtctttagtctaagtttttggtcaaaacactacttgagtcaaaaataacttagttcttttttctcacccttcatcatattttcagtgtgtgctatcagtttaaaatacagttaggttaatttatttgtttgtattccactttagggtttcctcccatccttgttgactctatgttatcttctgagtagtaacacattaacatagtaacaaaagacaaaatatgcaaaaaggaataccagagtagtgtcatcccccaccctgtccccaccccttccttaccttaccagtctcatgagtttctggcatttccttcatgtgtttctgtgttagtctgttttcacactgctgataaagacataccagagactgggcaatttacaaaagaaagaggtttaattgacttacaattccacatgactggggaggctttacaatcatgcaaggaggagcaagtaacatctttcatggatagcagcaggcaaagagcttgtgcagagaaattcccatttttaaaaccatcagatctcatataagactcattcactagtacaagaacagcacaggaaagacccaaccccataattcagtcacctcccaccagattcctcccatgacatgtgggaattgtgggagttacaattcaagatgagatttggctgggacatagccaaaccatatctttccacctctggcccctcccatatctcatatcttcacattttaaaaccaatcatgccttcccaacagtcccctaaagtctcaactcatttcagcattaactcaaaagtccacagtccagagtctcatccaagaccaggcaagtctcttctgcctatgagcctgtaaaatcaaaagcaagttagttacttcctagatacaatagagttacaggcattgggtaagtacagccattccaaatgggagaaattgaccaaaacaaaggggctataggccccacacaagtctgaagtccagcagggcagtcaaatcttaaagctccaaaatgatctcctttgactccttgtctcgcatccaggtcacgctgatgcaagaggtgggttcctatggtcttgggcagctctgcccctttggctttgcagggtatagcccccctcctggctgctttcatgggtggcattgagtgtctgcagcctttccaggtgcatggtgcaagctgtcagtggatctactgttctggggtctggaggaccgtggccctcttctcatagctccactaggtggtgccccagtagggactctgtgtggggactccaacccaacattttccttctgcactgccctaggagagattctccatgagaaccctgcccctgcagcaaacttctgcctgggcatctaggagtttccatacatcttttgaaatctaggcagaagttcccaaacctcagttattgacttctgtgcaccctcaggctcaacactgtgtggaagctcccaaggcttggggcttgcaccatctgaagccacagcctgagctctttgttggcccctttcagccacagctggagtggctgggacacagtacaccaagtccccaggctgcacacagcatggggaccatgggccaggcccgtgaaaccactttttccccctgggcctctgggcctgtgatgggaggggttgccatgaaggtctctgacatgccctgcagacattttcctcattgtcttggggattaacatttggctcctcgttacgtaatgcaaatttctgcagccagcttgaatttctcttgagaaaatggggttttctttcctatcacattgtaaggctgcaaattgtccaaacttttatgcactgcttcccttataaaactgaatgcctttaacaacacccatgtcacctgttgaatgctttgctgcttagaaatttcttccgccagataccctaaatcatctctctcaagttcaaagttccacagatctctagggcaggggcaaaatgccgcctgtctctttgctaaaacataacaagagtcacctttgctccaattcccaacaagttcctcatctccatctgagaccacctcagtttggaccttactgttcatatcactatcaacatttttgtcaaagctattcaagaagtctctaggaagttgcaaaccttcccacattttcctctcgtcttctgagccctccaaactgttcccatctctacctgttacccagttccaaagttgcttccacattttgggatatcttttcaggagcgcacctccccactggtaccagttgcctttattagtgcatttttatgctgctgataaagacattacccaagactgggcaatttacaaaagaaagaggtttaatcaacttacagttctgtgtggctgtggaggcctcacagtcatgtcagaaggcaaggaggagcaagtcacatcttacatggacggcagcaggcaaagagagcttatgcaggaaaactcccatttttaaaaccatgagatctcatgaaactcattcactcatgagaacagtgtaggaaagactcatcttcataattaatcacctcccactgggttcctcccatgtcacgtgggaattgtgggagttacaattcaagatgagatttgggtggggacacagctgaactatatgtttcttttgtagaaataagcaggcacatgtataattttatattcccttattctcttacacaaaaggttgtatactatattatcttctgttcctttttttaaaaaaacttcatatatcctgacagccactgcagtattaattaacagagagctattcctcctttagcaatttttattgctagagtgctctgctatgttgacccaaaacctgaaatctaaaatgctctaaaatccaaaactttttgtgcactgacatgatgccagatgtggaaaattccacacctgacttcatgtgatgggtcacagtcaaaacacaattaacactttgtttcctgcacaaaattgataaacgtattatattaaaattaccttcaggctatgtgtgtaaggtgtatgttaaaaatatatacattttgtgtttagacttggggcccatccccaagatgtctcattaggtatatgcaattattccaaaatctgaaaaaggcaaaatctgaagcacttctggtcccaagaattttgggtaagagatattcaacctgtaccacagtttatccacatatgaggatttagattttttatagcttcttttagccacagtgctgcactaaataatcctgtgcttatacaagaggaattgctagatcaaaaggtaaacacatatgtaagtttgttttgtttgtttgtttgaataatgcccaactcccttttgtaaggtttagatcaatttgaattgtcacgagcagttgttgcccagaggcttgtcaagagtgtggtgttacacttttaatttttcccaatctgataggtgagaaaggatatcttaagttttaatttccagttattttctttgagtgaaattgaactttttataggaccatttatatttaaaaaatttttctttctgtgaacttgtctgttcatgtcttttgtccattttctaaatcaggtttttggtccctttttccccttggttttaaagagttctttatatattagggatgttagcttttcatttttcatatatgttacaagtatttcctcattgattgtcctttattatgatttttttcctatgaaacaggtttttttttaaaaaaattgtcagtcttttattaattggaattgtagttctaagccttttctacatatagatcatatgataattcgccatgttttcttgtactacttgtatggttttgctttttacattcagatttctgatccatttggagtatgaggtgtggattttatcttggttcaaagataaaatgccccaacgtttgtgccccaacgtttgtagcatcatttatttcaaataagtttttctcagtgattagagatgcctttatcatgtagtacatttccaaatgcagttcaagctatttctattttctggtcaatctcctgttgtgtctcttctttcctcagcaccaaactgttgtaattggagcgtgttttattgtccaatagggtgttactttgccttttcagtgttttctgatctgttcatgaaggtttattgttctgtatgaactttagtgtcagtttgtctagcttcataagaaaggttgacatttttattgagattacattaaacatataaattaactcagggaaaatggttattgagtcattctactcaaatgcaagggatgtctttctgtttgtttaagtctgatagtctatcttcccaggagtgttttcatgtcttctccatataggctttacacattgcttgggtttattcctaagtgtttggtcttttctgttactgtaaatagaattttcccaccattatatttttagctggctattgtttgtaaataggaaggttataggtttctgtgtgtgaattttatattttttatgttgcttgaattatcttactattttttatcattgattctctagggttttctaagtgtactatcactttgtttttgtctactacagtactgtacttatacagaggagaaaagtgtctttcttgcatacagagtgaaatatcactttgctatttcttttcttgctagttggcgtgcacagtgtcatgaagcacgatgccatcatggatggagccagcccagattatgtactggtggaggcagaagccaaccgagtggcccaggatgccctgaaagcactgaggctctctcgtcagcggtgtctgggagcagtgtctggtgttcccacctggactggccacagggggatttctggtgcaccagcaggaaaaaagtaagagattgctgcatgccatacttgcaaggagtccaaacaactaaggctagaaataaaatcagggcaggtgtggaggcttatactgttatttctcttcaggaataaatccccagggagggattatagcagcaaaatctgggtgacttggagaaatactgttataactttgccttcctccttgctttcatcccctgttttccaaagtggcttcaggagaagtgattggttttatttgagagatggtgttgttaaaaatagtaagagatacaggataatgattaaaccttaatgagataattagccagtttacagcacacattaattactttgctattcagtatgctcttttagaatgattttcctacttggaattgagaatggttcccatcatcttttgaacaagatactgagtggttctcattctgagatgcagcagttcctttttttttttctttttttagagatggagtctcgccctttcgcccgggctggagtgcagtggtgtgatcttggcccactgcattctctgcttcctgagtagctgggattacaggctcccgccaccatgccaggctaatttttgtatttttagtagagacgggatttcaccatgttggccaggctagtctcgacctcctgacctcaagtgatctgcctgcctcagcctcccaaagtgttgggattacaggcatgagccactgcgcccagccagcagttactttctaggagggtggagtggaagaatcgagggggatagagcagaaatggcatggctgtgaaagaataagcatgcagatggaaatgtttccaggaagaagttcattgttgaaagaatattttgatctctaagtctcaaaagcaaacatttaatctactgtgatgcttttccttttttaggagtagatttggtaagaaaaggaattctaacttctctgtgcagcatccttcatcaacatctccaacagagaagtgccaggtaatatagataacctttttgctttccagggtgagacttgcttgattgaatgctgtgaaaatttcacctgattctggatgtgaagaaaatggtcatctctggtgtaatgacacctgatatttgtgttgcacgctctgatttacgatgcacattcacttgaatctaaaaggacctgctgatttcctaaagacaaagtctttaacccaagatccgtagcagcatttctgttttgccattagaaggttgacacagggataggtgtgtcgctgctaggacagcctgccttgtctagagggaaagtgccagctccagagaccacaaccctctgaaataaaagtccagaaaactgccttgaatgttggtgtctgtaactcactggctgctagagcagagtgcctgtctttctctgctcaagaatgccctgcttgccttgagtgctactgtggttaaaactagtccagattccaccattcagtggaagtctttctggtctttctgattaaggattatgttaaaactcccagattcagactccaattttaagttaatgtgaacatgtttaggaatactagtacctttttgacttcccatgttctgtgcttttagcagtagggatttgagaccctttcagagttagatttgtgtttttttaaggcaagttgcattagatgtaaggtaggaaagagtaagaagacttaaaagtgaagaaaaggaagtatagctatgatattgttccttatccacagtgtacagggtccatttgagaggaagaacaggaaaagcccacaggtactgaaagtggtcctgggcctcctagagacagattttcctgaaaccttgcctggaagcctccactctgccttcctgtccaccaccatgttgagtggtggtgactaagggaatggcttggttgccccctctttatttttttttaggaaacggtctcttaacagtgggaggatttagataccagaccctcctcctttcccttttcattaggtggagtctcagtctcaccctgtcaacctcaccaccctggcacatgtgttgtcttgtgacccttcacagcctttggggaaggaagtgggggcataaactagaaattaaatatatcagtatagtggtcttctttttataggatggcatcatgaaaaaggagggaaaagataatgtccctgagcattttagtggaagagcagaagatgcagactcttcatccgggcccctcgcttcctcctcactcttggctaaaatgagagctagaaaccacctgattctgccagagcgtttagaaagtgaaagcgggcacctgcaggaagcttctgccctgctgcccaccacagaacacgatgaccttctggtggagatgagaaacttcatcgctttccaggcccacactgatggccaggccagcaccagggagatactgcaggagtttgaatccaagttatctgcatcacagtcttgtgtcttccgagaactattgagaaatctgtgcactttccatagaacttctggtggtgaaggaatttggaaactcaagccagaatactgctaaacaacattgcttcctaaactttcaagtccctttttctaacgggcatttctgattattaatttattattaataatcatgtttgtcaatggaagttggctgcacttgatgtttgtttgcatgatgtctacctcagaattaaaactttaaggaagaagaaactcttctctgaaagttaaaagttttaataatgctagctaaaggagaaaatacttggattgatttttttttttttggcaatctaattatattgtaaatcaggtacctaacagttactccttggagcacatttgttcctttacccaaaagatgctgtcagggagcacagttagaagtttgcagaacagaaatctcaatatttttttttattggtgctaaaaacaggtcttacattcagtcagacctgttcaataagttcatcaatatctgataacagcattattttgatgcttaaactttaaacatttatatttaccatttgccacccacaaaggtcaggtttgttatttgttgtttgataattatattaattttcttggaaagatcctcttttcaaggtactggtaaattggtgagtatttttattagtaaagcatgaaatagtatggtaataaatgataagacatgtatttgtggaaagctgtagggtattcagtttaccctggctttcctttaagcagagggcatctttttctctcctacagtcacaaaatgtgttatcattaaaaaaaatcaaattaaagccaaaagtaggtacataaaaaccacacacatgcatgcacacaaacatcactgcagcccacagcagacccagccgttgttaccatgaagtgacaccactccaggcctctcttgtctgcaggctggcaggctgtcttctctccagttgccttcgtcttgcgcctgcctttgcattccttgcgacgggctttcttgtttctgcggtttggattccagccaaggctgtttgtatctcactactgtttatgtgtttgtggttctgtgatggtgttgctttgatcctcagtttattttcttacccatgtttttcttgtttccttctcaggatgattttatcatctcatctttgaagtgttgttttccgaaattcatcgtattcctgaaatttcttcttagctgtcttagtgcagtttgtttcttggatttgtattctctggcatgctcttttcctctctctcatttttctgtagtatgcctgccctcctaccctgctatttctttacatctctctcatgcttaacatggatagctgtgtccagatcttctgtctgctcatccatgtgactcagagaggagggttctgggcaggggggccttgccggactgcatgagaggacatgagttttgctttctctgctctaatattttgcttaagccaagaatccttttcttagagatgttctatatgattcctgtcaggattttctagttttttttggattatagcttgttcatttcttttgtttttagtttggtttatatataatgagggaagaagatgattacattatttttgtcactttgccatcattgtttagaagtcatagaaagaatttttaaataggccaataagtcttaaacttgagtacttggcttagaagaaagtcaaaactccttcctttttgactaagtggtttgtttctggggagctcttaatttctatttttataatcattagcctataaggaaattgtgtcttccttgttctcagggtgatctgctgaccttgttcactcatgaagcatttgggtatcatacttatagtgtctgaaacataaactgtattgagctagacaaggtatagcctcctcttcaagtagcaaatactatcaaaagctataatgcagtaggagcaaggtggtccttgttccagtttttgtctcagttctgctgctgatgtaccatgatcttgggaaggtggtgtctcagtgtggagatctgacacattgttaccgtgcctcctggctggagggacttggagaacaatgcagttaagtagaatggttttaacaatacagagaaatttattcatttagataaaaatctgatttttagaactttaaaagctttgtacagtgtaaatagatttaatgtatttaacatgctttatcagcacaaataaaggattttaaaattttgtcaaaaaattaaatgttaatactatcaccattaaaaatgttcaagcaatagtctgcctccccacccccacaccatcttgcacctgttccacagctaagtacagccctaggtttggtgtgtattctccatgcatttagagaatcacatgacacagactgctgctataatgtcattttcccattcttcctttactaataaaatttttgagttttacctggacgtctggctgctcagcttaagactacttctcagcctctcttatagttaattgtggccatatgactaagttttaaacttcccaattggccctttaaagaagcagggtatgcactctccttgacattcccctttcttgctggctgggaggccaatgggagcttcagtagtgacctggcatctcaagagatggaagtgatgtgttgaggaaggagaagttggcctgccagtcttgaactgctctcctttgacctgttatttaagagtaaaataaaatactgacttgctt

SEQ ID NO: 15817 - DNA, 53394 bp, Human
  misc_feature (1)...(53394): n = A,T,C or G
agcgcggtgccgggagcaagggcggcggtcgggggctctatccagggacagcaccggggccgagaggccccaggactcgtggagtcctctgagtcctgcgcagcagcggccgtcgggggtcagctaggaagctgcaggattgcgttgcttcggtgcctgggcttggggaggcttaaccatcagggcttcgggactccaagcgcatgttctcacttcacttggcccagcatctgctaagtgaccaggtccgcgctttctgtgtctagtcggagggtccttgggtctgacccgactcgcctgaattgctggttggcaaccgcttctcccgggagcagggggtggggaaggaggagcagtggctggtggcaagtctgagccaggacatagccgatgacagcctgtgaatgaccggccagactggggttggaccttcggggcagagcaggcagcccttggaaagccaggctggcaggagcatgggtgggaggcacaaaacacagacaaacagacatatatacacatacatcctctaggcatctgcccaggagtgatggaggaagaagagttggtaggtgggaccaccaggaaaccatcccacccagctctgccttcttcaagctcagggtccctgaagcctgactagtgtctcccgaatgggggggaggggggggctctgggccagagcaaaaggaggcattggctgcatggtctgtagggcctttaccaacctgaccttgtccttgctgtcctctcaaaagactgccatgctccggtgaatcctcaccaggacgccacctctttcactttgcagttgggggcagcccctacgaacccacagcactgggaggcgtgggaacaagcctgtggagagtgtccctgcactgtgccagcaagggctttacattctctgcccagcactgcaaggcagccccaggctcctccatccttgggcctggttcatccatctttctggactctctgttcctggcaacaaccctgccaggtgcccatacatgggcggtgcttgcctctgggtaggggtggtgttgggtggggagaggggtgaggaaattagctaaacctcagctttagacttgagagaatagagggtgggctggtggaaaacatgagtatgtgcctgtggaggcttaggttcagggggatctcagagggtagcaattgtgacccacagcctaataataacagtctttgccctcttggcctggctcacttctactgtaccttcaaaattaatctgcctctccccagactaaggcaggtggcccctaggggccctggctgcccagcctccctgcatacctccctgggcactcctatggcatctacactggcagcctgcagacccgagactgcctaggtcacaacgcctccagcaggcccagagtctccctgccctggccacaggccaggctcccaattagcccagatgcatcctggagcacagggccttaaaggcctccattcacccacgcatgcattcctttccctccaccaacggagtgagggaattcaccctactccacaccagagatgtggccggaatgcagagatgaagcactgagcacagtaggtatggtcttacccttgagaagctagtgggaaagagagagtttgattggcaaagcacttatctattgggttccaggcaggaacaaaggcagcactctgccagcaacccctggtggatttggattgccccagggtggtcagctggccttgggtgacaacagactcatgagagcagaccctcactttaggaaccactctctcccatatgggggcccagagagaacactgtggtcagcacgtacaggtggaagtagagactggggccacgcctgcaatgagacccctatacacagctgtcaggctctggcctcctcatggggctggggtgggggtctgttggcgggaggtggagggtttgtgacaggcctatgtggctgctgtgttgatgcttcccacttcttggtccccaggtccacacctctgcatccctgcaccaggactcaccaagacgcccatcctggaaaaggtcccccgtaagatggcagcaaaaactcccagcagtgaggagtctgtgagtgacttttggagccctctctcaaccctgctttccccacctacatgcccttgcttctagaacagtcctgagtgggactggcccccagcatttgcctggccccagccctgccctctactggcacaaggcccaggctacagctccacccccagcttgctgaggatcccagaagggcctggaggggctgagacgggcctcagggtgccaaggaaatgctaagagcttaacttccaaatcccctggccaggctaggccctatctttccttccagggcctctcttcatcccagcttccacttctgatagctttgagcccagtgattttgccttagggtggggctgaattcctactccaagccctgcaagtcccagctccagctgctatcactagttcagccttggagccttaggcaccatgttctccactggcctgagacaatgccatcctccctgggcaggcatcctccctcccgccccagccagccttcgggtggcagagcaacacacctgacttcaggtggttgcatgtgtttcccctctcccacacttgtctttttgccactcctcttcccccttcccccttcccctttcccccagccctcatttgaaaccctgagcagaattttctggcttctccccaagaagctgttcactccattgccctgaattctgcagctgacaaacatctattgtcacctctggtccactggcatgcttctctacccaccccattgggctgtggcttccttcagagcaggctctgtttctccatcgtctctgagtccagcccaggatctgactcacatgaactgcccaggaaacatggagttttggagcattgatctgagactcccaggtccaaagacactccttagcacagggccagaagtccaggagagtctggggaggatccctggggggttgagatgtctgagctgcgatttcctgctttattcctttttacccactgctgattccctgttagccaggctaagtcacagcgcactgtcagagcctggaagaaggggagcagtgtctggcacgaggatctagccagacttgtgggccctttcggccaggtcactaactgggctgggcaatcctgtagtgctcacccactccatcacacagaccaccccgacctacccaagaacggtagaacatgatcactgcgtggggctcaaacctgctcactggtggttggctaggctcgttccgatgctgccagattacatcccatcactccaggatgatctcttcttttcgcgcttttacacccgggttcaccctggatttcgctcgatgatcgctccgcgctggctctcacgcccccctccactcatgcccgcaccctctaggggccctcctcaccctcctttcctcctggcggcatcccgtctggctctctgccacctcgatggctcctcgtctttcacgtcacgttacnnnnnnnnnnnnnnnnnnnntcttcgcccggggaagaccttctccccagaagctgtatcactccattgccctgaactctgcagctgacaaacatctattgtcacctctggtccactggcatgcttctctacccaccccattgggctgtggcttccttcagagcaggctctgtttctccatcgtctctgagtccagcccaggatctgactcacatgaactgcccaggaaacatggagttttggagcattgatctgagactcccaggtccaaagacactccttagcacagggccagtaagtccaggagagtctggggaggatccctggggggttgagatgtctgagctgcgatttcctgctttattcctttttacccactgctgattccctgttagccaggctaagtcacagcgcactgtcagagcctggaagaaggggagcagtgtctggcagaggatctagccagacttgtgggcccttttggccaggtcactaactgggctgggctttctgtaggtgctcacccacccatcacacagaccaccccccccaccgcaagagatggaagaacaagatcagctgggttgggggcccagacctggctcactggggttgggcagggcagtctgggatgctgtccagatccatcctcgcatcattccccagggcaggagcagcccgtagttggcactgacaccccactgttgccagagaagtgaaccctagaggcaggatcagacaggcagagggccgtcattcatccatcagcagcaggggcagagaaggaggtgcttttaaggggccccttcactctgcagcctatggggaggaaccctttactgtctcatggaaactcatcactgcacaaagaagcccctgaaggaaggtgcctcactgtctaccagtgtgtcccaggaaccatgttgcagaattctggtcattagggcagcaatgaattatgtctcttatccaaagccatcttttatccttccaaatctctccacaagagtacacccttcaggtccggagatcagctagattctggagccccagctgagaacagtttataaattaagactgaccaggagacaacaatatcaataacaggactatttcatcttagatctatcctttatggcttaaaagcactttcacgtacattagctctttaatcctatgaaaggcagggtttgctacccccattttacaggagaagaaactgtacaatttaagcaatattattataagttctgccttcctattgtcactggccaagtgagggacaagaagaggaaacgaatggaaaagggagtgaaagggaagggagagaacgacccaggagaaagaagcagagtggacatggaagactgattttagctcctagtctgccatcagatttgtatgtgaccttggaccagctgctccactctctgggactcagtttcctcattcataaatgggaagtcacaaaattgaagccacacagaagccttctgtggtgaacgctgctggtgaactgagaggcacagcatgcgtatagaagggtggagttgggggttcttcctagactctagccacactttggggcccccaaagaatatgggtttcctcttgggaattcctctggaagtataagatagcgaggtcataacattttagatgtgcctatttgaggccagttgttcccccatttaattctctctgtgttcctctcaggtaggaattgttatttatgtcctatggatgaggagcagaggcttggagagattcggagaggaaggacatccactgcatccccacccctgcccctaacacccacatgaaacaaaattccctgcctgggttttataagtaggagggacttataagaagctcagggcatgaatcatcttctgaggaaccctcttttagaattctagtcattagggcagcactgaattatgtctctcatccaaaaccatcttttatccttccaaatctctccctaagagtgcccccttcaggtccagagatcaatcagattctggagccccagctgggaacaatctctaaattaagagtcaccagcagccaacaatatcaataacaggactatttcatcttagatccatcctttatggcttaaaagcactttcatatctattttctgtttgatcctatgagagataggggttactactcccattctacagaggaagaaactgaggcacagagggaggctgatttgcccaagtttgcagagctggtcagtggcagggtcagggtagaaacccaggtctgtctgatgccaatatcaccgtattttcctctgcactttatccctttctggggacagagcacaatgaggtcagggacgccaaacaggaacttcctaaattcataattttgctgagctgagccctagaaatggaggggtcccagggtagagaacaacacaggggcagaacaatacagatactagggaccaacttggggacaggcatggggcgcacatactagaggcacaatgcctatgaaccctttcttccaggggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtaagaggggcagacaaggaacccatagaagaggggcgggaggcagacctggagacagagggatctcggtgagaggcaggtaggggacaaagacagggcagaaggagagatgagggacagggatgggggataggtgtgggaacaggcaggtggcatggattggaggacaggaagggacaaggatgagaaacaaacaagatgaggaatgggaaatacggatagagaaagaggcggacaaatcggggacaggaattgggacagatgaggacagagatcgcattaggaaagaagagagggtgaaaggcaggaagaagacacctgtaaggacaggcagaggacagcgatgtagcaccaagccaccaggatggggactgggacagaagaaaggagacaggagggcacaaaggtgaaggacaggcctggtggactgggaagctcctggcacatacctggggcttagcatatatttgtggaatgaatgaattaatgctctggtgaagtgtcccgattttctctcggggctgtcaggatgggactgtttggagggatgtgacggccttccctgccctccccggcaggtgtctgagtactggctgaatgacatgtatctcaacaaccgcctggccctgcctgtcaactccagccctgccgtgatctttgctcggcagcacttccctggcaccgatgaccagctgaggtgaggccttggtgctcctagctcataacctggggacccacccaaggcaggggcccttaccccagtgccagcaaagaaaggccaaagctggagcctcggctgagcttcctggggtcaaatgccccgagacagtggacgtccaggccatcaggtggggagcaaggttaggtgtggctgcactcgagtgacaatcacacaattagccttagtctatatttatcttgcagtggaatggacactcatggaggtcatgggtccaaatatccccacagcctccacctggctgaggccctgggaggaggcgtgtgtccctggaccacgccagtacttgtccctgggaaacactgccccaggctgtctgagagggcctctgcttccttccagagcccccagctctaaacagaggccccagaaggctggaaacaattcctccctgccagcagccagagcctgtgccatctgctgtaatttcagagctcactgagccgttggaagggcctctggccgctaatgacaatggaggatgggtgcagggagaaagggtttcccttctggagtcactcagagtctggtcttaagacctgagtggggcaaatggtggggacggtttagagggagggcagaccaaagtggcccgaggacaagaggcagggcccacctctcctctgggcagggcttagccatgctaggaagacctccccaccccaccctaccagctggccagccttccctcccactgtagctggggtctccccagggaagaaggaaggtgtggacagatgaatgacttctgaaaacagttctcacaattgcatctgagggggtattttcctcctggtgcaattaagccaggcccagaatcctggtatgacagttcccgctgctcgtttctccagtgcctttccccaagcactcgatttccttttcattagtaccggggggtgggaggaaagggaccaaattactggcttttcccaggagaaaattttccacaaggccaggggtcctgccctgtccagacccagggctggcttttccaaggaagaactccacccttcaccctccaccccttctggcctgctctgtggcctctcctagcttccgtctccctctctgctccctctcctcttcaagatgattccagtttcctctcccttccccaagagctgctcgacccccagttctcaccaaaggaccattttgaatccaaggcttgtggtgggctctcggcatggggctggggggcaagaaccacatctgattagtgcaggaaccacatctgattagtgcacacgggggcggcatacaatgggcgatcacagagtttggcagtggggatgagggagggaggagggagggagaagggagggaagaggaaggagatggaaggaagagggaaggagggaggggaggcagaagggagggaggagggaggaagccaggccctgggaggaagggctcaggcctcccttctccctgcaggtttgcagccagcctcatctctggtgtactcagctacaaggccctgctggacaggtaggactgggagggtggtgccctgttccagcacagtctgcctatgcgtctatctcccttgcagggaccttgtctttttccagctctgtattcccattcctggctcctggcacagagcagatgtccctgccccaacccactcccccaccatcaggatgacctttagcctggctggcctgtctgttaactgttccttttcctgtggcaagcaccatccttccttgatcttttaaaaatgtctcctccctccacacatacgtgcacaggtggagtgaattcacttgaagctggagaacacataggaaggcggggaaggaagagttgttagagtaaggtgatgggagttctgctttgccacttggaggaatggtgtctccagcgggagactgtatcctcaatcccaccaagctcagtggacatgaggctgttctgacagatggagagggctgctcaagcaccgcaggctctctttgattttaggaagaaagtccctctcctggccaagcttaggagagcaggagggtgtctgagagcagcagggagagtaagcgggtctggaggacccaagtctctcaaggtagagactataagggcattagaagctggaaggagagagagaggcccaaagaagcatcccttgcacagatgaggaagctgcagctcagagaggttaagtaactcatccatggttacacagccaggtggtggcagagcaaggagggggcaaggggcaaacttcactctttgttcaacttgactcaattcagtctttacccagccttgggacagaggctcagacccacagccccttccagggtagggctgttccctctggagaggggcaggcagagctcccagactgtcagggtggagcagttcaggctgtccagggcattctgcaccacacgctcctgtgtgctctgctcactcctctctaaatgccatgggtcactaggccctgggctgttgtctcctcatggtgtgtctttggtctctcccttcttcgtggacagcattctatttcctcccagaactcgcccctccagctcaccgtcctgtctgttttcaaacaccattgtcttgctgggcctggggacttggtgcccattcatcactgactgcccccacgagaccactttccttctgatcccagactttcacatgtgtgtgcacactcacacagacacgaatacccatgcatatccacgtggaggttcccatgtccaatgattgaaaaggacttaagactggaacattttcctgagtgcctgttttgaacctttaattaattaattaattaatttacttattcactttgcaatgtagttatgctgggaagaggaagagaaataaggcctcatcctcccctcaaaatgtccttagactattgggcaagacagtcacttaaacagacacaaaatacagctgtgtcccttcccctgagtcccacactcgctcatccaagcctcagccatccccaccggggtgtctctcagtcattacaaatgagccaggagagcttcgcctctccctccccattccccaactcctcccataccttgtcgagccatgtccgtaagtgcaccagcacatgccctgttggtgagtctgggaacctagaagtcacctgtgcttgttctgctttctcccttgcaccttcatgtaacccatggtgctcagatgtggtcattctccctccccactgtgtccccaagctccctcctccttccctgctgccctcacaagacatcacgttccttctctgccacaacctccttccttgttcttcctgtgacacctttcagtccattctccccatataagcagggtcagtaaaacaacaaaatggaaacccagtcatgcccctgcgtgctaaagcctcccaagggctttcactgcaccaagaataaggcgatagctcctctccactgccactggagccccacaggacctggcctgcccacctctctggccctgtcttcactgggcctcagccccactggcttctctctgcctttgatcagtgcttctcaagctgcctctggggaagaaccaatatattttctttcattttgtaaaatttgtgaaaaacaacaaaaaattgattactagaaaaacggtatgaaatatgagaccaaatgttttattacaggattcaacagacataaaactcccatcacattgctacaaacatttctgggttcaggcattacaccaagtcatgggtcagtcacagcagttcagtgcaatactcatactttgagttgcagtgctttgggacacttcacccttagggctcagctcaatcaacctgcctcagtgagactgcccctggtcaccacctcctgtccctgccaacactctgtctcactacctgacagtctcctgttcactggtttgctgcttgtggtctactccctacctacacatcctaggacttacaccccagtagagcaggagctgcatgtcttatttgctgccatatccccacatcccagaatggtgcctggcctatacggaggacgtgcttcacaaatatttgttggctgaaagagtggaaggaaggaaggatggatggacggatggatggatggatggatggatggaaagatggatggatggtggatagatgggtggatggtggatggatgggtcgatggaaggatggatggatgcttggtggatggatgggtggatgcaaggatagatggatggtggatagatgtgtggatggtggatagatgagtgggtggtgggtggaaggagggatggatgtttcgtggtagaagtatggtagatgtatggatatatggatggatgatggatagatggatgggtggatggatggaagaaagggagggagaaaggaaggataggcacaaggcatgctgagaccagagggaaaaagaacttcctgcattgacctcagaagaggcttctaaaagagatgataaaggagtaggctcttgaaggaggggaaggagttttctgaatagaacagttgagttctggggttggggcaaaggcacgccgagagaagatcagcataagcaaagatgcagaaggctaactggcaggctttgcacatgccgtgcatgaggcagaggtttgagaaaactctgagggtctccacgtgttgtggaaatggggcctccactactttaaaaagtggagaattgagctctgcatctgccatgatgatgcagttctgggttctgtgccccattttgcctgatcaagttacaataaaacccattctctgtctcccctcaccacccaccatcccctcgtggctgcctcccttcccactcctctccttcagccactccattcccactgactgtgccaaaggccagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcaggtaagcaaccccttgtcttggtgagggagggcacagagcatacagtggccatgcgttcacgtccattaccttctccgagggggctcagcctccttccctgagtcacacagggagctggggcaccatgtctccaaagtggggcccctacttccagtcagtcccatgtctctccaccagttgccttctaagaatgagagccgtcagtttgagaatatcctcactggactctcacttcagcactgatgcactgagggtcatgatcgagacctccacctgtacatctgttcttttccatgcagtcacccaggctctggcctttctggagaccacacacagacagacagtgttacagactgacaaataggacctttcatgtgtcagcctgtgggctcagcacttaacatgcattcatcccacttaatcctcacagtgaccatgcagagggggccttaggatctctgtgtgacagttgaggacatgagactcagacaagttaagtggtctgtccaagagtgggaaggaatcctgggtctggccagtgccctaaggtcatgctctaccccctgcagctcaggtcctcagactgggttccacagagccaacaaggacccatgggtcctgggggacaggctgagcatgagggctcctgacctcttccctgtgcccactgcactatatattccatatattgagcttcacataaatatttcctctgacaaacagttttgtttttgtttttgctttgctaaaacccaagtttggcaaccatcccagggactcccctggtacttgctctacaatgtgatcctgggctctcctcacatttttagtaagttgggagctctgtggagccctgacatctgagggcagctgtgacctctgttcctagatttgaaggccatctaggagctctcgcagcccacctgacaccttggccatagaccaaggacgtttccccatcttcattcaaaagtcaagccaagtatttcccagctcccacaggccaccgtatccacctcttccagacatgctctgggcccctgcacaagaccaggccatacagacactgctagggggttggaggggaagggaaaacaaggtactcatgtcaatcagctgaaaagtgtatcttgacctgggtctaggaatagacccttcacaaagcccaaggctctagccttcaaagctacaaaatgacaaaaccacagggctgacatacaaagcacatgtaggtatacatgtgaaggtgcacacacatgcacacatgtgtaggtgcacatgcacgcatggtgtgtgttggttttccattttaatcttcctctgcatatgattgctggcttgctttttttcctccactcaccagtgtgtttaaggcccatcactgtggctctatctgttgctaattcactcttttcaatggctgggtagacatgccctagacatatacaccacatttcacttagccattccccttctggagaacagtgaggctcttgctaccattttgctgttgcaaacaaggccgagaggcacattcctcgtgtcttccggtacacacgggtacgtttctctaagcctcaggctaaaatatgcatttataagtgcaattgcttagtcataggtatgcacatttttagttttgatagacactgccctccaacagtagctgtgccaatttatattccattccccacaaacataatggattccgtgaaccatgaaacacattttcttttggctaagtttaatgttgccttctttgattgggggcagcgtggaatccagcacagtcaacagccttggcttggtccctaaactgagactagaaccaccaaacaccttgggaaccttgggcctgagcatccctgccccaagcttacctgtgaaggctgagtgaaggcctggtgccacgggccacccaacaagtgacatgtttgacctgtttaccccacagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaaggtcagccgcagtgcccagcacatctccatgcccatctcatgctcgtgcccattggctttccctcctctagggttgggccagggcctcatccccatcagccatagtgtgggagctcagggcccacagcatgccctgcggccagccacagtgccttgccaccgaagccaccttttgtgccctcgtgttccatctgacagtatctggctttcttggtgggactaactagtgctggaattggggatgtctgagaatactgggcggggcgggggagttagctggaggaaggctggctgcaagtgagcaggtgtgttttcctggtgggtggcgctcactgatagtggctgggggagtcgctgaatgggggtgtgggatggagcctgcctctgggaaagtggttcaccacctctttcacctgatctctccatcctgggactcttcatcttcaagctgtcccttatcttgtggcactgttctgatgaaagtctccaagcattcccataagaaagccaggaatattcttgaaaatttttcatcacccttctggaaactactttcaaatccaaagctggtcctattccaggagctgatggaatgctctccttccttgcccatgttagagacactggatgagaagtaagacttctgtgagtctttatttacccctcagaattttactgggtcaggcaatctattcagactctccacatctgttactgagggccctgggcttggctcagggagtatgggagacaaaggagttgaggcctctacccaagagcagccccatgatgggaacaggaagagggggcatggggaggagactcacatccaggtgcatgcagtgctgacccacttcagacaggcgtcaaaaacgtgctccaggacttcagagaggggacggagcccttccgagtgggattgtgaaaggctctgttagaagaggtgggaatggaacaaagccccatggcatgagtgagaaaggctggagggaaggatggtacccaggcaggcagaccaaccctgggcaaagcccgaggcccagcagggacacacccaccttacccccagggtgaggaggagaatagctgcccagcaaaggtggcctgagccggatgtactgggcctattttttctaacagccacttgcattttctggtctctctctagaagggtcttcccccagatccagctggctccttgccgcacgcagagctcagcccaggtgtccggcctcaggcctgccttgggcatccttcccgcacactctgtcactgtggcccgttcgcttaccttgactctgttgctcactctctgaggacaactttgcatttgtttgataaatgctgattatctgcctttccccccacctcctacccactgcctataaggtcagaaggacaggggccttgtctgtttggtttaatttctgagaaacacagtctgggcccagttacatttattaaataaaagagtgaagggtgattaaaaatgccaggccccagacttattccccgacttaccaattaattattctttcatccaattattgggcacctcctgaatgctgtcataaatagggggctgcaggagccaaagaggggtgtgagagctgactgccctcccggacctaacctcgtgctggagaattaataacttagcattccgcagtgagttaattccctcgggagaccatggtgtaatcaaatcccactcttctccccttcagggacagagacaggcatcaaaataatcgcctctgcctccagcatagtttccactttattagcaggccaggcccaagacacgcccttcagggctggctggattgccccaaggtctgagcacttgggctgcagatcagaattgatttgttaatggcacttgatctggctttctgaatggaagtgctgtttctgagggaaatgcgacagaaaggaggggacacatgcgcctccccttgggtaatccgattaatccagttagcgccaactgtgtcatctacacaacaggaaactgatccttcacagatcccccctccccagagcagccctgcctatggaacagaaacagagagaccatttacaaaatgatttcggtttcccagtgaaagagtatggcagcttgggacagggttgagagtgaagatggagagaccagtgacgtcaaggccattgaaagcgagaacaattcctgggctttttatccgagccgtgagtggatgttagtgccatttagtaagatgggaaacagggtcggggagtgggtacaggatggagaaatcattgccacacatgttgggttagaggtgcttgggtcatctgggtggagacgtcaagcttaatatatatgtttggagcccaagggagaggtcagtacagagcaataaatttgagggacatcagcgcataaatgatccttaaagtcatggacctgggtgagataatctagaaacagaagaacagggagcctggaggtcaggtagagaaggatgcaaaggggattgagaaagagtagcccatgaagtaaaggaaagccagaagagtcacaaagattcaagacagagggaacggccagccacatggaatgctgtggagagctggaggaggaacaggacacaggggacccggcttggcaaccctgaagttgtcactgggcttactgagggtcagactggagtagcaggagaacaaatgcttgcacactgacagaagtgatccaacagcagaaagaaattgtcgatgaggcagtcagtgagttgaaccagtgagtatggtcgactttttctcagacattttgacactaaaaggagcagaaaaatgagggagttgctaaaagaggatgagggtcaagggaggtgtttttaggaggagagacaaatgtatggaaggaatttagtaaaagaaattgatgaagagataggagatgaatggaggggtggaattcttgcaaaggcaaaaggagatagaactcagaaaataagaggcctttggttggtacagggtgaagtggaaagcttgggcctgaggcagcagaggtaggagcatgcagaggctcccaactggtacctcctggtctcagatcacaaccttgagataagaggcgggcagttggatgttgaagatgaaatcgactgtgtgaaatagcctcctggaaagtgggaaagaagacttgaaaaacttgataagatttatggactgtgttgagctcatatatgaaggttcaaagtgatacattttaggagaggctaattaacattgttatgtgatcttccccaccaacgctcagctcctcaggttcagccagagttggtgagtgtaactggtagggacggtgaaggtgtggccaagaacggtcatgctggaatctgagctgagtaaggaagtgtgttcaagtctgctcagcaggttcaagtctgctcaggcagccgtaacaaagtaccacagactgggaggcttcaacaacagacacctgctatcttacagtttagcaggtgggtttctcctgacacctctctccttggcttgtcgatgccaccttctctgtgtgtcttcatgtggtcttgcctctgtgcgtatctgcatcctaatctcttcttataaggtgaccagtcatatgggattaggcttcacccaaatggcctagtgtaacttaattgtctctttaaaggtcccatctccaaatacagttacattctgagcttctgggagttaggacttcaacacaggaattttggaacgacacaatttggcccataagaggaatgaagtgacagacagggtaaatgacagatggtgagagcatagcagggccgaggggtttggccgtctcagtgacatgagatgtgttcagtgggtatcagaggatgtgaactagaaagccaggaatgtggtcagagtgtgggatgcttgaaactgagactttagaggtggtgggctcatggtagagagaagttcccagatgtgatactggccatgggtgcaggggtgagactgtcaaaggtgtggagatggaggagttgggagaggaggatggagactgggcgtccacatggatgcacatactaccataacgatgattccagtagcatgggggaagcaggtgaattgagagcccagatattcatgatggggacctaggaagatattggcgcagcacagaaacaagggggatgatggttattgggggggtaaaacctaacagctccagctccaaaacaaagtgggatgagggagggggagttgtttagaagcaggaacagtagaaggaagctgtctaccccacctggccctggggtgcatgagtgtggaggaaaacaacagcatgcttgagagggtggcaggggagcgggcacctcaggggagcacccctcgggaagtgccacattgcagttgaggcaaagctgggcagacacctacagaagagtttagccatgcaggggaatggcccgtctgagacaggcatgaagcgctccagaaggagtaaaggacaagtgtgaggactgcatgcgcgtagaggacacatggcctggggagtggggtgatgggggagccagggagcccccagggtggttgcctagtgtggctgttggggctgaggtgctttctcacccacagcagtatcctgattaactccacggaaagggttgagctattttaggggagcatagctcccaaccctctcagctgaagccctaagatcctgcccccacttcctggagcctgggtacagggacagtgctcatgggcacagagtccaggcaagcactcactggcaggaggccttggccaagctgagctcctctcagcctggtggaggtctagaccaaggagcctgcgctcagatgaaacacttccccggattctcatgtggtcaactaaggcctggggcaggggcttttccaccccaaccctccattttatcaacctctctccttcaagacactgcccttgagcctccaccctgcccccaaccaggatgactccctcctgtgagccccaggctgcttagcctgaccctctgccacgacactgagggcatgaggcccacagggttccagggactgccagggtggcacagcccacgtgcaggggagcagggctgcctgccgcacccctcagctccagctcagacatgggctcagacacggtgcaggagtgtgtgcactgacatcaacgaaggtggcctgatcatccacaggccactaccagtgtcctctgggggcccaaagcaccaggatacacaggctaaaccaaagcagcaattcagacagattcctgaggggctgggaggccacgtccacagaggaacttgaagctaaagccaggtgtgctgaggccagtgtgactcagccctaattgcagactggggttggatgatgacatcaggattgtctagagcattccttaataaaacaaaataaaacagattcccgggccccagtgcttttccagagggacagagtggggccaaggaatctatttttatagcactctggtgttttcatgtgcaggccaggctgggacctgcttactcggatattagcagagcatccaggtccccctctggcttgctctttcctgggcaccttctgtcttttgttacacctgcgaggtgggattttattcccactgaaccgaggaagaggctatgtctgtctcctttaggggtggccgggggtgaagcaggatctgacactggaagggagcatctgcctagccagcctgagacctgcagtgccagggaggccaggtgggattctgaagacaggcttggggcctcagagggagcctgcacaccctattaggacctccctccccactgcctcgaagctgtggccttcctgaacccaggaggagccaacccgttatcctggtctggaaatttaattagacattcagccccgagtctgggagactacagcacttgtcaatttgtaggaaaagaatggccagcttggagagccccccagccctctggctttcctgggtgctgccgtgaagagcctgtgaccagacctcagaggcagatgcttttcgtttacacagtcccgtaaatatttatccccgacagtcaattagagctgagccactgcttgcaaggagggaactgacagaaggcggctacagctgcagaaggccatggtcatggtttacaagaaccactcaggatgggggcattttgctatttacgtatcgtcatccagagctaggcatgtctgctgattttaaaaccaattacacattagcactaacagcctctctgatttaattggcccagaaatacctcccgagctctcaagactgaatgtgattttcttgctctggaaaggggctgggccaatgcctccctccttcagtaggagaatgaaggcctttagggacaagagcatccaggcaggaaaggcaagtggtccagggcaagaggcctgcccttaacctaccacggctgctgtctcctggggcctgggcttcctagtctatatgaagatagcagtctgccctgtgggcaggaccaaggggatgggcggtaaagcagatgggctggcgcctggcacacagagggtgttggctaaatggtagctcttattagatttggggatcacgctggggatgctttgcccaatgcccacaacccctctggaaaaatctggtgaacttgaacatgagtactgtccttgtggtcagaggcaggggcccgtgggccctcaggctgctttgctctttgcatggaatcctaatccctatgaactctgtggtgcattttgctttccctgggccctccacgtaccactctctctgtgtgcacacacactgggctcctctctttaccttctccctagtcaccatctctctggccctcgttttccattttatgtgcagcacagtaatgtttggggtacaagatagctaggaggtggttttttttgttttgtttttgtttttgtttttgtatctcctgcctttctcccccaccatcctttcccccagttctggaagcctgacagctctttataccctctgcctttgtgggaagagtggttagaacccagaagaaagaacacttcttggttcttaagttcttttttgaaattaaattgtacttattttgggataactgaagattaacatccagttgtaagaagtaatacagagatctcatatgtacccatcttccaccaatggtagcattttccaaaactatagtacaatatcacaaccaggatactgacattgatacagtcaagatacggaacattccatcaccaccaggatccctcttgctgcccttttataaccacacccacctcacccccttcttaactcctgggcaaccacaaatctgttctctatttcaataattttattgcttcaggaatattatatacatgaaatcatatagcatgtatgatgcagggtctggcttttttcaaacagtataattctccggatggagatttatccaaatcgttgcatgtatcaacagttctttcctttttattgctgagtgatattccatggtgctaggtatcagtttctttcattgtttacccatcaaaggacatccgggttgtttccagttttgagctattaaagctactgtgaacatttgtgtacaggtttttgtgtgaacctatgttttcacttactggaagaaaatgcccaggaatgaaatttctaggtcacaccataatagtatgtttagttttttaagaaactgctaaaatgttttccagagtgactgtaccattttacattcctgtcagcaatatatgtataatccagtttctatgcatctttgccagcatttggtggtgtcacttttttttattttaaccattttgataggtgtgaagacaatgcaatccaccacattaacagactaaagaaaaaaataacatgattatattaatcaatacagtaaaagcatttggcaaaattcaacaaccattcatgataaaatctcttagagaactaggaccagaaaggaacttgctcgacctgatacggaacatctacaaaaagcttatagctaacatcttatttaaaggtgaaagactgaatgctttccccctaagatcagtaataagaggatacctactcttaccactctgtttaacacagtattggagttctggccagtgcattaaggcaagaaaagggaataaaagggatacagatcagaaagaaaaaaattaaatgatccctacttttatgaaatgattatgtatgtagaaaatagtagcaaatctacaactccaaaaactcctagaatacatgaattcagcaaggttgcaatataaaagattaacgtacaaaactcaattatagtctttcgcctttaaatatgatgttagctataagctttttgtagatgttctttatcaagtcaaggaagttcccttctggtactagttcaataagagattttatcatgaatggatgttcaattttgtcaaatgtttttactgtatcaattaatgtaatcatgttatttttttctttagtctgttaatgtggtgggctacattgattgattttcagatattgaaccaggcttgcatccctgaaatgagccccagttggtcatggtgtataattcttttcatatattgcttaattctacctgctaatatgtagttcagtattttttccatctatatttgtgagggccactggtctatagttggtttggttttttgtttgttgtactgtatttatcttcttttggtatcaggatacctgtttcgtaaaataaattgggaaatgttccctcctcttatattttctgaaagagattgtataaatgtggtatcaattcttccttaaatgtttggtagaatttttcagtgaaattatttgggcctgaagatttcttttcggggagttttaatgttgctaattcaatacccttaactcatttatgcctagtgttccattattagaacgctaagcttgtgggagttatttatgtcctactgcttaaggtcatcaccaaggtctgatttttcacacaaaaaaatttgcaacctccagcataaacgggttaataattatagggctattcaaataatcataatattcaatgcattgtggtagtttatacttttcaagggattggtccatttcatgtaagttgtcagatttatgtgtatagaattgttcatagtatcctcttattatacttttgatgtctgcagggtctgtagtgatatcctgtttcattcctgatattggtggttgtgtctttctccctctctttttttttttgtcagtctctctatgaatttgattgatcttttaaaataactacctttctttttgttgattttttttcctgttttcaactgtattgatttctgctctttattatttccttcatcttgcttgctttgggtttttttctgctcttctttttctaggttcttcaggtaagaaattattgatttgagacttttctaatgtaagcatttaatgctataaatttccctctcatcaatactttagctatatctcacaaattttcatatggtgtattttagttttcattcatttcagtgtattttttaaatttcccttaaaactctgatatggtttgtctctaagtctccacccaaatctcatctcgaattgtaatccccacatgtcaagggagggacccggtgagaggtgattggatcatgagagcggtttcccccatgctgttctcatgacagtcagtgagttcccaggagatctgatggtttaaaagtgcttggcagtcccccccttgttctctgtctctcctgctgccatgggaagaaggtccttgcttccccttcgcgttctgccatgattgtaaatttcctgatgcctccccagccacgtgaaactgtgagtaaatcaaacctttttattcataaattacccagtcttaggcagttctttagagcagtgtgaaaacagactaatacagactccctctttgacccattcattgtttagaagtatgttgtttagtttccaaatgtttggaactttttatgttatttttctgttactgatttctactttgattccactgtggtcagataacatattttgaatgactttaattcttttcaatttgttgagtgttgttttatggccctgggtatagtctatcttggcatatgttcgatgggtatttgaagagaatgattgatgatattgttgatttcttctacgtccttgctgaatttctgtctagtcgttctaacaactgttgagagcggtgttacagtctccaagtacaattgtggatttggctatttctcctttcagttctgtcagagtttgtttaacatattttatagtatgcttggtatagatgcatttagggttgccatgtcttcttggaggatttatccttcacttttatataatgcccttctatgtctctggtaagttttctttgctctaaagtgtactttacctgacattaagatagccatttctgctttcttttgattaatgtttgcatgctatatatttttccttccttttacttataaccaaactatatcattatatttgatgtgcacttcttgtagacagcatatagctgggtaatgttttgtcgtatattccatcaatctctgtcttctaattggtgtatttagaacatttacactttacataattatcgatgtgttagggcttaactctgatattttagtttttattttctgtttttcaattattgttctctttctcttgccttcgtgtgggttacccgaacattttttagaattcaattttgatatacctgtaacttttttaaaattatctgtttgtatagctttttctaacagtttctgtaggtattaccttgtatatacataacttatcacagtttattagtgttgaaatgttaccagttctagtgaagtgtagaaagcttaccaccttttattctcctttgtttataatacacttgtcttaaatattatctctatatacatttagaaccacatcaggcaattttatgatttttgcttcaacattgaaacacagtttagaagacttaaaaggagaatgaaaatgaatttatttactcagatatttacctttcctattgttctttctttcttcttgatattccaatgtttctctttttaccatttcttttcttttaaaaaaaactttcttagggaccagctgcagtggctcacgcctgtaatcccagcactttgggaggctgaggagggtggatcgtgaggtcaggagttcaagaccagcctggccaagtagagacaaaccctgtctctactaataatacaaaaattagcctggcgtggtggcaggcgcctgtaatcccagccactcaggaggctgaggcagagaattgcttgaacctgggaggcggaagttgcagtgagccgagattgggccactgcactctccagcttgggtgacagagcgagactccatttcaaaacaccaaaaccaaaaacaaacaaacaaaaaaacactttatttagccattctttcaggatatgtctgcttggcataaattctcttagttttcctcatatgaaaatgttttgatttccccttcttcatttctgaaggatattttttcttgatatagaattctggattgatagttctttttttttcagcacttacaaaatattatggcaattccttctggtcttcatggtttctgataagaaaaaaaaatctgctgttgtcctagttgcttttctcctatagaatatatatatagtatatatatacacacacacacacacacacacacacacatatgggtgtgtgtgtctatgtatagatacatgtgtatatatgtatatcatttctctcttgctgttttcaagatttttcctttgtctttatttttcaaaagtttgactatgatatgttttggtgtttgcttctttgaatttatcatgtttggggttaacttaccttcctgaatctttagatgtgtgtcctttgccaaatttggggatgcgttagccattatttatctgagtcgtttctgctctgccctctttctcctctcctgggaatttggtgacataaacatcaccttttgtctcaaaggtgccttagactctgttccttttcccccagtctaatcagtgttattccgtcttcaagttcactgattcttttctctcctccctaggttctgctgttgagtccatccactgcgctttctatattggttattctattattcagtcctaacatttctatttggttcttcttatatattttattttcttgctgagaatttgtttctttgtggagacttcttttctttttcatttgtttcaaatatgttaaaattgcttgttgaggcttttttatgattactgctttttatttattttattttaattttatttatttatttatttgagacggagtctcactctgttgcccaggctggagtacagtggtgtgatgtcggctcaatgcagcctccgcctcccgtgttcaaactgagattttcctagttcttggtagaatgagtgattttctgttgaaacttggatatattgtgttataagacttgggatcttatttaagcttgttttaactggcttcctctgacactggtccagcaagagaatgggggaggttataacgaggtggaggtggaagcacaggcacttcactgggtctctgttgacaccctgggggaggggactccttattactgcagggttggggggtggaagttcaagctccctacacggtctctattaatgctgtgtggggaaaaggacggagggctggttattgctcaatggagatagaattctcagcttccatctgagactgtgccttctctgataccccagaagctgagatgcctcattactgactggtgatggtagacatctgggctctccacttggcctttgctggcaagggtgctgggggagggagggatgacacggtttttctctgtggtgtttggctgaagtagaacgcttattacctaaaagttttatgtcttgctattctgatcctttgactagagagagcaggcttttgttgattattttgtttgtttgtttgtttgtttttaactatacccacttgtgtttttacgttgctgggttcttcaatgcaaattggatatttcaggtaaaaaacaaaccaaaacaaccccacagtgtattagtctgtagagctggcataacaataccacagagtggaggcttaaacaacagacatttatttctcacagttttggaggctggaagtccaagatgaaggtgtcacagggtaggcaactacaagccaccttctcactgtgtcctcacatggccttctctctgtgcacacatgcttggtatctcctcttcttatgaggacaccagttctattggattaagaccttatttaactttatctctgtaaaggccctccctccaaatagagtcacactgagagctgaagcttcaacgtatgacttttcaggggacacaattcagtccgtaatacccagagaatctgctgctatgatgttccttgggtcctgaggtccctggctggtctgccttcctctcgccatctttcagagtcttcttacttttgttttgaataaaatgtccaagtttttagcgggaggaatggggaaaagtatatgttcctggaatcggaagaccctctatccagagctctttaaaggtgcctgatgtaactcaagtcaaagcagttctgttttgcaagagtgagaaatacttttgtttgaattctcatagtctctgaggactgacagcataaagatcaccccctaggccagagagtcgggaagaatatgagatgtgcgatggcagatttacctcccaaaagaaaaaagtactccttcatcaggggaggaaagatgctgagataggattgggaaaggttaagaaggtctaagcccctgagaaagatcccagttcatccatctcctggactgtgagaagggggatgggcatggcatagaaatctgacttgtgctaacttctcagggaatagatcagagcaagcaaaggcaagtgtcccaaagagggtggtatatgtccgggggtacttgtgcacagtagtgcacattaaagaacatctcctgagtcttgcagccctgcacagagagagataccaggtgctattttgtctgtgctcatcagagtctcagcctgtaagcttccaacctctaatgccagcctcagggctccccgaggcctcctggcctctggaatttccacactaccaaagctgtcagctccctccttgggcatgggtgtcagagcaggctcctcctattactcaatccccacctctcactattacgccgggctccttgaggaagattgattcgccactttaaaggagcctcgatgtgctcgatgaggatgccacaagacaaatggctcctgccgtgcgccttcagcccgttgtcccatgtttccattacatttgggccacagtcatggtggatgagcttgggtgtagtgctcattttctgccttacatgataaacttgtcagcatttgactgatcagctacttatatgcagggagttcatttgcaaggccacctggctccccgctctgttgtcctgctcccattttaccctgtctaatgagccaggacctggttcctgttgggcagcgctgggctcctgggccctgcagagcctgcacatgatggcaaggcctcagtgcctcctcacaatctgcctcccctgcctggaggtgacaagggcagtgatgcccagggagccattctttcctgctgccagccttgcattgcccagttaaaaaggagtgtgccaggcctccactctcctgcctcgagcctgcatcaaggcctgctctcagcctcctgactgagcaggcatgctgtgggctgcctcaggagctgcagtctgcccactccacactggctttggggctgtttttaaggatcgcttagtgaaggcagctactaagccagggctctcagagttcaccctgaggtatggccaacaggaatgaggtgtacagcattcaagctgcctatggccccggcttggctggccttcaggcccatgcctttcccaagctgccaggtatcctagactctgctctgaccacactgagctcttccatgatccttcagcactccctgttgttgctggctgaagtcacatgactgagctgggcattcatagcccttgttgatgaacctgagcactggggttggatgcctgagatcaaacccagctccctccacttagtggatgattattatcatccgtgtttacaagagaaaccttgtaaatggcctaaggtcaagatatttggtttctctggtcctgacctgtaaatgaggcatgacaatgatacctatcttatatgcatcaatatgcatgtttagattgatatttggcacatagtaggtgctcaacaaaggttagctaatagcatcacatcattatgttcttccagccccacctaaatcctgcatgccctcacccataagctggaggtcaagccgatcactcacaagctctgcttacaagcctggggatctgttctccggccatccaaaccactgtcccaccctccatccaccaccctgcactactatacacctcctggcatgcctctcccttcttctttgctgatctgaacctgacccagacctggccaaggcctccccggggctctgaaggcactggctagcctgagcctgcagggaccagtagcacagcacatagtgcagggcgagcactatggccatctgcagggatgcctaaggaggggagaagggcagagcagggagccttgcaagggggaagaagccctaccttgtcccagcctcaccctacccccactcccccatcaattcatgaagctcaaagcctcaaaagtagttgggttttgcccttcataaggacatggcctttccccttcccattagccagctggacacctccaggccccctgtctgaactgggtccacagatcccagccctactttgcccaggccaagggaagcacactaaagtccattacccagcatggactgtgcttgccttgttcaggaggcccaggccccaccctcagtgagtgctgatatgggggaggggaccagaccaggggtccaggggctgcaagtgctgactgtccaaagcacggtggtctgggaatggcattggggtcatgtgctgtgcagcaggggctggtggtcagggattggggggcacctctgggctcaggtgctgtgtgaggctggcctgacaagagtgcaattccacatctgcactgagcaagctgtggaggccacgtgctcagggtgttaggagtcctccagggcagggctggtactgccagaggatgagggagctcagggagggctgtcatagacagaggaggagaagggccttgtcctgggcacagcctgcgtgatgatgaggagatgggatgtccacaggatcagggaggggcaggaggttgtctgtgaggtccacgcagggatctagggtgggaaggaggtggccatggagcccacggtgccatgtttagaaatttggattctcccttgtgggcggtagaagctgtttcaagttctaagagggtaatgtggtgactgcacctccttaaggagcttacaggaaggggagtttccccagggcctgggctggctctcatttatgcttagatcctcagggcatggccggatccttgatgctgatcagactgaggcagggaagcccaagaggccatgcagagagtgaggaggcatcctgccctcatagggacgaggaggggttctgaaagcacagggctcccaaagcctcatcctcaacaggagggaagagaggatgtcccaaggctaggctggcttcccagagtagaaggtctgctgtgggagacatctccttccccaggatttgcaaaaagtgagggaaaggggatgcatggggactggagactcctttcaggcaagggcatctgtggacactccttgtgaacctggagaattcacctgggcagagcgaagaccagtgcagttagcatctgtgtacacagcaggcattgagaagacctaggggatggtcttaaagatttactaaccaccctgggaaggggagctgtccacatgcccaaggaaggcaaaacgcaggcgagagctcccaccattatatctgtgatccaggcagcaggatggaggaaggtgggaagcaggacaaagagcacatgctagttatctttgaggaggttccccggaagctgtggtgtagttttttgagatcttgctcatagaatttagacacctggttacccctagctgtaagggaggctgggaagtatagctctagtttgttatccatgtaccaagctaaaaaccaggggttctacaagcaaggaaagaaaggacatgtggtgtgcaactaggagtctctaccatgtaatgaacctttccctgcaaatgccatgcacccatcttcccacacacagagcactctcacccctgccctgggtgcctcatcctgtcccagcatccagcccccaaggtcaggctctcctggtgatacgcagccctcaccattgggtcttgaagtgactccttggaattttaaaccaaaatgttaaactttgggtggactttttaacttttggtgaactttaaaccaagaggcaggctgtgtacccccacacccagtaccgagcagtggagagaacatcgtcagcacaatagactcctgtttggaagaaatgggaacacgcagcgggagcaggcctggcccccaacaggtcctgccgggtgggcttggtgaacctccctgtgccctgtggaggaagctgccagggagggcagcttctggtgctctctgggaggaacgcatgtgtccttggtgaaatcacgtgctctgtgcctgactcccgctcctgaagagccgtccttgtctgtactcttccagtgccaccagggagggggattcccttttgagacctgcttactctagaagaatgtctagaggagcctgggaattggtagaggctaacacaaaagccagctgtgggccaggcttggagctcctttggatccatgagtccaaaactgcccctacaagctcatccagatgtgggttcaaggcagcctggcccttctgcctgcagctctgcctctgaaccaacagcttgggggcagggaggtgaccaatacacttccttcaggttttaatgtgaaattgcctaattttgaaattgcaacaacaattttgaaattgcagtttagatgtctgaaagtcatagttcagcacaaacaagcatgcctacacacagatgtggctcacaggagccccagtggagggtgctgttgggtgggggattaagggcccttccactgatgtgggctgacatgagggtctaagcatcccgcttcatcttggcatgcatgaccaatagcccacacatctggaggagagctggtcacagctggagagcagggctcctgcagggaccgtgcgaatgagctgggatcctggggtaggacagaggctcaggacactctggctgacttcactgcccacccacagtggggcaaggtggggggtcagggctggctcaagacctgggtcttgttgtgatcccagaagacagggctgccctgccctgtgtggggctctgaggagggaagactggcctggagcgggacaggtgctagggctgtgcctgcctcccctgcagactccaccaaccgggactcgctggacatgattgagcgctgcatctgccttgtatgcctggacgcgccaggaggcgtggagctcagcgacacccacagggcactccagctccttcacggcggaggctacagcaagaacggggccaatcgctggtacgacaagtccctgcaggtaagccgtccaggtggccctgcaagagcacagccatgcccccagcgagagagtgagtaggcaagcgggcacagcctggtgcccaggcccgcacgtgcttgtgtctggcaggcgcactcactggtttctgctgcctaagaggctgggtctgaggggtcaggagagctggaggggtctgagatgtgctgttgatgtcaatctctggaccagccagaactcttctcaggagccagtggccgaacccaactcaaactccctaaccttcctgcagcctgtgccaggaaggtctgggccagacctggggcccatttcccatcacccatcacacctgtgaggtgggggtgtgccaggagtaggagagtataacagccccactgaacaaatccttaatgcatgctgaaataataatttctgatgcccagagctgtcagctttttggatgtccacccccgtggcctggcgatttcaacatacctccctcaatccctgagaagtagaacagcccagcatctccatggaagaaagactgtaagatgagataaaataattcatatatgttcatttacatgacatcagcctagaagcaagaaatttactttgacctagagaaaaatacccatgcagacgggatgaagtcaaggtcaaaccattcattcccattctgccatcctccttttattcccccaacatgccaatcctgaacctagtcttgtttattttaaagtcactacacttttatatgatatgccatgtagtataaaacagcaggcaaaaacaaaacatctctctactttgggttagcaaagctcacattgataagcatatctagacaacacctcgttttcctttctctctgtccctacattctgcaggttttcctttttattggtttgcatattgattctgttatttctgatgcgctctccagctgctgggccagctgttttagcctctacagtggtgctaatggcttatcatctttcatggagctgtgggggtgaaccgatataatacatgcacagaatctggaactcagccttggtagcagttttcaaaagacaccgctttccttccttccttccttccttccttccttccttccttccttccttccttccttccttccttccttccttttagtgacaggcacagataagtactaatgtggggggtgggtgcagccctctccaccacctctcatgggttagtctatgctgacctccaggttcttttcatcagcagggcagattatcaggcgaaccagagaagccagcagggcttcatggacctgaattcaagatgatggagaactggtctcaggatagcaaggcaggggacactgggggcgggaggggagggcctgcaaagggtgagtttggggagaagctctgtgggaagtgagtttctttgtagaatgtgagtaaagatccagcctctggcacacaaggcaagagattgggaggagaccccgatgtgagctatgacaggaaacagggctgaagggcctcacccaggccccaagggcagctgggcagactcgtcctgaggatgaactcctcagaaatccctggactgctcagtccgggaacttggggctccaccttcactgcccacagcttttacgggaaagaggtcgtgagtgcagagtagtcttggattctcatattctcaggccactgcaatcacatgcagtgttctcttcaggaaataatgtgctctggtgtccctggagaagaggtgccctgagaagccaggggcctaacctggggccaaggggctgccttgcaatgctgactctcccatgatcgcccactccctctttcctgttgcagtttgtggtgggccgagacggcacctgcggtgtggtgtgcgaacactccccattcgatggcatcgtcctggtgcagtgcactgagcatctgctcaagcacatgtgagtctggatcccagggctgccatgctgggcccaaaaaaatgtgggtggtcgctgggggctgtgtcagtctggaaagcgtcttaacaaaagatgaatttgaaaaaaatgtgtactatacacacacacacacacacacacacacacacgatgaatttgaaacccagctttgtatgcgacatcatgtgcttcacgggccatggataggaggcagcagatttacggcagtcagggagaagcatggcaaggaattctcaggaacctctgccttgagagaggggaagcctacatcgatacctattgcttatcctgagtcagggccaggcccacggctgccccagcacagggggagttctctgagtctcactgcttccaaatcccaaggctgggtccctccttagctccccagcagggttcctctgtgccctaaacacatggtattccttcctctattcccaattttacccattctctcctagaatcttctccctgcatccaagtcttcaatttcttccatgaaactcagggttactgaaacctaaaccaagcctagtaggcacaaaccttgtagaagagaacaacacagcttgctcttaaatttctctccaagtcttctgtaagggtgtaacatggtctaataggaaaacaatgaaaagaaataatgggttttggagtcaggcggaactggatggagccctggccctgccacttaatgattttggtggcctctctgagcctcagtttattcatctgcacggtggttcaggggcagctcgtaccccctgaaactccatggccgcaaacactgacagctaagatgattgcacagagcaaagaagagatgcctcccacagctgtctggccgcagagcctcaggaggttgcctctgtgcccgcaggacgcagagcagcaggaagctgatccgagcagactccgtcagcgagctccccgccccccggaggctgcggtggaaatgctccccggaaattcaaggccacttagcctcctcggcagaaaaacttcaacggtaaggataaccgaagtctcctttgaggggtcccctagggaccaccccgcccttgcctactagctcccaaggctccctggaagtttccaaagaccccagctcctctgcctctccttgggctccacctcgtccccatccctcatgtagtcaaattaaaggagagatacaactctggggaaataaccttgctgaagtatccatcatttctctaaaatgcaaacgcagggctattttttttttttttttttttttttttttcagtttcacctgactgagcagagtcaaggccgggaaatcatcccctgctttagggggagtaataaacaactggtttgaataggtcatttgaattcaagctatttaaatttgcttgaatgtacagtgcaacttgacaaaggggcctttttccccaaggggagggggccgttcaggccctaacgggacccaggcaggagggcctggggcagcagcaagcagtggtggcagccacatcctggcaaccacgtctgcactgtagctgttgattctcccattcagtaagcaagcacgaatgcattcattcactggtttgctcattcattcatcaaacatgtgcagagctctggtgtgcacccggcccgtggtaaggctctgagaacacagaaagttaagtaccatgggacctgcactccatatttgagtggaataagtagactcccaggccaaaacgtgtgatacagtaagattaatgccaaaagcagaaacagccatgctgacctgaacccacaaaaatatagaagctgaactctgtcaggactgtgagggagggccttgtagagacgggccttgaaggatggataggagttcatggtgcaagcagatggggaagaggcagaaaggcagcttcttcaagcttgtacaagttcataatgatgaaggctggtttggagaccagcaagtgagagaatggccagagtggggccacaaaaaggaagttgggccacactgtgatgagtgtcactgtcctgttatgggcctagagcctgccctgccactggagggttctgtgcagggggtatggggacgcccctgaggaggctgtgggaagggcacatgtgagcaggacagagtgtggccaggctgggaagctgaagagcgggaaggacccatccactgggagctgctggagagggtgcctggcttcagtgggcatggaggggcctcaggtgttctataaagtggtgctcacatctcagctttgcagggttgttcaggagctaagtcaggggccaaggcagtgagctggtgggctgctgagtcctcagtgggtaaaggagtccactcacttccagggacctgagcagaccccacattccccaaggcccccagctccaccctccagaggctgaggagagccaggaaaggcccatggatggggaagaaggaggcttcttcctgggggtcctgaggggcccatacaagtgggtgaggcccgagtgggcacagcttgggggagagatttccaggtggctgtggtgatagtgagctcagtctgtcccagacgtctgtcaacaggtaggtctaaggagcgagtactcatgggaactgggtctcctccaagtccccctgtgttcctagcacctggccccaccgagagctgagctgctgtgagcaggaggaatacttcaaggagaggcaggcagggagcatggagtcccgacagaaggtgtgcgtgtgggctcggggttcccactcaggctatgcgctctccagtggggaggcacatagaccttgccagacactgctccagtgggcagtcagctcagaccccagactcctgatggaggaggagattgttcaatatgagggtcagccagtgctccagagtctcagtgcagacttggaaaatgttcctgttactccgacagtgaattacaaaatcccgggcatgtcacctgtgtcacagttaatccctgactcactaacacagccaggcccacctccccacccactctccagagcagggccgacaccccactcagctgagctcaccttgggtcatagtagtcctggcctggtttgtcttctgacactttcataggtcaaggcatgtctctgacacctcagtgcactcctgaagggcagggactacgtccgcaccttccagaacgctaggacacagaccaggctctagaagcccggggaaaccccagatgcatgcatactgttttgcatgcaataaaaacatcttttctttttcttcctcagaatagtaaagaaccttgacttcattgtctataagtttgacaactatgggaaaacattcattaagaagcagaaatgcagccctgatgccttcatccaggtggccctccagctggccttctacaggtgagtgaaggtggagtgagtctgtaccctggagggctgacggacacagtgctgtaggatctagggtctagaagcatcctggagggagggacagccttctgtgggcctggaagactggagagggactgaggctgcatgaaggaggagcagactgaactgggttacaaatccaacctcagaacaagaaggatgtgccatcagggaactgcctgggtgatggcacaggggcacggagctccaaaggactggagtgtagagctgagaagagccaggaggggatgaggaccatggttggggttggggggctgctctccatcccaacttcccccacctcacccaagccctattgctgcaacctgttcctccccagtcttcccaatcttgctaaggaaatggaaccagcagctcccccagctgatcaagacaaagattttggactcatccttgattctgccctttctcgtatccccgcacactgccatatccgttctcctccaaatgtctctcacctgccctccacctccactgccattggcccctcccaggccaccatcagctcatgcttagccaacggcagcacttccctagggtcactgcttccagtgttgcccctggtaatcctgtcttcatgaagagtgaactttgaaatatgcaaatcagactagattactttccacatgaaacttcccagcgccttcacaccaggcttagaacaaaagacaggcttagaagtgccccctgtggactggccccacctgaggccctcccacacccccagctctctcctgcctcctgacctttgccctggctgtgcctctgccacccacggaaggtgtgcgtgtgggctcagggtcaccaccctccacacgcaccagccctttccagcccagtttccatccctcgaagcctttccccacccccttatctaaagcagccccctgtggcccccttgccacccattctctgtcataccacattgaattttctttttctttcaggcagttgttacttctgtgaattatcttgtttgcaggtttgctggctttgttttctagactatccccgcgaccctgacattctgggcatctcgcatgcctctgagtccctagcacccacaccatacctggcacagagtaggtgccagagactgaatcacagacgggaggtttagccagaagtggtccggccaggtctgggatttagacctggtggcccaggtagctgtgtgtcggggaaggggtgaatagtagggaaatcaggagtgaaggcaggggagaggtcaattagccttacaggaggcgaagaaaccaaaatgtgaaatagatcttcctggagatggggccagctcctgacagttccagggctgcagaagcagcggctcatcaactgcctgctatgaacggtaaagctctgccctccaacctgctttcagtttgcaacttccatgaagggcataaagttaccctgcagtaaagctagggcaaggcattctcactaatgaacaggcagcacccgtgtagacacagcagcccagtgtcccctgcggggctgtaattctcaaggaagtgagtgcagccactttgagtgtctgtcctgtccggacaccttggggaaggccgatgtcatcccacatgaggactgggcttgctgctgagacttgaagaggcagaaacctcaccagtactgagatgctgcaggacctgcctggcatttggaatggtggtcagtgccttctgatactcagagggcatggggccgagataggccgtgaggtcagcatcctgccagagcctcgactggggatgccactaagaccagctgctcgggacctctctactatgagcacttccaagtttcagatccagagctgagggggacagtgcagcctgcacaatgcacccctcctcctcctgcctgtgggctgtgctgtcactggacaaggccaggaaaggacatagccagaggctcctgggttcatcgaatggccaaagaggatctgcttcccatgagcagcattcttcaggctctaagctgtaataatcacaattgtttttatctgcccccagattcagcagaaacctagaggctgcctgaattcgggttggtcaatgactggccagtgatggtgtttgcctccagggaccatagagacaggacaggagctccttgccagagtcttggggaaatatgtcagagtgtacaggaaggtcattcccttgctcaccaagcaagacagtgtcacacaccctgcagacttggacatggccttcccaaacctccaggagcccagccagtgagggagagacatcctgagagggctgagatgtggggccacgacttgctgggtgacattgggctgtcactgcttctctccaagctctgtgtcttttttcctcccccactcccaacatcaaggactttaccaagtggtgagaaagggagtgtgcccaccaggggtgcaagcccagggacgctggcccagttaccatgcataaggacagaggagtcccctggctggtggggaagcagccactgctgctcaggacacagtcatcagggaagagaggcacagccatggtgcccatgggtctgtcagaagcccagctgcccctggaagggagggcctggacagccgtttacgcttaccaccactaaggctcctccctgcctccctctggaggtcatgcttgaatcagtttaaataaaacaggattcccgcataggtgggaatgattaattacacaattattccattctgtgctgttcatcaaacactcaggtctcacagaaaactctaggtttcccaccaggttgggaattttttttgaagcgctacccgtcacttctttattttatgtcagtgcagcatccccgggtgtatataagcaaacgtggctctccatgtgggagactccccagcgtcatctttgggaattccctctagaattctattaatattaaaatgaaatattctgccaagtcaagtcagggctgtgaaaataaagcttgctgaggcaatttttctttccgagtttatgatttcccaagaataaattaccatgtgccattcatccttcatcccacgcaggctccatcgaagactggtgcccacctacgagagcgcgtccatccgccgattccaggagggacgcgtggacaacatcagatcggccactccagaggcactggcttttgtgagagccgtgactgaccacaaggctgctgtgccagtaagtcccgccccaccccacggccacaggaaaccagtgaggctgctgtggttgccctgggttgcagtgggctcggccctctgaccaccagatgctttggctccaagcagccttttaaaccccgcgctgcctctgtgttctgttgacaggcttctgagaagcttctgctcctgaaggatgccatccgtgcccagactgcatacacagtcatggtgagtgacgtcgcaccacctcacaacactgcacttgagctgtgcctggggcctgccagaatgggcaccacggcataagaccctgtgtgagggcccagccacctgttactcggggacttggcaaggccacttcaccactcggtctcttgtttcttcgttttagaacctaagtaacatagcattcctgtttttgacatggattttataagaatacaaaagttaccacttttcaaaccctttgaaacaaccatactgacaataatagcacctaatatgtatagcatcttgcagtttatacaagaggagtcaactgtgaggggaaggggctcaagcctggcaagcgatgggggtcacacaccttccccaatctcaggcaaaacagtatctgttcccacctagggctgcttttgcctctcattctctgtatattcatttatactacctgtgaataaaaagtctttgctgaaaattaatagggaaatcaaacttgcaagggaaatgtttctctagcttagagaaataattcattttctggcactgcaaagctattgtttgcaatagcaaaatagagaataagcagtgacttgggcggctcatcaatacctgcattgcaagtcattctaatacagtctttgaaggatcatataatctatgagaaggagctgaacaaatttcactatagatacttgaaaacagaaacaatgcatttctggattttagaactagccaacatagacttctctctaattcagttgctaggtccctaattcatctaaatacttcagtgtttgttctatttggggaaaacatagcacccactcatgtattcagtgggtttttttttttttttttttttttttggtcttcatgctttatgccaggcaaggtgctgggtgctaggaaacaaaatatgaagtccataagccctgtccttagggaggttaccatgtagttgggagaagaggcccttcaacgtgaacaccaatcccatgtgaaaagagccctcagaaagtagcaggggacatggaggagccagctgtttcctctgcttgggaaagccaggaagaattcccagggaaagtggtgcttcctgtgagccacaaaggatgaagagaggcttgtcaggcagacacagaagggaaagatggctcaagaagggcaccacgtgcaaagactgagagccttaagagaataagacccattcgaggaaaagcagagcacagcttgcaaaggacagtggggcaggggagatgttggatttccctgttacaaagtgtgttatggtgactgggtggaagaaggactggttggaattgggggtgggaatgtttgctgagaggcagagttgctggttaagaacctttctaatatggaggaagagctggtgtttggactggagtaggacaggggcagggtgaaggggaagtcgtaaactcctcctcttggtggaagaaactcttcgcgcatggtggactgcacacagggttactgtcactctctctgaaaccctccaaaaacaacagcaagggatttttgaaagccgtaaatacaccagggcaaagagaacaggaaaggagtggcagcaacatgttagagctggaaagtagaacacatggcgactgactcagcaaacagtgagagaagcttgggagactgggtaatttatgaagaacagataattattttttaaagttctggaggtcggacgtccaagatcaaggtgccagaaggttcagtgtctggcaaagcctgctctgtgcttccaagatggtgccatgttgctgcattctcctgaggggacaagtgctgtgtcctcacatagtggaaggtggaaaggccgagggctgaacactgtgtacagcctcttgtataagagccttaaacccgtttatgacctaatcacctcctgaaggtcccaccttctaatactatcataccattaagtttcaacacatgaagtttggacaggacccaaacatccaaaccatagcagttgatgatctatataaaaagcagttagaccctcagttcctctctaccaccccaggcagccaggctactagcccccctccccagtggtgggctagaagttcattctctggagaggctgaagcagaaggactccagacttgaggacactaggcatggctgagggagggaatactgtacggaaattaattggttaattaaagtcttactactttcttcttacttactattaagcccttcagccactcagctccatacacactgggaactagctctgtaaccatccctcaccaagcaggagattagaagatttctctgtggtaaaattgaccaagccaagagagaacactcacagaaactgatggttggggcccacagtgaaagagcctagtcagcagatgaggtagtggtttgccaagaggcagagctgctagttaagaaccattttaatattgaagaagagctactgtaaggacagtgaagcccccaggttaacaaatacattatcatacataaatcttctaatcatattttcagtgctttattcttaaatacaaatagccatagatcctccgacattgaggagacataaaagagtaaaaccaacaccaacaaacatttttgctaattaaaaaaatctttttaaaaaaacttaaaatggaccaggcacagtggcttatgcctgtaatcccagcaatttgggaggccaaggcaggcagatcacctgaggtcaggagatcgagaccagcctggccaacatggtgaaaccctgtctctactaaaaatacaaaaaaggccaggtgtggtggctcacacctgtaatcccagcactttgggaggctgaggcaggcggatcacctgaggttgggagttcaagtccagcctgaccaacatggagaaaccacttttctactaaaaatacaaaaaattagccaggcgtggttgcgcatgcctgcaatcccagctactcgggaaggctgaggcaggagaatagcttgaacccgggaggtggaggttgcagtgagccaagatcacgtcattgtacttcagtctgggcaacaagagtgaaactccatctcaaaaaacaaaacaaaccaaaacaccaccaccaccaacaaaattatccaagtgtggtggcacatgcctgtaatcccagctactagggaggctgaggcaggagaatcgcttgaacccgggagtcggaagttgcggtgagctgagattgcaccactgcactccagcctgggcgacacagcaagactccttctcaaaaaacaaacaaacaaacaaaaacttgaaatgaaaaaagtacaagaaacaattgaacagtttaaaagtgatcattgagattctttgaaaaataaaaggagttattacatctatatatgataggaaactaaaaacatttttcaggaaataaaaataactctgggggaaaatatggtagaaaaaaattcagtggaagaattagaagataatctgagataatatccccaaaatatcaacacaataaagagatgaaatataagagagaaaagaggcttagtccaggagaataatattccaaataacttgcttaatagatggaaaatactcatagcaaaggaaatttcacaacactaaacatgaagagaagattctaaaatctatcagaggataaaaaaatcaaatacaaagatccataaaaaagatgtaattaatttctgaacagcatcattggaaggtggaagataaaaagagtagtgtcttcaaattctgagagaaagtgaccttcaacacacatttcatacccagctaaactgtcatcaagtttgaagatgcatcaaagatatttttagacagagaaagtctcaaacattttacttattaagcaccatttctcataaagctactggagaatgtagacttctaaagtgagaaaataaaacataaaagaggaaatcataggctgaaaaaaaacagaagatttaacacaagaaaaagatagaggggtgcccgcaggatgacagtaaaaggagatcacaaatcaacagttgttgagtacacctagagagcaatcagtccataaagaagcaagaagtgagaggacaaatgaaattcttgctgcatgtttaggaatcagttagaaacagatacatggggcctggcacagtggctcatgcctgtaatcctagcaccttgggaggccgaggtgggtggatcacctgaggtcaggaattcaagaccagcctggccaacatggcaaaaccccatctctactaaaaatacaaaaaatagccaggtgtggtggcacatacctgtaatcccagctactaaggaggctgaggcaggagaatcacttgaacccagggggtggaagttgcagtcagccgagatcacgccacttcactccagcctgggtgaaagagcaaaactccatctcaaaagtaaataaataaataaataaaatagatacatggaaagctaaggaagtaaaaaagtaatttatacattgtcaattctagggaaaacaaaaaattcaataagaaaggaaatctaatcatagtacactacatgacccagctgtgaatacttgcttaattatacttatgtatatcgttctgtatacatgattatgctgtatcttgatcaaactacaaagagttaaaacataatcttattgggaagatgggagagtagaagtgtgctgggggagcagggtcataaaagagctgaaattggccgggtgcagtggctcacgcctgtaatcccagcactttgggaggctgaggcaggtggatcacaaggtcaggagatcgagaccatcctggctgacacggtgaaaccccatctctattaaaaatacaaaacaattagccaggtgtggtggcggggtgcccgtagtcccagctactcagaaagctgaggcaggagaatggcatgaacccaggaggcagaggttgcagtgagctgagatcgcgccactgcactccagcctagacgacagagtgagactccatctcagaaaaaaaaaaaaagagctgaaatttcactgtctataacaagaagattataggtaaaactgagaaattcagtagtggtaacctaagcatatgtttggaggaaagaaagtatatacccaaaagaaatagctaaaagactgtaaggaattacctttgtggggtaggaatccgtgctggcaaaatgacctaggcttttggtttatttggatttctaaacgatataaatatatgacaataacaactttaaatttattaaaatgtctaggaaaacaccctccaaagcattgccatagggttgtgttaataattttaagttgatgagaacaaccaaatcaaagagatgggtttggggaaaggagagatacaaagatgcttaggatgtgaatctggtgtgtggttggacatggagggtaaggaaagggggaaagaagcaaggaaacctaataactggtaagcatatttgccagtggtcgtggagaaataaagttccaatggcaaggtggtccagagcccccatcacttactctcccacttctatgttttcccttcctcacacttgagtttatgatcatgtttttttgcatggttgatgaaatctgtcccccactacaccataagctccacaaggactgagtctacaactgtcttgttctctgttgtggctacaggacccgcggcaccaggcatatagtaggcactcaattaagattccctaaatgaatgaatgaaagactgaattataagtcattttactcgttattactcatggctctgagccaaacaacctgtgaactcagtctctcttgctacagttattccaaggtggtgaaaagaggggtgagttgactgttcacagggaagctgcttctatggaccaacacaaatcaggaattaaatagaggaaaccagagaaattaaaagagtagtctccttcatagatgggctcaccgttctttccttcggtcctaacaggtagggcacgtctaaagtgagctgtggttgtgtaatgtttgtcttttcagcctctaattaggtgcgttcagagagaccagagcctgagtcatctttatgcattcattcgcaactgaaagagaacagctgtcaaatccctaaacgtgccttgtaaacctataccaagttcattgtgaatgggaagtttcctcctgtgcagggctttgacagctaactggccatcctacagaactgtgaaaccccaagagttactcacagttaccctgatgttgacccaaaagtgattactatgggtcagggtggccccctgagtctccatcagcccctagaattgctccaaataaacatgcagtccaaaaaaccagtgtgcatactacatacccagcctcaagtgggggagctgtagaatgagtacccggccccacttccagacacctcaccctccgtgaacccctcctacattgacatcctggagctttctctatatttctatcctttgataaaagtttaaatatcttgtgataaaaagaaaaagaacttttattattcaacaggctctttccccttgaaaatgtcagttgagcctgctaaggggtctagttcctgtctcaaaacgatttcttagattatggatccagtttaaatgaattgatcctgagccatgaaatagcagccaagattcagtaacagatctcacaccctctatcctctatctcttgttccctgggctcctactggaggagacagcgctggttgtggtgggagtctgttcaggacagcctgggacgcccttcacaatgcttgcacaggatccggtagtctccaagctctgcacacagccttcttcccaaactctctccctgcccaagcagttggtagttgagaagaccaggccagccccattctttccacttagagaaccaggcggatatagttgtgtaggggatgctcagactcactaacctttagctcagatgtctcaagctagaacccaacctgctctggactcattcagtgcatgtggaaatgcgcaagggcccgggagcagaggccgcatggtagagcggtcagtcctgagcagccactcatacacattgttggcagcaggcactgggtaagcatgagccgtggctgctggagtcaccagcagtcctgtagactacagagcagggaacaaggaggtgcaggaggcccacttctcatctcctgttctttgtccccaactacacaggccataacagggatggccattgacaaccacctgctggcactgcgggagctggcccgggccatgtgcaaggagctgcccgagatgttcatggatgaaacctacctgatgagcaaccggtttgtcctctccactagccaggtacggccccgtgcagctatcgcccaagagtagtgtagtcagtaagctttctaaagagcagtgacaacaagcccactagctggaatcaggcaaatcctgcctctgctttttctgaactatgtgatcttcagcaaaatgatctgaatgttcattagaagatggtttactgaccaggcttggtggcttacaactataatcccaacaccttgggaggctgaggcaggaggattgctccagcccaggagtttgagaccagcctgggcaacatggggagacctcatctccctatttttaaaaattagctgggcatggtggtgcgtgcctgaagtcccagctactaaagaggctgaaataagaggattgcttgagctggggaggtggagattgcagtgagccctgattgcaccactgcattccagcccaggtgacagagtgagaccctgtctcaaaaaaagaaaaaaggaagaagaaggtttcccatctcctaaatgggagtaatcagcagaccctacttagccgaggtggagacagtacaggaacatacccattctggtgccctaaccattacaccttactacctttcaatctattgccgcggtttccacgggctctgatgcccagcaggtctgcagtgaagtcttggcttggccagatacaattatgtagggagaaagcccagcccagggcctggcatggacagggccctctaaataggtcacagatattattataaagggccacgcaaccaacagcagaacattcgtggccagcccaacatctaaccagtgcctcagcgtgtcctgtatgagagccactgccacaaagacagaatgcaatccattagagagaggtcgtggtttaggaggggaaatgccccacagccatcaatttactaaaatgccacctcatctgcgaaaggctggatgggcagtactggagttgataagctgtgtttgaggacagaagcccactcagtaatgggatgttgtcattatggcagtgagcatgcagacgtgaataaacgaggacagaacacagcaccataaatttctcaggaaatcatccatgggcaaaaagtgctttggaatggctttatggccttcggctattgcacggcaaatttatctgacaatgtggtgactctattagcaagactaatggtttgttctgccccattaaaacagccagtgtcacttccaaaggcctcagcacacagcaccagaaacctgtaggtttaaaacaaaccaggccctgcacctgcccaagaatcctttctattttttttcccaaggaccagctaataaaattaatctggggtgtgggagttttgttgttttccaactggaaagcagcatttatggcttgaatgctttcagaaacatactttcttggtttgtgatctggattacaaaatctcagcactctgattcaaaacatactaggtgcataagtaaaactgatggcaatctttgaaacacccaactctgggtaattgtgcatggccaggctgcagggagaaatcagagaagccaggcaatactgacagtaattaaggatctgggggaaatcgacacagaggatgggccagatttcctccagttcataaattcctccctccggaaagcatctaactatggggtgccaccaggggaccatttagtaaattacctgattgcctccgtgcctcaaatggcccccaggtgaagtggagactcagcccaagacctagcaccaggtcactccgggagcttccaactccacaagtagagcagattgcacaccagggagtgggcttggggcccctcatcctctgatatcatgcagttagatgggtctgtttttatgactctggctgtgtccatccatgctaaagcaatcacttgatttggttaattcagtcaaacccccaggtggaaaacagagaagccaagcccagtcgaggctggcgggctgcattccagaacaagcagctcctgacctgtcctctcctccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcagatccccactcccgtcccttaccccagctttccacagctccctgtcctcagggtccaactcacagaccatacagagacatcacacagagccggagtgttaggaggaaagggtcccctcttcatgcatgggaatcatcattttcaaggtggctttgggcctgcacactgggaaatgggacctgcctggctcagaggcagcctggatgcactggggaaccacactaaggactccttctgtggtccttggaagcttagtgttcatgtctccttccctagcaggacctagtatgtccaggtgatgcttctgcccaaggaaaggatgagtcactctattacatgcaacgtacctaatgagttaggaaggaagaggctaactccaggtcattacctcttttcttttttgggggagaggaggctgtgttttgagattcagagcattcttatcgtggcattcccagtgtctccactgagccgtacagtcctacaagcacccactcctcccacacacaccacagagcccaagtccatttaaaatatagtgacttgggcccacaaacacatttctgctttcgtgcccaggggcagccttctgttgagctcagaaaattgtgtccagctattctgaaaggaaaaaaaaatttatctgtgactgccctggagttgctgccactctctgcttagcaggcggcatcagggccagtccaagatgagtaaactgcacagccccaagcagatggtgcctggtgccggtgggtttgcagaggacctggccccttcccggggtcctgccatttgcattttttctgcatcttttcccctctcctcccctcctacatgctccagtaggtgaagagagatggttactttgggtttttccattatctgttttgttttaagacagagatttttaagaaaaccaccctgacattaatttcagaaattcttagtgattcaagcaggacccttaggcagctgggctcctttatttggagcaggctatccagggactctgacaaaaacccatgtggtagagcctagagcagggctctcttctggcctcagggacttaggggacagctggcagggagcagggctgggaggagggcacagcctcctccagagtcagccccagccccagccccagctccagctccagccccagctccagctccagccccagctccagctccagcatgggcaggacaggcaggtcagcagaggcagagttgagatgtctccagagactgtgatcataggagagacacaagaggcacttcctattagagcacatttttatgggaagtctaaagggcagagggagggagtaagaaagcaaccagagaaatctacagcatagagcccgtgtgttctgctccacatccctccaatcctgctgcttcctgctgagcactctgctctagcccagcaatcctgtaggtctcccttctttgtgccactgtgaaggctctccacacttcgacctggactgtcacaggctggcagaggtggggtgggcatttgacctttgctcagctctttgaaaacacaagcagcctcaagaagtgagttccttgaacccctggttttagatggaggatctctattagatgtcatgggagatttgggcactaccctttgaacatacaaacttaagtcattggcctgagatttatgctccttccctcccacggccaccttcctactctgcttaggaagttgcagcacaagggtcctgggttttctggggaaaggcagcccacctgctgtaagttggcccaaagctacttgtctgttctctccaagtgaccacagtgcagatctgagttctcctccggttcctttccctccatggatttctgcgcagacatagagctccagctatggggccaggcagccccaccaacctcggccaaatgacatgcatgcccagagacgcagttcct

SEQ ID NO: 15818 - DNA, 53394 bp, Human; identical to SEQ ID NO: 15817
  misc_feature (1)...(53394): n = A,T,C or G

SEQ ID NO: 15819 - DNA, 53394 bp, Human; identical to SEQ ID NO: 15817
  misc_feature (1)...(53394): n = A,T,C or G

SEQ ID NO: 15820 - DNA, 53394 bp, Human; identical to SEQ ID NO: 15817
  misc_feature (1)...(53394): n = A,T,C or G

SEQ ID NO: 15821 - DNA, 50563 bp, Human
agtcacatgtattggaggggttagggcttcaatatatgaattttaaaaataaatattagtaatatgcacatgattatgaatataaacaattcagtccatagcagtaagactacttttttttttttttgagacagagtttcactcttgttgcccaggctggagtgcaatggcgcaatcttggctcactgccacctctgtctcctgggttcaagcgattctcctgcctcagcctccgagtagctaggattacaagcatgagccaccacgcccagctaattttgtatttttagtagagatggggtttctccatgttggtcaggctggtttcgaactcctgacctcaggtgatccacctggctcggcctcccaaagtgctaggattacaggcgtgaaccaccacgcccgactaagactaattttttaaggagaataaagctttatatataatactcaagttatatagctgaaagcacaaatcagaataaataattaaagaactttttggataacttaggagaatgactttatgtagaccctttgaaacttttcccctactggaacataagctccatgtgggcaaaggtttttgtcttttctgttcattgctaaatcctcatgactagaatagtgaatagcacataactggtgttcactatttattgaatacatgattgaaggttttttcttttttggagcagggtggccctatatcagagcttaggagccacagatcattaaagccattgccttaattgagtcttggctctatcacttactgttttttaccttggagtagttactttagctctgtgtgccttaattttctcctctgcaaaataagtattttaacgttgtaaaaattaaatgaattaatagggtaaaaccatttagaacagtatttagtacatagtacatagaagtaggtaccttgaagttggctataaacgttagatattattttgcatatatagctaattctcctatctatgtatgtgattataatctaagaaaatactctgtaaagtcagtaatatggtacattttttgccttttctttcaggaagaaaaattgaggcatggagatagaaagactgtaaattgcgatagccaagggctggatcccactggattagtcaaagtaggacaatatgcttgcattttcctgcaattgtttattaacttgagttttcattcttcacttaatcagtggttcataagctatgaatctaggttgagcccctacattcccatgtgcaaagaacattataaaatcactaacatgtggaaatacacggtctcctaacttttggggctgttactacttttaaaatataaatttatttgtattatcctttagtcattaggtattttctgaagcaatggaagctgaaagtatagaaattacacgcagaatcttctacatttgtggatgatgtaaaaggagtctttattttttttaaatattggaaaacagtgctttaggggcttctaatacataaggaaattattgtaatttcacatgcaatgtgttctaaatcttgatctcttaatcagaatcgtaaagaatctctcttctaggtttgcagttaacggtgaaaaccaaaaactccacatttggctggatagtgagtggagggggttggaggctgccgcaaggtaaactacaactcccaggattctttggtgggcgctctgggagttgtagtttagtcccaccttggcccctccctccctccctccctcccaccatctccatccccgctctgggctcacgctctggataaggacggcgcgggggcggttgtctgatgacaatttcattctcgttttgtcatttttctcatttagctcatttttgtcattttagtccattgttaggcatgctcgaggacaactcctccggagagcggtagtggcggaggaggggccgggagcgtgcgttaacccggaagaagtgaaccaggaagtgaacgtgatctcgggtttgtcgggctgaaatgtggcgggtctcggaaggttccgacctcagtaaagagagctaacgtgtattcttctttttcttaggtactcacagttctttcctgatcttccccgccgcctcctgtattgcctctttatggaatcactccatatactgagttacacagcatggtttgcccgtgctgctgccccgcgggctgtcgcttctgacctgcctacactcagaactttccccaaagcatcagagtaatactgttactgtgatgggtaatggagaagtcgtgctgttctcaggtgtagttaaccttggagagtaaacatcttgttttgttttgttttccttaatgttgagattcatgaccttgaaaattatgcattctactactgttcctaaaatggaaattttagcaataagtattcgtacaaacatatatttgtcatccttttattctgtctgttagcaaatggatacactttctctaacatgcttgaaatacgggggtggtggagtgtaacgtttgtgacagctggccattggtgctttcttcagcagttcttttaataatgtgatgcagtatcctaaaatctatcagtagaactctggaaactgaatattttaaagaccattctgactattttatttcctaggtgataatgctaagttaacagacttatagtgaacaaatgagctaatatatcaatgcacctcctagcatagtaggatcactggagacagtaaagtttgattttgataaatgttgatccttctttttttgagttgagtctcactgtgttgcccaggctggccttgaactccttggctcaagtgatcctcctgcctcagtctcctgggtagctgggacaataggtgcatgctactgtgcgtggcttgacccttatttcaactttgaaccttagagtttttcttagaacactttatattctccctttcttactcagtaagaccattgtgtacttttgttagctcttgattatctctgttggaggggaggagaacagaaaattattgtacacagccaatttcacctaacctgtaattttttaaactaatctttttttatgattaggaaagtattccatgctacatgtgcaagaaacttggaaaacactgaaaagtagaaaaaatagcaagcaaaaggtattcataatctcacaactagagatcattttattaacattttggtatgtttctttttttttttttttttttgagacagcgtgttgctttgtcgcccacgctggttgcagtggtgcgatctcagttcactgcaaccttcgcctcccaggttcaagcgattatcctgcctcagcttcccgagcagctaggactacaggtgtgtgccatcacgctcagctaatttttttggtatttttagtagagatggggttttcccatgttggccaggctggtctcgaactcctgacctcagatgatctgcccgccttggcctcccagagtggtaggattacaggcgtgagccactgtgttcggcacattttggtatgtttcttatttaactttctttttaaaaaatactctatgtgctttttttttttttacatgtataccttatattgtagaatattttttaaatgtaattgagattctattttgttccttgcctttcttgcttaatataattgtcaccatttaatataactgtagagcttttcaccagccctactttcttggtctattaatacttgaacttttcttcctttaggatctcagctaaacgggaagcatttttgaaaagtgattgcacaattgagagtgaaaattactgagtcctgaacaggcaacttacattctaataccagctctgtctccatccagccgactgaatagtcgtgattaagttacttgacttccttggatatctagatccttaaagttaaagaattatacaagataataatattttcttcaaactttagaaaatgactttatgaaccgccttaagtttgtatgttttcatagctttcaagagcttgtttacacactcaattctagattctagatactttctagaaaataactgacttaactcattcaattgatatatttgttagttgtactcctactcatatgcttcagttaattatatatgttgaacaggtaggaagcagtgctgtttttatttattttaatatgttattcatacatttggttctttctgtaggcagctgaattttttttttttttgagacgaagtcttggtattgtcccccttgctggagtgcaatggcatgatctcggctcactgcaacctctgcctcctgggttcaggcaattctcctgcctcagactcctgagtagctgggattacaggcgcctgccaccacgcccggataatttttgtatttttagtagagacagtgtttcactatgttggctgggctggtctcgaactcctgccctcaggtgatccgcctgcctcagcctcccaaagtgctgggattactggcgtgagccactgctgccagccggcagttgaattttaagactgtggagctggctgaggcagtagatgaaacaagatttcttgatgttccttccaggtttattatgcatgtatctttagagctgattttttttttaaagactgtgtttattgtatttcagatgctgagatgaatcgtcacctgtgtgtttggctttttagacatccatctcttaatggttacctccagtgtcacatccagctccattctcatcaatttagacagatacatcttgatacaaggctgcaagtttttagacaaaacaggaattgcattcttcatctgttaagtaagaattggtccaggagatattgccatcaagacaccaagatgctctggaagcataaagcactacagaaatatatggagaacctgagtaaggagtaccaaacacttgagcaatgtctgcagcatatccctgtgaatgaagaaaaccgaaggtccttgaacagaaggcatgctgagttggcacctcttgcagccatttaccaagaaattcaggagactgaacaagcaattgaagaattagaatcaatgtgtaaaagtaggtaaaagatacttatgtgtcctgcataagggctatgaaaaaaaaaccacacacttatatgcgtgtgtgtaagtacagatttgattttctaagttaaagctttattgaacttagtctttgttttttttttcccacagaagcaggttctcacttgttgcccaggcaggagtgcagtgactcaatcgtagctcactgtaacctgtaagtcctggccccccacttcagcatcctgagtagctaggactattgtgccagggctttccaaagcgatatgattatagccaccgagccactgaggctggcctgaactcagtcttttaaaaaaacctacaagtaataagctcaacacttggaaagaacaggactctgtacccagagtatttgacacactttagctactaaagatcaatgtactaagtaaacaggctcctcgtggtacttcccgtggtctcaaggtctgggagacaaaatgttggtcttttcagaagctttattttattgagcagacctttattgaacactgtacctacatactagggctacacatacagttcctaccccatcagtgggcttctatggtccagtgagagaaacttatttaagtattgtttataatgtgagacctgctctactagagggaggcacagtttcatgggagcaaagaggagagggcactcaaaccagcctggattgattgggtaaagcttcctggaggggactgcgcattagtggaaccaggaaggaagcttttattttttatttttatgtttttttttgtttttttttgtttttgtttttttttgtttttttgagacggagtctcgctctgtcgcccaggctggagtgcagtggcgggatctcggctcactgcaagctccgcctcccgggttcacgccattctcctgcctcagcctcccaagtagctgggactacaggcccctgccaccatgcccagctaattttttttgtatttcagtagagacggggtttcaccatgttggccaggctggtctcaaactcctgacctcaagtgatccacccaccttggcctcccaatgtgctgggattacaggcatgagccaccatgcccagccagtactttatttcttttcattactgaattatattccattgtatggatataccacattttatttatccattcatcagttgatgaacattgagttgtttccactttttggttattataaataacgatactgtgaacttttgtgtacaagttgttttgtggacatagattgctggttcatgtggtaactctatgtttaaccttttgaggaagtgctagactgttttccaaagtgactataacgattttacagctctacacacagtgtatgagggttcatatttctccacgtacttgccagcacttattatccgccctttcaattattgccatcctatgaatgtgaagtggtgtgttattgtggttttgatttgcattttcctgaagattaatgatgttgagcatcttttctggtgcttatttggccatttgtgtatcatcttgggagaaatcactgttcagatcctttgccagtttttaaatttaattgtcttttcattattgagttgtgagtggtctttatcttctaggtaaaagtccatgatcagatatatgatttgcaaaaatttcccattctgtggttttctcttcacttttttgatactgtcttttgaagcatgatatttttaaattttgatgatgtccaatttatctttttttctcttgttgcttgagttttgggagtcgtatctaagaaaattgcctaatctaagggcacaaaggtttacatctgtgttttcttacaagactgacgtattttttatttttatcccatgcatttaggtctttgatctattttagttatttttgtatatggtgtatttattttttatgtttttttttttgtttttttttttaagagatggtccctcactcaaactccggggctcaaacaatcctcctgcctcagccttctgagtaggtgggactaccggctattttttatcttagttttttattttagtatttctcaatactgctattgcctctacattttttctcttatgaaaattttcgaaaatttttatacagaagttgagagaaaagtttaatgaactaacctatgattcaacatttatccagatttggctattaacttttagtttctagattttcttctgtgcttcattttgtttcatttagccttagcagtattatgtgatacacaggccagtcactgttatacctgtaaagtcctggatttttgaagccttccatttttctgccttctattgatggtaccacaagtctcttacgtacgtttaatggagatattttttactcttttgcataatgccacacagatttgtagttaattagttttgagaaggttgcttgtgtatagtagaagtttatgaaatgcattctaattaaattggcataacttctttcagccttggttgtatcatgtataatattagattggattacatcatttctaaaggctctactacctctacaatttttctataataatagtaataatagctacatttacaaagtcctcttatgtgctaggcactaagctcagtgctttacaaatattatctcatttgaatgctcaggtaaccttatgaggtaggatatatgattattccccctccccctttttgtttcttttaagagacagagtcttgctctgtggcccaggctggaatgcagtagtgtaatcatagctcactttaaccttgaactcctggactcaagcaatcctccaacctcagcctcccaagtagctgggactacaggtgtgtgcaaccattcccagctattttttttatttttagtaaagatgaggtctcactgtgttgcccagcctgtgttttccctcattttatacattttatagatgaggacattgaaaggttaaatttgcaaagatcactcagccagcgaggggagaagcaaggatttgaacccaagcaatgagattccaaagcctctgctcttatccactgcttgatggatgattcaaagtccagcagggtctacctttgtgatgtagcttgcatgagtcctgttctattccttccactaatttatatcttcattacatctctgacttagctgattgcaatcaattccaaacttgtagccctacctctaggcgttctagttcaagtacaatcttattcatgttactcacctgttcccattgtctataagtagagatttcttggtttggtatttaaaagcccctgcagattaaccccagcctctccatgtactatgttaattctctttgcatattctgccttccaaccaaaatagacaacttgccattctctggatatattcgtgctgtcccatgtctgtatctttgcccacgttgttaacatgcctggttcaccttgttaaaagccagtcctcttacaaagcttggctgagatgtcatactttggcttcagtaccctttgcaaaacaagtgtggttacctttctctgttttgtattataatcctttatgtaactgtcttaacctcagcccctaaccccattgtctgttcttcaaggtcaggtcctgtgtcttactcatttttctatcttctgcagcatgaaacatgggacataataggttctcaaatctttgttgatataataaaattgaattagacggattctacaggtttacagcaaataataagagaacacaaaaataattttatatgattgcaaatcagaaggtttttctgatacctttgaatcagcagatctctattaagtaatgtcagcctggtttccatttgtggcatatgtgcacaatgtggtactagtggtgacattaaaattctacaacaggccgggtgcggtggctcatgcctgtaatcccagtactttgggaggccggggcgggtggatcaggaggtcaggagatgaagaccagcctgccaacatggtgaaaccccgtctctactaaaaatacaaaaattagctgggtgtggtggtgcgcgcctgtaatctcaactactcgggaggctgaggcaggagaattgcttgaacccaggaggcggaggttgcaatgagtcgagatcacgccactgcactccagcctgggcaacagagcaagactccatctcaaaaaaaaaaaaaaaattctacaacagatggtctgtaattagaattagttctgatgacaccttagccaggaagctctcattaactgctaaagtctggtttagtccccttcatttatgcccctatggcacactggcactcccccatctcatattgtaatcatgtgtatgtgtttgccaccagactgggccacttgaggcctgaagccatgtttttttcttcgttgtctccccagcaactagcagagtgtctagcaaaatgttaaatgttgaaagcttgaatgaggcacagaatcccaccagagcttaatgacttccatgactagagaataatttaaaagagtcttctcttctttataattgtgattcttcatttctattttctttattattaagggtcggaattttttacctcaatttgcagcaatggccactgacaaataaagtctccaagcctctaaagcagtggagtcaaaggtcatgaggtctaccatccttggtcaataactagatcattgttatcttgttttgctagagttccatgatttaactttctcctttggaaataacagaaaaaggcccattttctccatacaggacaggttacaaaaatgtatgttttgtctgacacacgtgatatgtattttatttttttaaagacagagtctttctctgtcacccaggctggagtgcagtggcatgaccttggctcaccgcaacctctacctcctgggttcaagcaattctcctgcctcagcctcccgagtagctaggggtacacgtgtgcaccaccatgcctgtataatttttgcatttttagtagagatgggatttcaccactttggccaggctggtctcgaacttctgacctcaagtgatccgcctgccttggcctcccaaagtgctgggattacaggcattagtcaccgcacctggccatgatatgtattttaaagtaccgtactaagccaggcacagtggcacgcacctgtaatctcagctacctgggaggctgaagcaggaagatcgcttgagtccaggagtttgaggctgtagtgtaccatgatcacatctgagaatagctactccagcctgggcaacatagtgagtcctcatctctcttaaaaaaaaaacaatgtgaactgagtatgaatgtatcaagagattttaagaattcttatttctgacttctcttggataatatggaagttgtagctgtgctggaccatgtcacagtatgctgagttacagctgctacctttggacaggaaatgctcactccagtttgctccaaatcttatcttatttgggtttatatttaattagctagtagctttttaaacctgtttgattaatcaccaatttatataattatagacattcaaataacgagctttgtaaatgtgggtttctatattaagcatatttttgttactactgttaatagattgattagagatgaaatgttttaagctattttacctttaaaaaaaaaaacacaaggttttgggaagcacgattatattgcttttcacattgagttttttggaaatgcttagcaaatacttgttaattgacattctccaaatattctaaatgttcctttgtataatcccttgcctttgcaactgaaataaaacttagtagccaaagaggaacatggctacttaggagtttctctgtaagtatttaaaaactttatcattatttctgtttctggcttttaggcctaaataaacaagatgaaaagcagttacaagaacttgcactggaagaaaggcaaaccattgatcaaaaaatcaacatgttgtacaatgaggtaggttttcagaggtcgactagtttcaatagtgctgtataaaggaatgctgtttttgctagactctgcttcggtgctcatagtggtttccaaacactgttttaagtgttctcttatgataagtgatcaagctggtctcctgtaatttgctgcagaatgagaatgaagaaattacgatgtcaaataataaagactcccagggtaaaaaaaaaaaaattcaaagttaagtctgttaacttgttaagcaagagaatacgtgctggtaaagaaatttagttcaccacagggaagagtcagaggattttaagagtgagaagaggaggaggagttcatggtggctgttaattaaggattggaaatttgcactctggatagaatggaatgaatccaaaggtgtaaaaatagttggttaacacacatctttagttaggtctagtaagggtgtggcatactggagcttctcagggttgatgatactgtatcagcatcagctgatatctcctagacatggaaatggaagatttcccttccatagtggtctcttttcattcttgcttaatggatggtttgtctacaaagacaatgaagaacacactactgtataccatgtttccctctgtcacgtttgccgtcctcctaccttcagtgtttcttactctgggaatccaatagaggggctttttgaaaagttaagggggaggttacatgggatatcagttatttttattacaaattgaaccagttaatcaaaggcagaagatgtctgactctcagtctgtctcatattctctcccatagactatatcatttctagcagagatggagtatttcagaaattggcagtagggacagtcatgacacataggtacttttactttgatttgaaaaaccttttagtaataatgaaattacttcccttttcttcctaagaggaatgtcggttactttctttattaggaagccctttttctttctggtcacagctgagaaactcattttgagccttatcttgggagccctcaacatagtctttaattagagcgtctctgctgagaaggcacagcatggctggtgtctgctgtcagttatagcagaagataatatgaaatcatttctcaaagtgaagactttcaaagccttgcttcattcattagatgaaagaagctactgttcagaactaattataagagccaaaatctgaagaaaattgaatggaacaccctggactttgatctgaacttctgcattctagaaaattaagataatctgataacagtgcagaaaatatactgacaagtaactccattgttaacatgaattgatcacctattttaggtctaattagttctacttattatagcatttttggaataccctgtttgggatactatatgattttgccaattattgatttttttcaatgtttttcgggcctttatttaattcagtaatagtgtaccggggaaaatatacacacaaatgctgatttttattccagcttttccagagccttgtgccaaaggagaaatatgacaaaaatgatgttattttagaggtgacagctggaaggactactggaggtcagtaaacttactttattatttaaatgatctaaaaagtccttgaattttaccttatttgataacactaactttaaaagtccattaaatgtatttaaatttggaaatagttattctttatttcctaaaggacttagtcttaagggtggctttccgaaatttgtcctgactaaatatttttcgtattttgttttaggtgacatctgccaacaatttacccgagaaatatttgacatgtaccagaattattcgtgctataaacactggcaatttgaacttctgaattatacaccagcagattatggtaggcatattgaggaatttgcctgtaggagatactgaaaattattttacctctgatcttgattagaaccatattgtcccatttttttttgaaacttttggtgtatatctactaaacactgtggcataggctcatcaatcacagtggcttactattatagcagagttgttagctaggagaagacagtagaaaggagggaagcatttgcttagggagaaatatgtgaattagagaaaattcccctgaggaacttagatacgtatcttgcctcaaaatcatttttctctattattgaaagcaaaggtatattaaggtttttactttaaataactttatttataaaataatataagtattactaattagactaagtggctaatgtgtttgatttttatgagaatgcggaaaaagttaatcatttgtctttattttcaagaaacttctcttttggctgataaaaatttataatggctgggcactatggttcacgcctgtaatcccagcactctgggaggccaagatgggtggatcacctgaggtcaggagtttgagaccagcctggccaacatggcaaaaccctgactgtactaaaaatacaaaaattaactgggcatggtggcacgtgcctgtagtcccaaatactcgagaggctgaggcaggagaatcgcttgaacccgggatggggaggttgcagtgagccaagatcacaccagtacactccagcctgggcaacaaagtgagactgtctcaaaaaaaaaaaatgatacaacatagacaaacagtgcagttctttacctttaaatactcaagtatattgattgaaaacatgataataattctctcatttgtctcattcttttaatccatctgaaagttttcctctgcttggttacacagtgatacattgtagtagacagaggagtcatcagtaataaaccacaaactatcaaagtggggagagaggattcatgtaagttgagcagtaaagggaaataagaaccagcctacagcataaggaagttgtacctggtacagatttcagatacaaccagtggtcaggaaaggggattatccatgagagcagagagaagaaacaacctgagcagcagcatgctggtgggagaggtcttggtgtgtggggaagggagtggtggggaggccagtttacccatagcttgtcagggaagtaatcgctgaagtaggtttgagtggatagattttgaacagctttgattgatgggcaataggaagctgttgaaaattgcattaataagaatatgatttgataaaatatatattttaaggagattattttgacaatagtgatggatggatggatggatggatggaaaggctagatttagtgcagactgcaaagaggttattagagtaatccagatatgactaagagttagaatggggagtagaattatctgtcagagacctgcaaaggatgaataggcataatttgctaagtaactagatgtgagaggggctgttgtttatccagtatgtcttgtgtgcacaacttcacacccttgtgaaatagatattactaatctcattttacagatgaggatctaggctcagagagtaagtaactaatccaagaccacacaataagtaatggcaatcctgggattacattttagtctgtttgatccagagctgcactacatcccattattctattctgacacaaaggagatgagccacagggagtctaatctttctagctgagaagactgtgatactcattcatgccattgaatggaatagaagttggaaggcagaaaccatttggaaagaataatgatgaatggtttttgaatcattaagtttgaggttatagtgagcatccacttagaaatagtcagtaaataggctgggcacagtggctcacgcctataatcccagcacttcgggagacagttcgagaccagcctgaccaacatggtaaaaccccgtctgtactaacaatacaaaaattagctgggtgtggtggtgcacacctgtaatctcagctactcgggaggctgaggcacgagaatcatttgaacccaggaggcacgggttgcagtgagtcgagatcacaccactgcactcagcctgggcgatagagtaagactcagtctcaaaaaaaaaaaaaaatttggagtaaatattgaaattgagtaaccagatctttggtgagacaacagaactcaggcaagctatttgatacctgtcagctcagagataatgtctgatactgagagaataagtgagggagagtctatagagagagagcattcagggcaacaagctttggagaatggccatgtttagaaggatagaccagttagcaaaataaaaagaggattcaagataatcagaaaaaggatgaggacagtaaaatattatggaagcaaaagaggagagagtttcaaggagaatgtaagaagaaacagcagcattatgaaaaggagagtagtagaaaatatcctgagtgaactctgataggtgtatttcgaatgagactttcaagaataaaagggagataacctcaataacaggaagagagattctgttccaggtttgtatagcagcctaaacaatgattgggaaacctttcctttagacacactaagtcactggcaaaataaaataaaaatattttgaaaagctaaaagccctctttaaaaaaaaaacattacaaatattttactcatatatctttaaagttaaagactaagggctgggtgtggtggctcatgcctgtaatctcagcactctgggagaccaaggcgggtggatcatttgaggccaggagtttgaggccagcctggccaccatgtctactacaaatacaaaaattggccaggcgtggcagtgcgtacttgtaatcccagcttcttgggaggctgaggcatgggaatcacttgaacccaggaggcagaggttgcagtgggccaagatcatgccactgcactccagcctgggcgacagaatgactcccatctccaaaaaaaaaaaaaaaaaaaaaaaaaagaaaaaaaaatcaaagactaagaataaacctttattcattgaaattataatttctaaaaaattgatttctttcttttttgaggcagagtttcactctgtcacctaggctggagtgcagtggcgtgatatcagctcactgcaagctccgcctcccaggttcacaccattctcctgcctcagcctcctgagtagctgggactacaggcacccgccactacgcccggctaattttttgtatttttagtagagacggggtttcactgtgttagccaggatggtctccatctcctgatcttgtgatccacccacctcggcctcccaaagtactgggattacaggcgtgagccaccgcgcccggcctaaaaaattgatttctttattagaagcagttaggagaagaaaagggtgtggataaagaaagggcaaaaagcacctaccttataatatatacatgttaaattacatatatgtgcacacaaatttttttttaatgtttaattgaaatggagaggaactcatagataagcacagagattcacatagcactaaaagctaaagttgaaaagaaacagtttcatgtacaaattcatacattaagtgactttcaaagtcatgtcattttgtggcaataggtacagatagagacaatatttaaccatttcagaaatagttcaaactaaatgataacaagatagtctatggaagcagtggagggtaatggctctagatatgtagtgtaagtctgacactattgatctgtaaacctggtatcaaatgaattgaaatattttccacattaaagggattctatgaaatatattgcattatctccccagccctcgactgatgaatgtttataattatgttttgttattctctactcacgagttaatttggggtggggtgacttacggtaatgtaattgtgaattttatgtgtccacatgactcacctttcaccacaactgcgagaaacatatttgtcgggaagccccagcatccttcaagagctctgtgatcactcttctctgtaggtcagaccatacagtgggaactttggtcactgaattgggaaacctaaatgtagtaggagtaattcgatcccagggtggcaggggccaactggtggtaccccactgccaaacaccaagtagtaggcagagttaccatcagacagcagagtcaaaatagaaagcagaggctgggcgtagtggcttacgcctgtaatcacagcactttgggagactgaggcaggtggatcacctgaggtcaggaggtcgagaccatcttggccaacatggcaaaaccccgtttctactaaaaatacaaaaattagctgagtgtggtggtgcgtggctgtaacctcagttactcaggaggctgagataggagaatcacttgaacccgggaggtggaggttgcagtgagtcaacatcgcaccagtttccagacttaagccaatttccagacccacagtacctcgagtgaaggggagtgtgtaggtccccttgaggagacaccccaggataccgccagaactttcccccagcctccgcaaagggacttacagccttttaatacggtaactatgctttggagaaaagaaaataatcagaacttttgaggacttctagtcactgtctgtaagccaacactaattctaggacattcaaaaatgtcactgtgatctactagtcaggataggggcttgtgtggaggtcagatgatcaatgagttttagctcatgcccatctcacagtgggcccaatgtgaaaataaccaattctgtggttattttgtggttttttccccagttccagaatgcaaaattggagtagacatactcagcagctggtagaatccccacactggttccctgacctatggagcaaaggctattatggtgggaaagaccaagcggaagccaccagaactgcctctaggaaaaatagcaaactgaaagcaatactgcagttctggagggattgtggagattagtgctaccaccaaggacctgaaaaatgcaggagtggtgattcccgccacatccccatttagctctcctatttcgcctgtacagaagacaggtggatcctggagaaatgatggattatcgaaagcttaaccaggcagtgaatccaattgcagctgctataccagatgtggtttcatcagttgagcaaattaacataatccctggtacctggtatacagctgttgatgtggcaaatgcctttttctccatccctgtcaatgaaagccagcagaagcagtttgctttcatccagcaaggccacaatacaccttcattgtcctccgttagggtatatcagctctctagccctttgtcacagtttagctcatagggagcttgacagcctttgtcttccacaagatttcacaccgatccaggaaagccaatggcatagttccagttactactgatacctctcgacagctgcatgtcaacactgtacgaaatgttctgcatgtatttatctcagttattcctcacaaaaacccttggagagtagattgaatttcaaggctgtgttgtatgcctgcatatgccttgaggcactactcatatactcttcagtgtgaatgtttctcccttcaggtgtgcggtgctgtagccctagttatatactattattatttacacataaggaaaccaaagcgtggaactaacttgcctgtggacagacagctaggaagaagagaagcttgaaatttgaactcagatagcctaagactggctgttttaatctatgccaaataagtcacagtcttctcttataatattcaagtatttgcacatgacatgaagtaaaggggatggaggggtaattttaaagtacagtgtgagtatgagatggggaatttaaatttgtggcatcactctgttttagttcctgaataatctttcatagtatgtccgtcctaccacactgagtatgaatgttaaaccatttgatttttcatatcatctgtgccctaaatgcatgtcagcttctttatttggtatgaagattattatccggtaatatgttttattgctggaggaagatcagctatgttggacttattaagagacagtatgccagtctctcataagacaccttcctaaggcattttcaagggtaatctaaaactatactcaatttttgtctaacatgctgactttagaaaccaaatggttatatcttcattagaaatgcattaggaagatggcagctgcagtagcagcatagttttcagtctctctgaatccccatgcaaaaacacatatagcaactagatatcaaaaccaaaaacccatggatagcattgacagcattcagttgcagggtatacccacaaaaccccaaaacaaaccaccaattgccatagaacctgcatggtctaagcatctgtgcaggaggaagaaggaagcaatggggtggcatctgccggatctgaaaactggagaaccctctcataactcatggttattctctggaatttgggagccagttatgaacatgagctggagctgggaggaggtttacgctctccaataatgagtaagtgttcgggctgtaggtaaggagatttaaagaggccagagcagtctagcctgcatgacctctcaaaacagatccactagggcgcccttccaaaacaggcccccacactgaggaaggactgctgggaggagaatcaaagttgagcaggacagggataaagagggaggaagggaaaagaagatctaatccaaagccagggagaacagccaggaagtcccagaaagcaggttgctatttatttgaacattacacaaagccacagaaaagagaactctgtgaagttagaaaagccttcctggactcattctaaaatatatggaaaagtaatctcacagaaaaataaaccatagaaaagtattaaggttaaattccatacaaagttttatgagacacaagagagtaaagagtagaataagatccctacagacaatgaaagcacattagaaagatatgactacaaaataggtcaaaactatcatctgctatttcaaaataagtaattaagaggctgagcatggtggctcacacctatattccccagcactttgggaggccaaagtgggaggatcgcttgagcccaggagtttgagaccagcctgggtcccacatggtgagatcttgtctctacaaaaaattttaaaaattagctgagcatggtggcacacgtctgtagtcccagctgctccagtggctgaggtgggatggcttgagcccaggaggtcaaggctgaagtgagccaagattgtgacactgcactccagcctagaggacagagtgagaccatgtcttcaaaaaaaaaaaagcaatatgaagtgtcaaagaatctgataaatcaggattagaaatgaaatgacagactcaggaaataattagaaagcaaagaaaaatcattttagaaatgaataaatcagaaggaacatatgagcagataaacagaacatttaatgccttaagaaagtagtagttaaaaaggaaaatttttttgaaatcaagaagaaatgaagaaagataataaaggagtgaagaaaatgacaaatattgttgataggcaaaaagattgattagatgataaaagtcagagcagatactatatttgttatttattgctgtgtaacaaattacccaaagcttagcaattttaaagaacaaacattttttatctcacaatttatgagggtcaggaatcagctgcttttttgagtggcacagggtgtctcatgaggttgcagttaagctgttgggtggggttgttgtcatctcaacacatgactggggtgtcagggcctgcttgcaagctcactcatgtagttgtaagcagataccagcttttcaccacgagggcctctccacagggctattcccaacatagcgacctgtttctcccaagtaagtgatgcaagatggaggccatggttctttataatctaacctcggaaggtgacatagtatcacctctgtcataccatatgctattgatcatacagaccagctgggagggaactgtaagggtatgaataccagcaggcagggatcctggggggccacccttgaggctgcctgtgacaaatactaacatctatatttccagagaactcttctgaaatagaaataaaagatttgaaaccatgtgcacatctgaaaatatccagctagaacgaccaacactaagacataggctaataaaatgtttggacttacaaaaaagggaaaagacccattaggcacgtagaaacaaagaccttgagacttataaggcaaggattagatttccttcagacttttcagtaacaacactttgtgccagagagagagttcactgaaagaaagttgagttaaggattttataataagcaaaactgacttataaatgtgaagggaacaatttgttatcattatgcaagaattcaagaaatactcttcccatgatccctttctgaggaatctactagaaaacaagcttcagacaactgaaatgagagatagcaaaataaggagtaggggtgaacattaaatatgcagttacctgaagaactgggactaattgagggctaaggggaataaatttgttacataaggactgtatgatctgacagtatagatatagtacaatcatttgaaaaatgggaggcaaatggcaagagcatatgcaaaaaagttttaatgtttttagtaattgtattggtagaactagtattagtattctgagactgttaggtgtgtagtgtaatataaaaacagataagtaattttgggatattttaattctaatgccctctctttgagaaccaagattcttggtatgggaagaaatacaataaaagtgtggtagaaaagaggttgaagttgaatttaaattggaagtgtcagttgtaaaaactctgaaaggtctgagattttaccctacttgcaagctaacaagttagcctgctgctgtttcatgggtcagcagtgaaggacagtttattactcagggttatagcagtagccagagtattagcatttttgtgccagttccctgagcccagagtcccacagggcaacaactaagaagaccagatgatacctgcccacacagtaggttgcattataggagaagagcactgaacttaaggaaattgagtcttttttttttttttttttttttgagacagggtctcactctgtctcccaggctggagggcaatggcaccatcacagctcgctgcagcctcaactgggctcaagccatcttctcatgtcagcctcccaagtagctgggactacagacacgtgccaccacacctggctaatttttttatttttatttttttaaattttatttatttattttgagatggagtcttgctctgtcatccaggctggagtgcagtggcacgatctcggctcactgcgacctccgcctctcaggttcaagcgattcttctgcctcagcatcctaagtagctgggatgacaggtgcgcgccaccacgcccagctaattattgtatttttagtagagacatggtttcatcatattggtcaggctggtcttgaactcctgaccttgtgatctgcccgcctcggcctcccaaagtgctgggactacaggtgtgagccacagcgcctggccataatttttgtattttttgtagagatggagtttgactgtgttgcccaggatggtcttgaactcctgggctcccgctgtctgcccccctcggctttgcacagtgccaggattacaggcatgaaccactgcgcccagccattttttttaatgcgcagtaagcatgctgcacattgctctagaaagagacactatctctgtcttccaaggctgtggaaacttgtcctttgctctggagggacacattatttccaaggctgttcactacacaaaccgcctttaaaagatattttagagcgaaatagccagcaatgcttcatttgtaagatgtgcaggaacacaggagacccatggaaaattgggtctcaacatcatatgaactcatgaggtatttcctatttctggccactgaaaaggcttagaaattataaccaaatccagtagtagtggacaaccctagcccccaaattgtgattttcaaatactatttttctcttgaaccagggctttttggagacatggctgattccaggtctagggtaaaaaatgttcaagataatcctggaatatcttgttatgccatacaaatggggcatgtcccatacaaatggggcatgtcagaagaattcagaagtcaatttgaagaggctctatgggccaacgatgggactagttgagctttaataataattgtgcttgatttaaacgtgctagatgtgtttcaatccttgagttcataatgataatttaaacttttaattggtcatcttcagaggattaaaatgaaccagttcagtatattacaaaaaaaaaatgttggtatcttggtagaactggtaaaagggacagaatcaaacatttatcttgcttttcctatgtaattgtatcaccatgtaatcaaatggtagacaaggggaagtgtctctttattagtgtattttaactaataagtgagaaaggaatgatagaattagacttatcaccattttgtaaccccagtgatgcattcagtgtcaaagcctgtcaagactgtaaaaagagagacatccagacaccgtatacctcctgtcgtcttgccaaagggctcgagctggtgtctgatccagtgtctgcatccagctgcctaattgctgccgatacagagggcagcagaacagggtgacttgcaccaagaatatgcagtctgcaaaaacagactgttggaaattctacaggtcagcagcccaagttcttcaccagatcatttgtaggaaatgaaagcaatggatgatgagcatgtggactaatagactaaaaagatacatcaaacatttttaaatgggcaggactaaactgtagcgcctagggctacacgtttaggtaatgaagttatgataaagaaaggaataaaagtcaggataatgattactcatagggaagagagaggattatgtctggaaatggcatttgggagggcttatgaagtgactagcaccgttctttttcttgacctgagtggtggactctaaaccacatatttgatttgtgtgtttttctgtctttcatatattattgtatcataaaaaagatttttaaaaaaacattagataagaacaagtggccgggcatggtggctcacgcttgtaatcccagcactttgggaccccaacgcaggcagatcatgaggtcaggagttcgaggccatcctggccaacatagtgaaaccccgcctctactaaaaatacaaaaaattagccggacgtggtggtgggtgcctgtaatcctagccactcaagagaacgaggcaggagaatcacttgaacccaggaggcagaggttgtagcgagccgagattgcaccactgcacaccagccccagtgacagtgcaagactctgtctcaacaacaacaaaaaaagaacaagctagcctaggtgttaagattctttgtgatactcttcccactccatagataagcaagagctgactttcaataaattcttgaaaatttgggaggatctgtagagttattcaacagtatgaaattattctcctattgagcattcttttatatatgataccctattagcctaagactacacagggtagttcaatacagaaaacatcccagtattatttttttgttctaatagtagttttcccttattataaaaataaaacttgttcattatagaaaatttggaaataaaaaaagtattattctattccccagacataacgaaataatattttggtatgtttcctattgttgcatcactagctcctataattaattacattttggtatgtttccttttgtattttaatacatttacattggaaaactgtagttttgtgcatactttatgtcctcttttcttcttcttcttcagaggccctcgttctcccatgctttatgttctcatcttaggctctgtactcaacattcaggccttagattaaggacatttaggatcctgatctgtttcaaaggataattcattactatttctggattgttgttcccctaggtggactacatcatgcagccgcccgaatttccggtgacggtgtctataagcatttgaagtatgagggtgggattcaccgagttcagcgcatccccgaggtgggcctgtcctcaaggatgcagcgcattcacacaggaacgatgtcggttattgtccttcctcagccagatgaggtaacctcaggaggaggcaagggaaactcactccatgtcaacgggtattgtgctggaagccttagcttctaggaaaatctgtccttttttttttttttgagacagagtctcgctctgtcacccaggttggagtacagtggcgcgatctctgctcactgcaacctccacctccctggttcaaacaattctcctgcctcagcctgctgagtagctgcaattacaggtacacgccaccatgcctggctaatttttttgtatttttagtagagacaggttttcaccatgttggccagactggtctcgaactcctgacctcgggcagtccgcctgtctcgcccttccaaagtggtgggattacaggtgtgagccaccgcacccagccgaaatctgttcttttcatggctacagattggactttatagtctctaatgggaaatgtttaactctcccctaggcaaagttgcccctcttatcattgaccaagatgttttgtttgcttttaaatagaagtcacttattttcaaaaaaaagttcatttaatgttgctgcctaaattttatcttaagaaagaaaatgaattccagagataatatttcaaggtcagttgtataatatcagtatggggaccatgtatctatctttttagttgaatacagccatctgctctatatttttcttttccctaaccttttttttttaaacatacagaaaatttaaaggataccacaatgaaaattttataaccttcacctgaggtcagttgtttacattttctcacatttgcttgattcctatatatatgtgtatacatttatttaaatgaactataaaggatacagcagacaccatgagaccttaccttccaaatctttcacatagatctcttagggcattctccgatataagcacactaccattacctatgaaaactaaacataattgtataatatctaatatctagtacatttaacagtttccctaatcagcccccaattttttaatagctatttatttatctacttttggaggcaaggtctcgctgtgttgctcaggctgaacttgaactcctgggctcaaggtgatcctcctgccttaacctcctgagtagctaggactacaggcatgccactatacctgggtatagtgattttttttttttatccaggatcctgtcaagtttcacacattacaattagttgctatgtttctttaagtttagaacagtctcccaacttttttttttagtgataatgacttcttgaaaagtctagaccatttgtcttgaagaatgtcccacattctggattcctctgactgttccttgtggtactctttaacttgttcctttatcctctgtattatgttgaaagttatatctacatgttccattctgtgcaggttacacattttgagcgagaatacttcataggtgcagttatagtcatgttgcatcttatcagaagacacataatgctagattgtctcacttttagtgtaccttagttttagtagttagtgaagatggtgaccacagaaatatctccattgtaaaagtatatttctccctttgcaattactaagtaatttctagggtacatatatcctgttcctaattacctttcatccatagttttaacatccattggtgatccttgcctgaatcagttctttactttggagttgcaagatggtgattttctaattccgccattccttccacatttattaactggcattcttctgtaaagaactttcctccctactaccttctcacctcctaccccacacttgcattctttttctagtatatgatttcattataaactcatgtatcaagtttcacgtattaacctcattatagactcatggattcatgttttaattcacttatttatagttactattcttctttaccttcaaatagtcccagatttggtctatagtagccttttagggtacttcttttgtccttttgaaatgataccatcatttgagtgcatctatgctttctgacacagttagattcccaggcccattttgtactatcctgcctcagacttagagtcagcctggttcattttagtggggaatgtatccagaaatcaagatctagatagtaggtctgttcattatcattagtgtcgttacttctagactctttcagtggctatagccaggaaatacatgttttgaaatcaaagtttcatattattactaccaattcaaatttaacattacagaaatttttgtcacccctcaacttcttgcattttgtgtttacatctctccgttaatataaaaaatcttgtttcataatcactttaatatgtttatttggtttattatatactatatataaaatagtttcaaaattataatatcgacattactaacagtaaactactgagtaatgtttaagatttttccccttagaatatattctaccaagaatgtatagtcaggctgggtgtggtggctcacgcctgtaatcccagcactttgggaggccaaagcagacgggatcatttgaggtcaggagttcaagaccagcctggccaacatggtgaaaccctgtctctactaaaaatacgaaaaaattagccaggtgtggtggcgcatgcctgtagtcccagctactcaggaggctgaggcaggagaattgcttgagcccatgaggcggaggttgcagtgagctgagatcatgccattgtattccagcctgggcgacagagtgagactctgtttcaaaaaaaaaagaatgcatagtgtgagcactatgctcagagatcatctgaaataatttttttctgtgtggttatgttattatgataaatattttggttcatttatttctgtttttatttcattttaggatttgatttttcttttctcttttacttaattatatttttatatattaaacatttacatggttaaaaaagcaaaaccatagagttatcttgcttcaatccttatttcttctaccccattcccacttaccctgtttttattgtcatattctttttttttttttttttttttttgagacagattctcactctgtcacccaggctagagtgcagtggccccatcttggcttactgcaacctctgcctcccaggctcaagtgattctcccacctcaaccttttgaatagctgggactacaggtgtgtgccacaatgcctggctaatttttatattttttgtagcgacgaggtttcgccatgttgctcaggctggtcttgaacctcctgagctcaagtgatctgcctgccttggccacccgaagtgctgagattacaggcgtgagccacagcgccgggcctgtttttatattcttgaaaattaaactcattcagtggcatttcactattctaaaagtacaaggttatgttctcttaactgacatttaaaatgctttatctgccctaagtcaccatttctgtatccagagttccccaaaagtcattagatcatttctgtaacatttgggagaatgtgacatatgatatccacacattttctatgtaactacttaatatactatagccacatgaaatggtaagtcactcttatctcttcagtatttattgatgtcttaaggcagccaactctaacatatattaacaaaagctgtataatcattttcttcactgtgttgcagtcatttgagaggaaacatacaaaagaacaatcagctaaacagtgtattagattccagccttgacccagttactagttacttttcaaagagaaaagtcacatttgctttctgtcattcacactaataaatgatgaatgtggaacaaaatgttagctctcccctaaaaaatagcatatttgttgtaggccgggcacagtggctcatgcctgtaatccagcactttgggaggccaaggtggatggatcacaagatcaggagttcgagaccagcctggccaacacggtgaaactccatctctactaaaaatacaaaaagtagctggtagtgatggcacacacctataatcccagctacccgggagtctgaggcaggagaatctcttgaacctgggagtcagaggttgcagtgaattctgaggtcacgccactgcactccagcctgagcaataaagcaagactcttgtctccaaaaaaaaaccaaaaaaaacaaaaacaaaacaaaacaaaaatatttgttaactgtgtgtgtgtgtgcgtgtgtctgtgtgtgtgtgtctgtctgtctgtgtctgtgtataagtttccaaactcttgaacctgggagtcagaggttgcagtgaattctgagatcacgccactgcattccagcctgggcaacaaagcaagactctgtctcaaaaaaaaaaacaaaaaacaaacaaaataaaaacatattcgttaactatttgtgtgtgtgtgtttctatgtgtgtgtgtgtgtctgtgtctgtgtataagtttccaaaggctgctgtaacaaattaccacaaacttagtggcttcaaatagcagtaacttattatttcacagttctagcagccagaagtccaaaatcaaggtgtcagcagagttgtgcctctctgaaggctctggggagaatcctcccttgcatcttccagcttctggttgctccaggtgttcctcggcttgaaacgataacactcttcaaattcacatggtcttctcctttactgtctttagttgtttgttataaggacacttgtcattggatttagggcctatcctgataatccaggataatttcatcttaattacatctgcaaagaacctttttccgaataaggttccatgaattagaatatgaacatatctttttgggagccacctttcaatcactaataaacacacacatgcacgaatgaagttgattttcattattcccagtagttatgttctgtaaagttgcagcaaacactaatttagtagattctgaaccacttggcagtaatggttcagtatttgttaaatcagtgttaggaacaatggttcaatattagctaaatccagctgagcgtggtggcacacacctgtggtcccagctactcaggaggttgaggcaggaagattgcttaagtccaggagttcaaggtggcagtgagctatgattgcaccattgcactccagcctggggaacagagtgagaccctgtctcaaaaaaaaaaaaaaattagctaaattcatacacacacacaaacacacactgagctcacatagattataatcttaaattctaaaaataacccatcctggtagattctctatactttacaaaagagaaaacgaggctcaggagtgtcaggtgacttgcctgatgctgctccactaaaaggtgctagagttcagattcaaacccagtccaaattggccccagaaccagagcactgctctgctctgccccctacacctccattctctggtcatctctgtaggagagctgccacaagaaggcagagtgttaccttgtcctacttcagctggcaatgggcaaatgtggagcaactcatatttttcactgccctatgcatgtctgcaaatgactgtggaagtgcctcgggtgttgatttgtggatacaaataaattttagtgagtaggcaaatttgcaaatagacattctgacaataatgagaatcaacaatatatagtatatatgtgtgtattttatatatttttggggttttcttacatgtaactttgggatgatgaatgatgaaacttttgaaagattgaaaactcagtgatctcataacatcctaaatcagtgcttaaaaatggaatcccagggccaggtgtggtggctcatgtctgtaatctcagcattcaggaagtccaaggtgggaggatcgcttgaggccaggagttcaagaccggcctgggcaaaatagcaagaccccatctgtacaagaaatttttaaaattaacatggcacggtagtgcgcaccagtagtcctagctactcagcaggctgaggcaggaggatcacttaagcccaggagtttgaggttacagtgagctatgattgtgccactatactccagcctaggcaacagagggagaccctgtctcaaacaaacaaaaaatagcatcccattggaatggggagtttattgctctttctttggtataagttacttctcttagtctaaaggctataatttatcttaaaacaatacagtttatttgaaaaatcttggaatcgattttatattaaagtattcacggagtgtagaattatgccatgccttctgttctaggtggatgtgaaattggaccccaaggatttgcgaatagatacatttcgagccaaaggagcaggagggcagcatgttaataaaactgatagtgccgtcagacttgtccacatccccacaggtaagcaagccccttggctttgtacttttaaccctttttccatcttactcagcatttggaaggaaatagtcctatgtgagtgtctggttccttgcacagctctttaaaaatgtcactggggttgtggatcaggatggctattgtgttcatatttcccttctgtttggaaagattcctttctgaaaagatgcagacggtgagcagacctattcagggaagcttcccaggtatgctggatgggagtgagcaaacagaggtgccccagcctaaatacagatgaaacacagaagcagccttgcacaggccaccaccgtggatattctgtcaccttgtagcatgacagctaactccattaggctttgctgcactaatgcttttattttgaatattggtaattttggtatactctgaggtagttttgctgtccgtaatgtgattttaaatattcctaccgtttttcaaattaaaattttatttaactccttaatttttttaaattaatttttacatttcatgtatatggttttaaaagtctaatggcaaagtcctataacaaaaaaaccaacagctctctggacttgttcccaccctcttcctacttcctctactctcagttcccatttcctaaagacaaccactttaaattctttttactcacttctctagctgcaaaaaacaaacaaatgaacctcttttagctatttcttctggtaattacctcagtatttctaaataataggcaaatattgctcttctgaccaactataaagattatatatttacatcttaatgtggtagatgagaattttgcccttcttatataccttttcttcttccaaatatttatcttttggcaaaattaattttcactgtgttcatataatgaacagatagtgttagacgctgagcccattagtatacagtcctgtgatttcatttcctagagttaataattacctcattgatttttcatttgcctacttttctttgactctgagtctgcttacatcttccaaaagttgtgtaaaatgaagtcactccagtgctctctggagactccatgacagagcactccatcatcttgcttcagtgtggaccagctgctccccaggacattgcacaggggttgtcctggtcatcagcagttggggagttcctttcatctctgttctgtgttggatcctcccgtttcttgggttctatatcatcttttctctttgctactctgtcattttaacaaagctcatctttaagtggcttcctgagaaaagatttgtgacatgtaaatatttcaaggctttgtagatctgaaaatagctttattctaacttcacacttcatcgatcatttcatggaaataatttccccttagaacattgaaagtctttttcattccttgtatttgttgctttcagtttagagactcatgcctttcagctctgaaatactttcttcaatactttcttgcataacattttatttattcttcctgggatttctattagttagatattagacctcttgaatttgttttttcctcatattgtctgtcactttgttttttagttctttttcctacccttttttctgattgtaaaaaaattatttttttaacttttgagagctctttcttgttctcagaattgttttctcatagcatccttttcttattttgttgatacttatttcttttttttattactgaaggatattaattttagtttctctgaagttctcttctgctttctgcagtgtctctgtttcttctgagtttatttttgtttcattcttgctttacttttcttttttttctttttgagacaaggccttggcctgttgcccaggctggagtacagtggtgtgatcacagctcactgcagctgtgactttcccaggctcaggtgaccctcccacctcagcaccactcccccgtcccagcttcctggtagctggaactataggcgcttgccaccatgcctggctaatttttgcttttttttttttttttttggtagacaccaggtttctccacattgcccaagctggtctccaactcctcggctcaagtgatctgcctgcctcagcatcccaaagtgttgggataacagacatgagccactacactcagcccattcttactttcatgttggaaatttctaggaattcttggctgtctgtacatatttaagagccagattctgaagctctgagtgcacttatccacatacccattagtgagttccactgtggagcagttagaggattaatcagcttttttattagggacccccagatgtctatatctgtagaccttttctcttgtgagtttgttttctcctgagaaggatcttccaggatacagctgagagtaaagtcaaggtctcacctttcaatagcagttgtttacttaatcctcttgtcttcccgcccatactccatacttgccctcccttataactagtcccaggtctggaattttcctgatttaattatccagaaatatacctcctgccttctgcagattgaggaaggagacttgaggatctatttgttattataggctttctgtatttagccctagctcctcaagcctgacttctgaaatacctggtgtctctatttctgagcctttctggcacttagcagggcaaagtggccagtttctggtcagcatctccctctacagggaattaagtctcaccttccttccagctgctaagtcatttaccattcttccatccactttctgtctttaatagatcatgtttggggattatatatatcacctagttttatttcagatggagtttgtgtttctgttctttgttcttgttgtagtgtgatttaaaaaaagcggggtgggggccaggtgcagtggctcacgcctgtaatcccagcactttgggaggctgatgcaggcagatcacctgagggtcaggagtttgagactagcctggccaaaatggtgaaaccctgtctctactaaaaatacaaaaaaattagctgggtgtagtagtgtatgcctgtagtcccagctactggggaggctgaggcaggagaatcagttgaacccaggaagcagaggttgcagtgagccgagatcatgccattgcacttcagcctgggcaacaagagcaaaactcagtctcaaaaaaaaaaaaaagggaaaccatcttgaagtcagacatgattatgattgcttgtactgtttgttgtatgaaaagttaaaacaacctaaatatccaaaataggataatttcatactttctcttgtttcctttattgatttttattccataggaaactgttaaaaaaaaaaaaaaaaaggcccggtgcagtggctcacgcctgtaatcccagcactttgggaggccaaggcagacagatcacctgaggtcgggagttcaagaccagcctgaccaacatggagaaaccccagctctactaaaaatacaaaattagctgggcctggtggcgcatgcatgtaatcccagctcctcgggaggctgaggcaggagaattgcttgaacctgggaggcagaggttgcagtgaactgagatcacgccattgcactccagcctgggcaacaagagtgaaactccgtctcaaaaaaaaaaaagaaaagaatatatgcatgagcaaaagaacataaaacatccgtaataataacccagtaaccattgttggcatatatctttggtatacatcctttcaaattcttttctgtacatataaaaatatgccattttttccccaaaaatgaagttatacttttttttttttcttagatggagtctagctctgtcactcaggctggcatgcagtggccagtgaaccttggttcactgcaacctctgcctccagtgttcaagctattctcctgcatcagcctcccaggtagctgggactatgggtgtgcaccaccacacctggctaatttttgtatttttagtagagacgtagtttcaccatgttggccaggctggtctcgaactcctgacctagagtgatctgcccacctcggcctcccaaagtgctgggattacaggcatgagccaccatgcccgtcctgaggttatactttttgtaacttgccataatttatttcaacagtccataaattgttgaatacttaatgtgtttcacctaaaccctgtattgttggatatcattctatattatacacagtccagaacagtaataattagcttaagatgaattaaaaattaaaatgggtaaaaaattgggtaaaaggtgatcaaaactctgacaaaccagaatactttaaaacttacaagttgtaaaaccaccctatgtagccataaattgctgactttacaaaaagtgacttacagagagtagaactgtggttattagagactaggaagggtaagggggagaggaggatagagagaggttgggtaaaggatacagaattacagctggataggaggaattagtcctggtgttctgtagcactatagcatgaatatggttaatatagatttatttattgcatattttcagaaagctagaagagaagattttgaatgttcacaacacaaataaatgataaataaattttgaggtgatggatgtgctaattaccctgatttgatcattccacattgtatcgaaataccactctatatcccataaatatgtacaattattacatgtcaactaacaataaagggaaaagaaagtgacttatcattgtgctgccagacttaccttgggccaattattttttagccacttagatctgagtctttggtttcaaagaggcctgaaggcctaccctcaaaccttccctttaggcaagcaaggcatgtcaagacctaacccttatgaagccatgcagttatgaccaagtgatttcttcagcctacttcttccatattttgaggattgccatggtttcagcatctgcttcaaggaaaactcagcctttcttccatttctcccattctttcttccatactaagaccttagactaggaaccgtccctgctagaattcaaagtgagaactatatagctcattcttctattttctccatgtcatggaagaatcgtattttttttctaaccactgcttctagataatttcattttccaccattggaagagttattcataggggtatggttaaatgtttatacaggggaatattacctttcttgggaaaatttatcccaagataaggatgaagacaaatgaatattttgtgcattaaagtgggctttttagtttattaccagttggtgagtaaaagatggcctctgtaattctttgtttttctttctttctttcttttgagactgggtcttgctctgttgtccaggctagagtgcagtggcatgatcatagctcactgactgtaacctcgaactcttggctcaagtcatcctcctacctcagccccctgagtagctgggactataggtgcagctaccacgctggctagtttttgtatttttagtagagacgaaatcttgctgtgttgtccaggctggtctcagaacttctggcctcaaataatccacccgcctttgcctcccaaagtgctggggttgccggtgtgagccatcgtgcccagcccccttctattattcagtacaccttccctccctctacatcttctattcttaagggagtactcattattaaatactcctctatagaaagtacattataataaaatacataataagtgattcccttaggaattactgagctggaaagtaatagttttgatctaaaagttctaacctgagtgagtagataggaataatacaggtgcttaggcaaaaatcagtacagatcagctgacaagaagaggaatgtggaggagagctcatgaaagcctggccgtcttaaaatggaaatgttcatattcttttgggtagtacaaaaaggatacgagagtcaagaaaactccagacaaatacctggaagatgggggccagccagtgcccccagtccaaccagatggctgcagtaaagcagtcaggaagtgattaaactagtagaggtgaaacctcagtgccctactaaaagtattagcaggtagtgactgtagcttatttagacagggagaaaacatagttcagagaatagaactttatagaaattctttacatctccagcaaaatatttaccactgtatcggtgcagataggctaagctaatggggcttttggtttttagtttctgtgattcagaaagaaaatccctttctcctctaatgtactgaggagcaggatttgacacggacctcagagtggtagctgcaaagttaagaacaacacagcctcaagaagtgatcgtttcagagctggatttggaccaggaactggactacacagtgggccaaacccacccaaatgcagaagctggccagccaaaacttgtgtgtggttagatgtattgattagctggaccccagctaacttagactacgcagaacaacttagaaatttagaactcagaaaactcagaaacattcactataaattcttctttttaaagactctgagtagcgtcttttcattggcttttttctataaagtttttttttttttggtttttgttgttgtgtttgtttttgtttttaacggagtctcgctctgtcaccaggcataatctcggctgactgcaacctccgcctcccaggttcaagcgattctcctgcctcagcctcccaagtagctgggactacaggcacatgccaccacgcctggctaattttttgtatttttagagatggggtttcactgtgttatccagtatggtcgtgatctcctgaccttgtgatccacccgccttgccttcccaaaatcctcggattacaggtgtgagccactgcgcccagccattataaaggtatttttaaaacctcagctctgtgtatatttgtgactgaaaggggaaaaggcaagttcttcttgagttggacagagaatggagcagcgcagtatagggagtagcagtagtttgctgtttgttgagctgcagaaatgcccggatgagctaggaggaagaggccaagctcggggactgaaaggacaggtaatcatctgtggatgctgctgctttctgggtgctcatacggagttctcatttacatatcagaatctaaagagccaactacagctataatcataacccagctagtttctgaagtgtgctaaacctaaaatgtttgtatcttttgtgatcttttcctgattaacctgtctcatttaactgttccttggttctatcttaatttggtggaagctacagtttaccttctgatccctgttatttttcagggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtaagatttacttggtataataatttagtgactgtttaaagaaaagtcattttctgtagagaatgcagtgtttgttcttgcttaaatgggaatgttttagagcatagagaaatgtgctcctttgtaaataagcagtaactcagtacaaatgaactgatgggttatggctcaacttgggcataccagtttgcaagttagtaaatgtaagatgtataaactaaaaattatttcctagttgtttccctcttgtgtttatatcattactgtcttaagaagaaaacggtttaaaagacaaataattctttgagaattaagaacgttttttatttctaaaaattaaaacctatgcttgtactataactctatgtgagatcaaatacaaatggcactgcaaaaaactgggaacagtgaatactactgatggagactagggacaaggggtagaaaggaaatttatttttcattatgtaccatttggtactttttgaattttgtacaatatatatgatatagtgttactttttcaaatagataaatagatgaattctaagcaaaatgaataaatgtcattattttaagtaaacctaatatataatttaaattctttttttttttttttttttaatgacagagtctcgctctgtcaccaggctggagtgcagtggcgtaatcttggctcactgcagcctctacctccctggttcaagcgattctcctgcctcagcctcctgagtagctgggattacaggcacgtgccactacacctggctatgctacagtaatttaaatttggaagattttgtggccttttaggataatgaattgtctaaacctaagcattagttatacttttcatctagatgtatcctagctttttcacactttcacgtttctagctttctttacctacacgctaacttgcaggtaataaaagtgacaggataaataatattaacactattagtggtaatcccagattgtagtgcatcatcagtgtatacacttgcagataggaatgctcatttacaaaccataacttatttttgcttttaacaagcaaacaatataccctgggtacacaccatcacttcttggcaaataagtgataaccacagacactatgaactctgccacatttgaattttaaaaagacatttggatttacttgccgtttaacattttggcaccaggcgttgcacaaagttttttttttttttttttttgagacagattctctctgtcacccaggctagagtgcagtggcacgatcttggctcactgcaacctctgcctcccgggttcaagcgattcttgtgcctcagctttccgagtggctgggattacagacatgcaccaccatgcctggctcatttttgtattttttacagagatgggtttttgtcatgttggccaggctggtgtcaaactcctggcctcatgtgatctgcccgcctgagcctcctaaagtgctgggattacaggtgtgagccactgcacccagcccacaaagtaatttttaaaataggtattcaagattggctttatgcaaattgttcatgtgtcttcttcagtagtctgattgacaagccaaaaaagacgtcactgcctcttgaataacttatccacctacctgaaatgttttaatagggatttctaaggcttagaagtttttttcttcaaccaagatatacacttggcttttatacagaaggcattatgccacattcccaatcctggttccactgatcacctaacaagctttcgtagatgcccaggccccaccccagagattctgatgtaactgatctggagtgaggtcctggccattaatatggtgctttgggacagtggtttccaaacttggctgattgtcagaagagatgatctgggatgttctcaaaatacataattctgatccattatatctgaggttgggcttaggaatccataatttaaaaaaattcttctaatggtcaggagtttagtttcatatcacttgccttagggtttaagacaataagttatagaaatatcttattttaaaaagtgacagcaattgacacagggtgctgtgtatatcgggtgttggggaggtggaggagatgagcagactaagaagaatgcaaataactgtagcatgagacaaactgtggtgtgccatgaagaacattccaagtacagtggatttcagggaagaagagaatgtatttcaattgctggggccagaaaggcagaaatggtaggagagtattagagaagggcatcccttgagatgatgttttatagcagagataaccgacacacacataataatgacatagtattattagtggcattatggagattaacgtaattttcagaaataacactgggaagattggccacgttacaaagtaccttgaatgctgagttgagttgtgtctgctcagtagacaagaaggaaccaaagaaaatttatcagaaaactgtactgtaggaagagtaagcagggcagcacaatgtgagcaaaaaaattggagattaatcaggagatttttgcagaattgtaggtgaaagtaatgagtccatgagtgagaggagaaatggaaagggcaggatataataagagacccatgaaaccaattggaaatgggcagttggagaatgggatgaactgaagatggtctctcccgccgtgtgcatctttgtcaaagcctggcatagtaaactcagacccacaaaatgtttgataaattgcagaatgtcagaattttctacttggataaaagagaatacatggtactgtcatttatagaaaccaggagggggaactgattggagtggaaagatgattaatttgattttaaggatttggagtttgaaatatcaaagaaacattccttcttattctataaccgagctctacaaacctgtagtattaaacattaagttctgcccattctttttctttgtcattttgtatatatgacttttagaaagtatctaaattgttgaaatggtcatttgccaagtgctttttccattgtaatgaagacatttataaaggtaaaatataaattgctttttgttatggcacaggtgggaacaagagcccagtcagagcgaattcggacatataatttcacccaggatagagtcagtgaccacaggatagcatatgaagttcgtgatattaaggtaatactactgagtatgctttgcctacctttgatttcagaagaaaatatagtcaaattctagaacatatatgtagatattaccaagtatatctaaaatattaccaagtaatttaaatcattaagccaccctaaaatttacaaacacttttattagtttgctggttaaaaaaataatgatctttatgccattttgaaacaatggtcttttctaaattccaaattcttcgttatgcaatcacaatgcatgaacgtatattcagtctgcatatatacatgggtattggttttctattgacaggtaacaaattaccacgaatatagcaacttaaagcagtacccatgattaaagtattatctcatgatttctgtaggtcagaaatctagggacaactgagcttagttatcttctcaggatctcacaaggctgaaatcaaggcatggccaggctccatactcttctggagcttggggtcctcttccaagtttatgtggttgccagcagaatgccattgccttcgattgtaggactgaagcccccattcccttgctgacagtcagctggaggctgcttttcagcgcgtaaatactgttggaagttgtttcccagtggctacctccagagactctctcccactttgaatctcttcttgcaggaatgactcgggcctttttaagggctcacctgtttaggtcaagctcacctggataatgttccttttgattaactcaaagtcagctgcttagtcacctaggcactagaatgatactccatcattttcacaggtcctgtctgcactgagagggagttattcacagtgtgtacaccagggggcatcttagaattctccctaccacaatgtgtcttcattagattgaggtgttacagttaggctgttggggaaaagactcggtcaagattgtttgaacattaacctatctaaatcgcatccagcaaagaccactgacataaatatataaatatattaatgatgaagcacagaaaaatgtcttttttgttgccactgaaggagaaagtgaactggtcccataaaggactatgtggaaaaggcagcagacagaaatctttgatgtttttccttggtgccatgtgatacctaaggcttctttcacttgactctgtcccatcctattctcaaaattaaagtcctagttttacaagggaaatataccttgtaaaaaagtcctagttatacaaggttaatatgtttgtcaatttctgtatgtcttatgccacatcctctgtctcctcagcaggataaggctatcttgcttaggaacatagccatgttgaaaaggaggaaaatatttgctaatttccctttcctccggaaacacacagtattaacgaaacgtgtttggccatattgttctaattacactatgttctttcagttgtttttctggtagtagtgacaattttttcggagacagccacattcttatgaccagtaatatcttttagatgggaccataggtgcatagtatagtattcggttgtgaaacaaagggaaggtaactaactggcttctgtagttataaaatatctgactttggcctaaataataatatatcactaaccaaactagcatgccagactcagaagtaataaggaaaataacactggtaagctctaataatcactaactagtctactggaagaagacattccatagtagtgaaaggaacaaagtttgaaaacagcatgaaaaaaggtagctgtagtaaaacattaaaatctgtgtgaaggacagtaaagagactagtaagagtgaataattggctgggcacggtggctcacgcctgtaatcccagcactttgggaggccgaggtgggcagatcacgaggtcaggaatcgagaccatcctggctaacacggtgaaaccccatctctactaaaaatacaaaaaaaaattagccgggcatggtggtgggcacctgtagtcccagctactggggaggttgaggcaggagaatggcatgaacccgggaggtggaacttgtagtgagccaagatcgcaccaccgcactccagcctgggcgacagagcaagactctgtctcagaaaaaaaaaaaaaaaagagtgaataacttaggaaccaaatcatagatgaagctggaaaagtgataaggatcttaaccccagggcaacagctgttggacaaatggaaggggtagataggaaagaatgtgagcgtttttggaactttttgcctagctttcctcccttattctagaacttgcccttcgtaccacatccacagtttctgacagagctgctgcattcttacatgatcgtgatcctgacccaggacaaaagtggatttgtttggagtggacacccaaataagtcctagccagtgagtttcttcccaggattttaagatcagagatggagaggattattctctctcttggtggctgaaactgcaatatataaagcatgtaagaggttagaggccacattttcagccaccaagagaaagcatcttcagtgagaagagaatgaaattgatacacagagaaaagcaaaaatgagaaatagacagaaagaaccctgatgatatgagtccctacatttatttattcccaaggctcagtctcattccacgggtggtagtcgtgaccctgcacattccacattcctatccttggattctgtgagatcacctggtattctcattatgacttcttctgttaggtaactttcttacttttatttatcgagctaataagcacagactaccatataatgtattgtttcacatttttattgtttctcaatgtccttgtgcagatttcttgacatcagccttatctcctgctctatattccagttacactggaaatttcccctggccttagagatttaaatgtactttgttttcctgtttttttttttttttttttttcgagacagattctcactctgttgcccagactggagtgcagtggtggaatctctgcagcctctgcttcctgggttcaagtgattctcctgcctcagcctcctgagtagctgggattacaggtgtgtaccaccatgcctggctaatttttctgtgtttttaatagagaaggagtttcaccatgttggccaggctagtctcgaactcctggcctcaagtgatccacccaccttggcctcccaaagtgctgggtttatagcctgagccaccgcgcccccagcagttttcctgtcctaatactcattctttttttttttttttttttttttgagacagaggtttgctcttgttgcccaggctggagtgcaatggtgtgatctcagctcgctacaacctccacctgctgggttcaagcgattctcctgcctcagcctctggaatagctgggattacaggcatgcaccaccatgcccagctaattttgtatttttagtagaaacggggtttccccatgttggtcaggctgttcttgaattcccgacctcaagtgatctgcctgtcttggcctcccaaagtgctgagattagaggcgtgagccaccacacccagcctctaatactccttcttttgacggaaatgcccagctcatttctattcgggaaaatactattctctttgtaaaaccaaattcaaaactttctggcttcccgaatctttccctgatgccacctttcttcaaaattcatggttccttacaatccttcctttcttctccttcattttttaatttattatattgttttgtgatgcttatgtatttgtctagctgttctacttagactgttagcctctgaaagttaggaactatgactcattcatctttgacctttgtatctcctgcactctggttaatccagttgaatctaatgtgtttgactcccagtagagggataatccttttacatcaattccaaagatgattaccttggcaatactataataatttgagtaccaggtacatttttttttttttttgagacagagtcttgctctgttgcccaggctggagtgcagcggcgcaatctcggctcactgcaacctctgcctcccgggttcaagcaattctccagcctcagcctcctgagtagctgggactacaggcacacaccaccacgcctgttcaccatgttggccaggctggtctcaatctcctgacctcaggtgatctgcccgcgtcagccttgcgaaatgctgggattacaggcatgagccactgctcctggcctagtcacactgattttaaaagcaatttcatattttgctcaaagtgatataaaccttaattttaaagttatatcatagtgtttttgctttctgtttaatttcagagtttgaggttttactatatgctggtactttggggaatacagaaatagtaagatatatcctttaccttaatttgagagatgtgtgtgtacacttcctaaagttcaactttaagaccattcaagaaagacttaactataagattagttcataactatatcaaaactaaatgttttgtgttccagatgccaacattaaagtattttcattaagccagtgtctaaatttcaagcatttctaaaatggcaatgtacaaattcattaatcccaacaactttactacacagaatttctgttatacaggaaaagttcttgaagtcattaatttagtcatttttcagagaactgtagacgagacttcagggaagtcaactcaaaacagttttcacccagtggagttatttagtggtaaacatgaaaattttttttctcaactttttatttcaaactttttcaagtttacataatgtttaaagattgggtcagctgggcacagtggctcacacctgtaatcccagcactttgagaggcagaggtgggaggatcgcttgagctcaggagaccatcctgggcagcatggcaaaatcctatctctacaaaaaaaaaaaaaaaaaaaaaaaaaaaaattagctgggtgtgtagcatgtgcctgtagtcccagctactcgggaagctaaggtgggaggattgcttgagcccaggaggcagaggttgcagtgagccgagatcacaccactatactccagcctgggcgacagagcaagagccagtctcaaaaaaaaagattagtcaatcagcacaatatagactatacctagattcaacagttgttaatattttactgtattttccttctctttccccccaccatttcctctgtctctctataaacctgtgttgctcttgaaccatttgaaagcaaattgcagacctcaaagacacttcacccctaaatatttcaacaaaaatatttttcagttacacaggacttctagatcatcatgttttcggtttaaaaataaaaaactatcataaaccacttacagatgaaataatctaaactttgaggattagcagaagggtgagcttgaatggtcgggggaggcttcctctcagtcagatccagaggagttggcaaggagcagtatgtgcattaatgcacaaaatgcttgtggaacaaattgcttgtggaattgagacctttcagtctttttcctctgggaaataacataatgtgagtgaaaagggtagaattttcaggacaagaataaaagcattttttttttagggtacaataagagaaaatccagcaaacccgttctcctaaagatggtttgagagcctagaatggtgttgtcataaaagccaatcagtggaattttaaagggagggaggtggtcagtttcaaaagtccatctagatctctttgttttgttgtctctggagttgttaggaaaatccaaatctcagaagatttattttaaaataaaatgctaactgaattcttctacagagtggggatcttcccaagttagcgattgtgttcattgtattacagaacattagtaatcctttattgttattaaataatgactgcaaagaatttaaataaataaacactaaagtctttgcttatatttctaatcattaggtttcataatagctctctcttttaccaggaatttttatgtggtgggaagggcctggatcagctaattcagagactgcttcaatcagcagatgaagaagccattgctgaacttttggatgaacaccttaaatcagcaaaataaatactaacttattattatttatgattatataaatgaaatggacctatatcaagaggcagactgaagcttggaaatcattatgaatatttgtaaattacagctttaagaacacattacacataaatatatgttttgtaattaatcgaagtcacatttcctgacctaagaatttattttaggtttcctgtaaagtacaatccaactcatcaagtagaaaataagcatgcatcattgaaaagagaaagtattgagaattgattgtgtcatttaggacaagtcacttgttctctttatatgccttttttccccagccatctatgaattaatttaaatatatttttaatctactacttcaggaaaatatggtaaaatttagtaaaatatgaattttagacttccttataaaccttttatttaaatacaaagtaccttggcctatagtggatgcttatgcctgtaatcccagtgctttgaagggccaaagggggaagatctcttgaggtaagaatttgagaccagcctgggcaaaatagaccccatgtctacaaaaaaactcaaaacataaagaaaaaccataatactgttaatcatgttaaagttaagacttagactgcaacttttaaataaaaattatgaagaatatgagtcattcaataacaatgagcatctgggtacagacagtaaagccctttgattgctgtatgaattccacactatataaacaataagctgatattttaaatagactctttgtttgacttctatttcttttttttttttttttttttttactcctggcaagctggagtaaaaaagttattgtttgctggcttaacttaatgagcatcaatagatgtgtaatatgagtaatacactgagatcagttttgtgcagcattatataaaacccagtccttaccttaaagagcttgcagttgactgaaggatttaaacatgtaaatcaccaagtaatacagagtggcatgatgtatttagtaattgttccgaagacgtttcaagttaaaaagagaggaatggctgggcacaatggctcatgcctgtaatcccagcactttgggaggccgaggcgggcagatcactgaggtcaggagttcaagaccagcctggtcaacatggtgaagccccatctctacgaaaatacaaaaactagccgggcatgatggtggatgcctgcaatcccagctactcaggaggctgaagcaggagaatcgcttgaacccaggaggcggaggttacagtgagctgaaatcgcgccactgccctccagcctgggtgacagaccaagactccatctcaaaaaattaaaaaaaaaaaaaaaaaaagaaaggattattattttagttactcctcagagaagagtttatgtgccaagaaagactagttaagagttttaaggccaatggaattgtttgtatgtaaacattaaagaggaatgttttccctaatttttattttgaaaatattcaagcataatgaaaagtctaaaataaattatttatttatttatttttgagatagagtctcgctctgtcacccaggctggagggcagtggcgtgatctcggctcactgcaacctctgcctcctgggtttaagaaattctctgcctcagcctcccaaatagctgggattacaggtgtgtgccaccacgcccagttaattttcttgtatttttagtagagatgaggtttcaccatcttggccaggctggtcttgaactcttgacctcatgatccacccacctcagcctcccaaagtgctgggattacaggtgtgagccactgcgcccagccaaattatttttttagagacaaggtgtcactcttgcccaggctggagtgcagtggcatgatcatagctcactgtaaccttgaactcctgagctcaagcaatcctcccaccttagcctcccaagtagctgggactacaggcatgcatcaccatacccagataatttttttattgttgtagagatggggtcttgcatgttacgcaggctggtcttgaactcctggccttaagtgatcatcctgcctcagcctttcaaagtgctgggattacacatgtgagcctttgtgcccagccacaataatttttaagaaatagttcaatcaggagaggtct

SEQ ID NO: 15822 - DNA, 26452 bp, Human
aacatctgctttcagtaatggcactgaccagaaacccatctacaagagtcactttttccttcttcgtttgttcccagaggcccaataaacattatagccgaccctattttctaatttcagcttgcatttaagataacgcttttgtttcatttacagctcacatgctgctgacacagctgtcccttctttgtaataaacacagggcttctatatttaaaaatacagtgaaactttgttttaacgtcccctccccagtctccagccaattttctctttcccaagccccacctccaccccaggatgttttgccgttgttttaatcaatttttttctttaaatcaaccgcgctcaaaatgttagaccctttggaaagtcgatatacttatttaaagccatctcatcagagtggtatttttctcctccatagctcgtggtgtgtatttttaaagggaaagaaaaaagattctcgttcccaaaggccttttttcgagggtactttccgtgactgcgaccagcgccccttaagtcaagttgggaagacctcgcaggccggcctcgcgcttgctcaggcgccgcgggtggagacgcgagcgcacacgcggcggaaaggggcgccgggcggctgcgcggccgggaaagcgcgtccccccgggagggcgcggaaggcacactgtgttccgtggggcctcgtaaataccctgcggccagagaaccactagagctactggtccgggcgcgggctctggggcgcccagggcaggggggtcagcccgtcctgcataggaagagtcgcaagagcggctgaagagggtgtgggccggacgggggcgctgggaggagataacgcaaggccggagttaatcatcacctcccgggcgtctggaaaactacgggccggaggggcgggggagcagcccaggggaaagtgaaactccctcagggcccaccagccccgtgagccggaggcgggagggagaaggatcggaagcgcattcgcttctccagcaggcacggcgtggcactcgaggctccaaaagccgcagcccagctcctggcgccactaactacagtaatgcttattttctacaaactcacccagacggggacaagaaaggagccagaacacaagatttaaaaagtcagccctccaaaccgatagttgcaaaaaaaaagaaaaataaggaagcgttcccataccgggagtcgaacccgggccacctgggtgaaaaccaggaatcctaaccgctagaccatatgggaagtgctatgagaaactgccgtgacccacctgacaagcataagtgcctctgcctccttcgccgcacctctcgccaccgccgcctctgcgctactgaagctgctgctgccgccgccgccgccgccgccgccgctgctgctgcccacacgctcccgagctagggaacaagccccatccgagcgcgtgggcgtcgtaggggagaggaggggcggggccgctccgctgcaacagcaaagtttgaggcgaagcctagcgactcgcagcgccggtcccgcagtttcacctcttttttttttaactccgccagaggaccccgacccacaggtcccggttgctccgctggtcaaagtgcgtgcggagtagttggcaaagttgagagcggagacgtctctgggaacagctgtttgcgttccgggcggaggcggcgcgctgagctccttggccttgagccagcgagcctagaaggaggatggaggttttgggccccaggggaggacacagagacggcgggatggcgcagggacttgaggcttgagatcccgtccttcagctcaggtcccgtcgcgcttttaccccttcccggtgacctcaacccctttataccgaccccacctctttggagccgggagtaccgcccctgtagggggaggggagaggaggcgatttcgaacgcggattggatcgtctgggcacccgtagttgggaacagcggaacgctggtcccggggactgagtaaggtgtctggatcggagggaggttcgggtgggcatcgggcggctggaagagctcgactcgtcccgctgggaaagcgcgagtctgagtggaaccctggacgacttgcagagcggctggcgcagtcatgtgagttgggtctcaggccctgaacaacgaggtgttgtttctctgggccgccctttctcgcccgggtcttcccctcctctcctcccgcccttcggccgggggcgtgacagacgcgttcttaactcgctcgggaccggccccagacctgcagggccggttctcagggcggggtagaaatgttaccccgctgaacgccctggggtatggggcacgggctctagggggaggccggcggccggttcagggggctggttggacggccgcgggtgaagcgacgcagtgctctctctacgacgctgtcgggggtcgcatgcaccccttgggtttccgaagcccctgaaccctagggtattgtgaaactagggctgggctgcggcctcccccgcccactggaagcggccagccctggatagcgtaatggttttttttttttttttttttttttttttgtcggccgtctacgaagtcccatggcttttccagttctctcttgccttgaggctcaagaacagtttgttttaactgagagtctgggaggaactacagttttccccagagtagtcttgtacgttgttctcttggtgggaataacttgatttaaggcaaactttatgagtttcttcaggtttccattacagcaacctcccccaaagccagaaaggataaatgttcttctaagatgttccttagtttttcataacgatgacgataacaagtgaggaatttttgaaagccattttattgaagggagttttgtaatgaatcagatacagactttttctactccgctggcaacagaatttcaattgactgtgctccaaccagataaataataaaacgactatacataacaagacaagattcagtagcaggggcatatatttcaaactttaaaaactgtaaagcatgcagaatttaaccttttttaagttttacatgagcttagccttgttgtctctctttttcagggcggactactggaagtcacagccaaagaaattctgtgattactgcaagtgctggatagcagacaataggcctgtatgataattccgctgttagagattctaataataattgtgttgaatgaagtgctcctttttgatgtaaactcagtttacaaagcacttttatgtacattgctcttgcattttcaaaacatcagaagatttctgtcttctcagtcccctatgaaagctgtgagccttcttccttttcatcaacctgactttgattatatattaaattatttctctgtggccttttgggaaatgggcaatgagttggtcatatcattcatgttatgaagcacctatattataatggtggtgttcataatactgtcatacccaaagaattgtggaaagcccttaaaaaataaaagcaacatgtttagtttttcttgtatattttgtggtctagaaataatcaagtgtatttaatgcagagctgtgtatctttagatgcttaaatttgaaagaacaccattatttcctttctcatgaaacaaagtaacaactctgttaggtatgttgttagtctgtctcatagttgagatccagttttgaagatgtaaagcaaaaagcacaccgctgatttttctcccctcttgcatgtcaaaatactatgtacataccacataaacactagggtatctgttaaatatattttatgttgataccgtttttacttggcaaagttggatgcacaaagaatagtagtctcatattttaacaatgctgtggatttcttctgtagacatttatttcctgttacctgcaaggtgtttaggatttggattttttttttgatgttttggtctttttggatagttgctaaagttcttcactattttacctaggctatccttataaataaataccatgaatttttaaaaccacacaggtcacttaaagtctctctttcttggaggtacctaggctgtaaaatgaattttgtgagttatctagagtaagtaatcccttccagtgtagtctgtctttatcttcttgagttggtaatacacattgatttaacctttaattagaaacaaaattaatttaattttgaatggtcctttaatattgtattctttgtgtagtgtaatcaactttaggaaacgcaatgtatgaaaaacaggaggattatctgctttacaaagtcacactttaaagatgaattcatggtagtattttaaaatagctcagttaatgcatcatgtaagatttgattgacagaacttattttgcagagcttgtgaggaatttcttactgcatttaactagaaacttgtaatttagggagcatttctgattgtttaaatagataattgcgctcactcaccagcccctgtccccagtcatctagtggccatcactccccataggttatcatttttttttttcattttcttgcctatccttccattgtttctacatgcatgtagacacaagttcttattccagcatacataaaaggtaatgtactgtatatattattctgcactagttttaaaaaatttaacagtatgtaactggagctccctttgtatccatacataaagagcttctttctctctgttacagtagactatgagaatgtaccatagtttaaccagtcagtcccttagagatggataccgtattgttattgcaaacagtgctgcagtcagtaagcttgtgtatatcatgattttgtacatgtgcaggtatatctatagaataaattaccagaaatgaaattgctgtgtcaaagggtaaatgtatttgtagtcttgatagatattgccaaattatcctccatagaagttgtacattttgaaccattaccacattgtataaaagtgtttgcttataatttacgaggaatcttaaaatacatacttttctcctaaatttaaggaataaagcaataaaatcattgttctctatgtccctccttgtgacaaatagagcaataaaattctaaaggcttttgatgttgaaagttgtttaagatttttttccccagtcttttggcttcatgtcacgtttgagtcctcattacaatcatagtcactagattagtcatcaagggtaccttgtatttttctccattaataaggtcatcatggtttattttaagaaccaaaggaaacctagtcagaggacataataataaacaatgtagttccctagcatcatttgattaaaagggccaatttgcattaaattaatgttttcatcttttctgccattcattttaattttaattttctcatgtttatgagaaaattatgtttactatgaattttatgatgtttatgtagttttcttttgttattttctcttttcattttcaagagtgttgaatttcatgaaagaggaaagaatcataaggaaaatgtggcaaaaaggatcagtgaggtaatttagattgtttatttgctaatttttctatgcaaatgtcagtcctttatctcactttcactgttatgtatgtcttacatagattaaacagaaaagcctggataaggcaaaggaagaagaaaaggcatcaaaggagtttgctgcaatggaggcagctgccctgaaagcataccaagaggatttgaaaagacttggcttagagtcaggtaaaaaaaaaaaaaaaaaaaaagcagccagcatgttttaaaagtaacatcagaggtcaagctaagtaagctttgattgcttccataaagaggttataaactcagtgtactctcagtgcttttattatgcatcatagccctgtttagactatggaagtttgcttatgcccttttgttgtacttttaatgttttatcttttaacaccttcattcatagcagccatactacttttgtggtcacctaatcctagttctatcctaggtaaatggttcatttcagagacactttgagttttttaggtattctagttatttggctaagagacactattcatttaaaaataggccttgcattataattgcaattcactgtgtccatatggtcaaaattatgagtcttgtatatttatatgggtgaatatgtagtgaattagccttttgtggacaattagcagattttactagtagaaggcagatatttactactagaaggaagttccagatgaaagaccttatttaactagactgcatctatcttgtcattgaatttaggctttaaactgggaaggttttgtgaataattcttccatatcaaatccgttttccttaaaccaggcatatagcagatctcagttgttgatcttacctagtggttgcagtcatcaacatgtgatggtattcctctaataaaaacagctttcaattaaggttttaagcagagtaccagttaagttaattggcattgtgttcattaaataagaacagttgtagccagactttgttatcctggacattggtaattaaaaggtgggaaagttgtttggttccttgaggataaagccatatgttcatcttgaaaggaaaaaggatttaggcattcctggagaattaggaatagatgagagtccaactattatcaattatatgcattgagacattccattatgctgccctttgagcaaataaattttaccattttatatttaaatggatttttcctattaaatattaccatagccttgtttttccaaataggatacatattcaaacatacaacaatgcagtacaaagaaaagagtttttaaaaactcactaactgttaagattttttgcagacctcttctttagatctttttttaaattacatattttgtgctgcggtctatttgccggttgttttattttttccctcagtgatatatcaaatgtatcttttcttttaattagggagatgtatcatttttatatggtaggagcagactttggagtcaagcagaatttcctcttgctagttatgacttttgatttttattaaaactaagtaacattatggtataaattgcttattacgtgaccacacataacaaatggtgaataaatggtagccactgttattttgtctctgtactataatttatttaatcttttcctggttaacatttaggttgcttagcatttttcactgtcgtaaagagtgcggcattaagcatctttatgcatgtatctttttacacttatttttctctgtaggttcagtttctggaagttacagtataaaagtgtgaatatattttatattgatagctaataccacattgtctccagaaatggactgatgtacattttcattagaacaaaaataagtttattaacccgttttaggagtaactagccaatcctttggaaagtaaagccataaaaactatttttctctttttttgaagacaggtctcgctctgtcacctggttggagtgcagtggcaaaatcatggctcactgtagcctcgacctcccgggctccagtgatcctcccacctcagctcgtcaccagtcccagcgattttttggtagagacggggtcttgccatgttgcccaggctgatctggaactcctggcctcaagcaatccacctgcctgggcttcccaaagtgctgggattacaagcgtgagccactgtcccccaccaaaactacccattttttcaaagcaatgtaaatacctgatctatcaaactaatactggatttggtcattcttttcactacttattgatcttctgcaaaacaacaacaaaacatttctttgaatattagcaaaagtaaatgttaattggccaggtgccgtggctcatgcctgtaatcccagcagtttaggaggccggagtgggaggattgtttgagcccaggagttcaagaccaacctagcaagatggtgagaccccacctctactacaatataaaaataaaaaattaactgggcttggtggtgcgcacctgtagtcccagctacttgggatgctaaagtgggaggattgcttgagctgagaagttcaaggctactaatgtgggctatgattgcaccactgcactccagcctggacaacataagagaaaaaaaagtaaatgttaattatctgaattgtctttgtaattgttgtccatttttctattagaatgtttgatttgtaaaggatctttgttaggaatattaaccctttgccatatttattgtaaatattttttcatttgtcttatatatgttttttctttttatttttgtcatacagaatatcttaatttttatgtagtcaaatttaacattattttactttgtgttctttttgtaactatctttgacctagtatttaataaaaaggggggaagggagcaggtagtggggaacagctttacttttttcccaaataattaatcagttaatctaaaaactttctttttaagcatgctttctttatttcctttttttaatatatatatagatgtagggggtacaagtgcagatttctcatatgcatatattgcatagtgatggaatctggacttttagtatacccattgcccaaatagtgaacgttgtacccagtaggtaatttgaaaacctctttttttaatgatctgtcttttatcctctgatatgaaataccagccaacctgaagttggctctgtatctggactattttgtttcaattatatgcttgcctatttctatgtcagttccacactgctggctgtttttttaacccatagttttagaataagttttaacacctggtagaactaaattctcctttttctttttattacagttttccttcccttacatgtttatttttccgaatgaactttataataatgtgttaagttctcaaaagaaccttatcaggtttttgattggaataacattaatgttttatgccagcaaccataaaaaatagtagttactatagctgctttacccttctctcatctctttagaaattttggagccaagcataacaccagtaaccagcactatcccacctacctcgacatcaaatcaacagaaagaaaagaaagaaaagaagaaaagaaaaaaagatccttcaaagggcagatgggtagaaggcataacctctgagggttaccattactattatgatcttatctcaggaggtaagtcatttaggcataaaactggtaaagaacagtgtcactagtagaatagaacaatttattttatgttaggatttttatctaatgttggagcactttaaatagtgaaagaccggtttttcatttttgccccaaaggtaagaaaactgtgtgccctttaaaaaggtacccttctcatagtgactaagtgtcatacttagtcaaagcctttgataatgactttcttacaaataaactatagctttatattttctcaatagaaacttctgtaagtataaactacatggaaataaagaattttgcatagaaataaggaatttcaaatccacttcacaaattgtaggggtacttgaaataaaatattctacagtagagattttcttctgggagccagtaactgatttcttttttctgtagctgccttgattgatttgatattgttactgaaaaatgacattgtgtattttactggaaactgatacccaacagaaaaatacacagtgccatggccagatgcagtggctcatgcctgtaatcctagcacttttgaggggccgaggagggtagatcacttgaggtcaggagttcaagaccagcctgaccaacatggtgaaaccccatctgtactaaaaatacaaaattaggctaggcgcggtggctcacacctgtaatcccagcactttgggaggctgagatgggcagatcacaaggtcaggagatcaaaaccatcctagctaacatggtgaaaccccgtctctactgaaaaaacaaaaaattagccaggcatgatggtgggcacctgtagtcccagctacttgggaggctgaggcaggagaatggcgtgaacccaggaggcggagcttgcagtgagccgagattgggccactgaacccaggaagcggagcttgcggtgagcgtagattgggccactgtactccagcctgggcgacagagcgagactctgcctcaaaaaaaaaaaaaaaaaaaaaaagtagccaagcgaggtggctcatgcctgtaatcccagctacctgggaggctgaggcaggagaatcaattgaacccaggagatggagtttgcagtgagcccagatcgcgccatttcactcctgcctgggcaacaagagcgaaagtccatctcaaaaaaaaaaaaaagaaaaaaaaaatacacagtgtcgttttacagtaacaatatcaaaaacatctttttttgtttttcctaaaaactaaatgtatttggggtttttactccgtatacattttggaataaattaatacatttattctacatttatgtagcatcttactctccagagtcataaaatttagcgacaaataaataagcttgataaaaggaggaattttaaagtgctataatagaagtgtaattaagattatatgggaactcataataatgttgaattcattgtgattatgtagctttgagagattaccataggaattacttttgagctgatctctaaattaagatagggacatcaggaatgatgccttactcaccattgtattcctggcgcctaacatagtgcctagcacagtgtagacactctgtgttttgattaaagaagacttcagtagataattaagaggtacagaatccacacagaacaatatgaaccccaaaaaaggtttgaaagtattgggaaatagtggtcgaggtaaaacatgcagttctttgaagacgtcttagtagagttagactggaaggtagattggagccatcttatggagggctgagagaatgatggtgccatttacttagatacgagataaggaactgaaaataagtttaatggggacaataatgaattagatacgttgaatatgaggtacctacagaatattcatatgacagcttttggtagctaattgatggttacagtgtggagctgagcaaaattgagtctggggatgtagataatatgttagcctttaggagtatatgagatcgcaagcagagagaatagagcaagaagtaaagaaggtgagtgttacatatattaaaggaatggatagaagaaaagccagcaaaagaaggttaagaatgctaggaaggtaggaaataagatcagagagttaatcatgaagaaatccttgggctaacaatcttactgtaatgactattatcattaggatcataattacctttggactatgtagaaatattaatccgttagagtttgcactgagctttaagtgacatgcatattgtagtttagcaatgaagatatcataaatgattatgtactagcaattagaagtctttctcaaatttacttataaactgttatttcatttctcccttccaatgcttattgcttgcctctctttttcagcatcctactttatatactcttcctctccatgatacatgtttttaatttctgcatactagttgttcctcttctgagttcttattcagtttatctctcactctcccttgccccaagatatcaaaaggcctttgaaacttatcagacctgaattctgtgaaacctttatgagaagccctgcctggctctaaaattcctgtggaagttccagtaacttctaatccctcgttctgtcctttcttcttggttacgtagcattcacatatattgtctgcacagtactgggatgtatgttctgttttatttttcaaatatgttttaaattgtagacctgtagtgttttgtacataatgactgtaaattttgtccaaattttttggaaagtatttttttaaagcaaaaagattttataaatgcaatatattttgctttaagcatctcagtgggagaaacctgaaggatttcaaggagacttaaaaaaggtaattgaagcatattaatagtgtttttgttttattctttacagtgattcgtttcttaggtttttgtagagttttgctaagcaactttatttacaaatactccactccctccacccccaaactgtgtccttttttttcccataatgcttttgttagaaggctggatggagatgaaatagtgatatctggctgggtgcagtggctcatgcctgtaatcccagcactttgggaggctgaggcatgtggatcacaaggtcaggagttaaagaccagcctggccaagatggtgaaaccctatctctcctaaaaactacaaaaaaattagccaggcgcagtcgcagttgcctgtaatcccagctactcaggaggctgagtcaggggaatcactgggacctggggcggcagaggttaacagtgagccgagattgcaccaccgcactccagcctggataacaaagtaagactccgtctcaaaaaaaaaaaaaaaaaaaaaagtactgatatctatccaaaaactgcattcagggcaaatattagttggtttgccgtcagttgccattcacatgttcctgtccatttggaaggaattgttcctggctttcaaaggtgagacatccactgcttgaaagttggttctttattagcaaaaaccaagcttcctggccatgattagtactaccacccctaatacccaggtgtattagtcagttcttgcattgctataaagaaatacttctgaaactaggtaatttatcaagaaaagaggtttaattgactcacagttatgcaggctgtacaggaagcatggtggcatgagcttctggagaggcttcaggaaacttacaatcatagcagaaggccaagggaaaacagtcacatcttacatggccagaccaggagcaaagggaggtgccacacacttttcaatgaccagatctcagggtagcttgctcactatttcaacaacagcaccaaaggtggatggtgttgaaaccatgagaaaccacccctgtgatgcagtcacctcccacaaggccccatctccaacttggaggattacaagtctacatgagatttgggtggggatgcagatcgagatgatatcaccaggtgtcaggaggagaggcaagggtggctgactgtctgagttattcaatagaaaatcatggttatccttagtttatgctgggtttttttcctcctattagacagcagtgaagaccgtttgggtagaaggtttaagtgaagatggttttacctattactataatacagaaacaggaggtaagtattacctttgattatcttaactgtttaaaattgtacctggaactgcttattggcctgctgattaatcatctgaacttggaaattttagtatacaataaacatatttgtgtagtaaacatgaattattttttgtaatttaaaaacaatacagtggaaaagcaaaaagatttatattcgtattatgttgtgctgttcaccaatgttattctcagttgatattgcattcacaaacttaaaaatagaatcattttagctttctctgacattactatttttataattattttagaaatatagtcattaccttggaaggtagcttagagatcatctggctcaacttgccttttcctttttaaaaataaaactgtggccgggcacagtggcacatgcctgtaatcccagcagtttgggaggccaagacaggtggatcacctgaggtcaggagttaagcgaccaacctgaccaacatggtgaaaccctgtctctgttaaatacaaacaaattagccgggtgtggtggcacatgcctgtaatccaagctacttgggaggctgagacaggagaatcttgtacctgggaggcggaggttgcagtgacccgagatcgtgccattgcactccagcctgggcaacaagagcaaaactctgtctcaaaaaaaaaaaaaaaagtaggctaggcgcggtggctcacgcctgtaatctcagcagtttggaaggccaaggcgggcagatcatctgaggtcaggagttcgagaccagcctgaccaacatggtgaaaccccttctctactaaaaaattacccgggcgtggtggtgggcacctgtagtcccagctactcaggaggctgaggcagagaatcacttgaacccaggaggtagaggttgcagtgagccaagatcgcaccactgcactccagtctgggcgacagagcaagactgtctcaaaataaaataaaaaataaaactgaagctatttagtagtgtctaacaaattagtaaaagtgaaaatttaacaatgtttcagttgcataaatacttacgaagcatgcataaatactaattgttatctaaaactttttttttttttttgagacggagtcttgctatcgtccaggctggagtgcagtggcacaatctcggctcactgcaggctctgccccctggggttcatgccattctcctgcctcagcctcccaagtagctgggactacaggcaccagccacttcgccaggctaattttttgtatttttagtagagacggggtttcaccatgttagtcaggatggtctcgatctcctgacctcgtgatccgcccgcctcggcctcccaaagtgctgggattacaggcgtgagccaccgcgcccggccctaaaactttcaaattaatgtttcatctaatttaacatcataaacagttgaatttatcagaacagctataacattaatgtaactttaggagaggcttgtttttgtttttttaattcctgttatcattagctcattgcatagcattaaatcttttaggaagaaaaggcccttttaacctccaagtagatatttagcctgcccagttatagcaatgtttatattccagtacaattgaaggttgggatttttatacatataaaatagtatagtgatataatatagctttagagttagacagatctgagttcaatgcacagcttctttccttaccagcaatgtgactgtgggtgttactgagcctatagtcactcttcagtgaaatagaataaacatgcatgctctgtaaggtcatgaatgtcatatgtcataaagttccaataacagtgcttggcacatagtaggtgctaaataaattactccctgaactggcgtggtggttcacacctgtagtcctagaactttgggaagttgaggcaggcggatcacttgaggtcaggagctcgtgaccagcctgggcaacgtggtgaaatcctgtctctactaaaaatacaaaacctagctgggcgtggtggcgcttgcctgtggtcccagttactcgggaggctgaagcaggagaatcgcttgaaccggggaggtggaggttacagtgagctgagatcacgccaaataaataaataaaaataaaataaataaattcttgaaagttctattgttaacttgtgtgaaatgtggattaggaaaagtaatgttttttcattaatcctgccaagaactctgtattaattaaggtgctgtatatattggtttgccttgaatgattttggtttattcctggaccagaataattactaacggcagcccctttcactcttaaaactctcccagttgaaagtagggaattaattacaaggtaattagaaatattattgttttactaaaagcccaatgaaccactggatggcagtagagttcagtcaattgagattcccattgctgcccccccacccaccaaaccaccataataaaaatgagaatttaatattcacttagtgcttcacaatgtaatttcactccatgaaaatcttaggaattttttctttttttaaattgagacaaggtcttgctctgtcccccagactggagtgcagtggcacaatcatgattcactgcagcctctatttcctgggctcaagcagtcttcccgcctcagcctcctgagtagtgggtactgcaggaatatggcatgatgcctgctaactttttaattgtttgtagagacaggttctcgctatgttgcccgggctggtctcacactcctgagttcaagcaatcctcctacctcgccttttcaaagtgttggaattacaagcataagccagcacactggggccaggaaaggaaatctctgtgataagcaagtttcaggaaatctcttgtttgctcattatcaatacgtttcctgaaattggtgtcagataaattgtgaaccgttagaaatatcacccagttcttaggtctctcattccattggagttatagtttacacatctagtaaatccgggctgtttgaaatcaatttctgaaagatacaagagcaagaggtttgagaactctgttatcttcttgatcaagagatagtatgaaatacatacagtattgtcatttaataattgtaagtgataaatgttatgttgaaattacatctgaatagaattaataactaaataacatgactttaaaatgtgttgagcagaatccagatgggagaaacctgatgatttcattccacacactagtgatctgccttctagtaaggtcaatgaaaattcacttggcaccctagatgaatccaaatcatcagattcgcatagtgattctgatggggaacaggaagcagaagaaggaggggtctctacagagacagaaaagccaaaaataaagtttaaggtaggtttttaaattttactcttcacatcaaattttttttttttttttttttttttttttgagatggagtcttgttctgtccccaggctggagtacagtggcactgtcttggctcactgtaacctccaccttccgggttcaagcaattctcctgcctcagcctcccgagtagctgggactacaggtgtgtgccaccaaacccggctaattttttttattgttagtagagacagggttttaccatgttaataaccaggatggtcttgatctcctgacctcgtgatctacttgcctcggcgtcccaaagtgctgggattacaggcgtgcgtcaccacgcccagctgacatcaatttttgaaaagctctacagaccttaagtcttctgatagaacatagaaattaagacatattttggcaactggataaataaaaccgggaacactcaggagcccatgagtcaaagcagaggagacacattattagcattgagcaatggttgcgattgttggcctgagaaatgtaggaaaatcagagttcctaaatacctagttacacctaggatcttgtcattgcctgcagtttctctaccaacttcacaaatcttgatggaacttagagtaagggttatgtgcagtttacagaggagcagcagcaaagccttcgttgtaattgccatctcacaatgattatagccagccagatttaggtaatccagtatccaacttaggatagaaatgattaatttattttcgtcaaaatgaatgtgttccaacaacaacaacaaaaaaatacaggccaataaccctgctgaacatagatgcaaaaaccttcaacaaaatactggcaaactgaatccagcagtacatcagaaagattaatacaccatgataaagggatgctttattccagggatgaaaggatggttcaaagtatgcaaatcaataaatgtgattcaccacataaacaattaaaaacaaccatataatcagctcaatagataaaaagcatttgttaaaattcagcatcctttcatgataaaaaccttcagcaaactaggcacagaagaaacatacctcataataataaaataataaaagccatatatgaggccgagtgcggtgcctcatgcctgtaatctcagcactttgggaggctgaggcaggagaatcgattgaacctgggaggcagagtttgcagtgagctgagatagtgccactgcactccatgctggatgacagaccaagactctgtctcaaaaaaaaaagaagagccatgtatgagaaacacacagccaacgttatactgaatggggaagcactgaaagtattctccctaagaaagcaaggatgctcacttcaaccactccttttcaacataatattggaagtgctagcctgagcagtcaggcaagagaaagaagtaaaaggcatccaaattgaaaaagaggaagtcaaactatctctgtttgctgattaaatgatcttactacctagaaaaccctaaagacccctccaaaacacacgtggatttgataagtgacttcagtcatgtttcaggatacaaaatcactgtacaaaaatcagtagcatttctgtatacctatatctatataataatggtaaaaccgagaaccaaataaaaaactcaatcccatttgtggtaactacaaaaaaaaaatctcggaatacatttaaccaaggaagtgaaagatccctacaaaatgaactacaaaacactgattaaagaaatcatagatgatacacacaaatgaaaaaacatctcatgcttctggattggaagaatcaatatcactaaaatgacatactggccacaccaatctacagattcaacacaatccctatcaaattaccaacttcattttttacagaattagaaaagccaattctgaaatttatgtgaaaccaaaaaagagcctcaataaccatagcagtcctaagcaaaaagaacaaaggtggaggcatcccattacttggcctcagactatattccaaggctgtcataaccaaaacagcacagtactggcataaagataggcacatagattgatggaacagaatagagaacccagaaataaagccacatacctacaaccaactgatcttcaacaaaatcaacaaaaatatacactggggaagggataccccattcaataaatgatcctgggaaaactggctagctgtatgcagaagaatgaaactggacccctacctctaaccatgtacaaaagttaagatggattaaagacttaaatgtttaaagatctgaaactataaaaaccctagaaggaggccaggcatggtggctcacacctgtaatccctgcactttgggaggccgaggtgggcggatcacctgaggtcgagagttaaagaccagcctgaccaacatagagaaaccccatctctactaaaaatagaaaattagctgggtgtcctggcgcatgcctgtaatcccagctacttgggaggctgaggcaggagaatcgcttgaacctgggaggcggaggttgcagtgagctaagatcgtgccgttgcattccagcctgggcgacaagagtgaaactctgtctcaaaaaaagaaaaaggaaaagaaaaaaaaaatcctagaaggaaatctaggaaaaactcatctggtcattgacgtaagcaaagaatttacgacaaagtcttcaaaagtaaacacaaaaataaaaatagacaaatgggagggacttaattaaaaagcttatgcacagcaaaagaaacaattaacagggtaaataaacagcccacatattgggaaaaactgtttgcaaactatgcatccaacacaggactaatatccagaatccgcaagggactcaacaagaaaaaaacaactccattgaaaagggggaaaaggacatgaacaggcatttttcaaaagacacacaggtggccaaaacacatgaataatgctcaacatcactgatcgtcagagaaatgcaaatgaaaatcacaaggagataccatcttacaccagtcagaaggctgtaattaaaaagtcagaaaatggctggatgcagtggctcacacctgtaatcccaacactttgggaggctgaggctggcagatacttgaggtcaggagttcaagaccagcctaaccaacatggtgaaaccccatctctactaaaaatgcaaaagaaattagccgagcatggtggcgcatgcaggagaattgcttgaacctgggaggcagaggttgcagtaagccaagatcatgccactgccctccagcctgggtgacagagcaagactccgtctcaaaaaaaaaaaaaaaaaaaaatcagaaaacaacagatactggcaaggatgcagagaaagggaaacacttatacacttactgagaatgtatgttggtataacctttatagaaaacatttctcagagaactaaaagcagaactgttattcaatccagcagtcccacttctgagtatctacccaaaggaaaagaaatcattaaacagaaaagatacttgcactcatatatttgtagcagcattgttcacaatagcaaaaagtaaatcaacctaagtgtccgtcaacggaggattggataaaaaaaatgcggtatatatacacacgcacacacaccatggaatactactcagccataaaaaatgaaatgatagcttttgcagctatgtgaatggaactggaggccattaacctaagtgaaataactcaaagtcaaatactacatgttctcacttataagtgggagctaaacagtgggcacacatggacatacagaatggactaatagacagtggagaccataaaaggtgggagggtgggagggaggtgagttgaacatgtgtctattgggtttgttcactgttcaggttataggtacactaaaagcccgtacttcaccatgacataatatatacatgtaagaaatacgcatttgtgccccctaagttattttttaaaagataaattataggaaaaggaaaaaaattacaaaatacaggtaaacaaggacaaactccctataatcttgccgcctcccagaagaattcaacagagccacaattataaagggagtcactgttgggtatgcaagtaaagcaagaaagcagaagagagaagttaagagagccctgtttatatgtccttaattgtagaacttaagacattaaggtggtgatttagggagcctttgtcatggtatatcaacatttcagacatggaaaacctaatcaagcagtaaagttctatgtatatttattgtgttatgtgcagatttgagttagtgaattattgtttataaatctataacaatacctttaaaagccttaaattttatttttgtcttggtagttttgcttgaactgtattatttcttggcttttacatttcaggaaaaaaataaaaatagtgatggaggaagtgacccagaaacacagaaagaaaaaagtattcagaaacagaattcattaggttcaaatgaagaaaaatcgaaaactcttaagaaatcaaacccatatggagaatggcaagaaattaaacaagaggttgagtctcagtaagtacctggagctttaatcccactgttattacaagtgattttacatcccagtacttccctaaattgcagtaagtaatttcaaggatgctgtgcttattaaaagtatagcttgaggccagatgcacccctgtaatcccagcactttgggaggctgaggtgggcggatcacgaggtcaagagatgagaccatcctggccaacatggtgaaaccctgtctctactaaaaatacaaaaattagctgggtgtggtggcatgtagctgtgatcccagctactcaggaggtggaggcaggagaatcgcttgaacccaggaggtggaggttgcagtgagctgaaatcgcgccactggactccagcctagcagcagagcaagactccatctcgaaaaagaaaaagtatagcttggctgggtgaggtggctcacgcctgtaatcccagcacttcaggaggccaaggcaggcagatcaactgaggtcaggagttcgagaccagcctggccaacatggcaaaactttctctctaccaaaaaaaaaaaacttagcagggaatagtggcacacatcatgttcccagctacttgagaggctgaggtgggaggattacttgagcccaggaggttgagactgcagtgagccatgttcacaccacttcactccagcctgggcaacagagtaggaccttgtctccaaaaaaaaaaaaaaaaaaaaaatgtaaaaactaaatagataagcaaatattgcagcaactcaagtattactcagcaaagtacatttctataggattcagtgttgctatttagttttataacttaaaacagcctatgataactgatagcaaagaaggtccttgctggccaggcaggtgcagtggcccacgcctataagcccagtaccttgggaggctaaggcaggaggttcacttgagcccaggagttggaggctgctttgagctatgatggcaccacttcactccagcctgggagacagagcaagactctgtcctaaaaagaaaaaatccttggaatagattgccttctgcagagctccattctccaaataggatgatgtgtgtttttcaacaggttttacgctctcagctacttaaacataacgatctttctggtccattttccagagtctcatagatgggactgatgggtgtgatgtgactaatttactctttcacagaccagttgactatctagggagtacggtactgtgataggctctttttaatcaggtgctgatatcaggaccactcaactgattatttataattaatcatgtggatggttgaagggctagttcttagcaaaggagtgctaggcatacagctccattcagtcttctacaataggaaaatgagatctcgactcgctgcaacctctgcctcccaggctgaagtgatcctctcacctcagcctctcgagtagctgggactgtaggcacatgacaccatgcccagataatttttgtattttttgtagcaatggggttttgccatgttacccaggcgcatctcgaaactcctgagctcaagtgatcctcctgcctcggcctctcaaagtgctgggattacaagattgagccaccgcacccaacccccttatccctttacttgtactgcttatatataagcccaagcattttcttagataatgcatcctttgtgcaacaggaataaattaatacatagaacttctcccagcatttatccacctgaataagtgttcagtatcttaaataatattgtaaagtcagtattttaaagtagttcctactccaaaatgagcaacttctaatgtcattagaaagctgatcttggggcattggttatatgaaaacgtttgtcttaccctgtcaaatagagttttactttaactctatttccagtgaggaggtagatttggaacttccaagcactgaaaatgagtatgtatcaacttcagaagctgatggtggcggagaacccaaagtggtatttaaagaaaaaacagtcacttctcttggagttatggcagatggagtggccccagtcttcaaaaagagaagaactgaaaatggaaaatctagaaatttaaggcaacgaggtgatgatcaatagttgcaggagagctttttgtacatgcttttaggacagaatggagacttatacacccaaagtttatctgtgtttgtttgtaagtattatgatgctaaaaatttagatttattctaaatgtatttgatgtgaattaaaataaatattttttcatgtgaaatttattttggttcctaaaatggaagcctaccacattgcattgtaatacagtgtattatgttcagtgtctaaaaactgctaattaagtcataatttaagatgctatgtatctgttatttaaaacatggagaaacagggcctttattccattcatattcataagagcatatttatcctgcattgaaaatgcattacttttgcacattgatattaactgttgtccaacaaataagtatcggagtacgtgagaatattcccagcccagtgatgatttggttctgaggctgatgtgagaaagctgatgtaaaaaatgtatgcatattggcttaccttactcaatttaaagtcaaaagccaacagccaggagcagctcaggtacttcagatgtgcttaatatggagtgaaaactggaccagaggtggaaagatgtatttgccccagttcacttcaaagcagcaaacgttgtttaagcattttagtttgaaccaggcattgtgttaggaatccagggataaagatgaatgaaatgtatttctgttcttcaggagttcacattctagcatatgccttttttcccccagtcatgcactctttttagcagtcttatatgtactagaaaagattttttaaagtttatttaaagctgtgtagatgaaggcttgatctaaaatagtataaggtctccagcttcagtaaaagtttttagtgtttacttaaattagtaatttctcactttctgtctggttaaaatgtcttaaaaagtagaattttcttctttaatccgtttagtagttacctcccttttacttttcaaattcacaaaattacatttctcataaattgtatagtatttaacttataatagttaatatttgtctttttaagatgactgtacatgtaagaaaaaagcttattaaaaacttgatcaaagaataagttaaatattgttattctaattccagtcagaatcaccttagcattggtgagatagtatttggagatttgtctttgcattttttcagtctactttttgggtattttatgaatgtgaaagcctaaactttccccttcattaggaagagatacttaataattcttgatagcccattcatcatctaggtgagcagtgcattctggtgctttactcttctcaggtggaaaaaataatggactgtaaatgcagtggtcctatactttacccacatttagctcttaaaaaatacaaaattgaaggcatttttaagattagacctcatgtaaagtttctctttgatgatttttaaaacaatctcctttacttttgaaagtagtattctcaaaaactgaaagcaaggtaaatctccgtaaacagtatggttataaagattgctcagaaaagacttgataataacaaacaccaatattttagtaaatcaagtcatgaaaaatagtaatattccatctgctttggagggatagagaacataacagcttttaacttacttggatgttttcataagtgtttgatatcatttccactattacttttcgatcgatcgatagatagataatgaaagtaattttttaataaatataaaaatccaaataatagagaaataagtttttagaaaatctcagtaatctgtcatcccctctccatgaccactatggggttttccgtttttctcaacatgttaacactgggtatatatgggtaacccttatgacatctggacctatgaggtccactatctgaatgaaaccatattcaaagaaacatgatccaaacaaccaaaagtagtttttgtttttttaatgcagtttttaatacattccaagaactgtactaggggaatcaaccctaccagatatttatgaattaaaaatctataagatacagtaaaggacaggaatggtggctcgtgcctgtaatcccagaactttggaagaccaaggcaggcagattgcttgagtccaggagttcgagaccagcctgggcaatagggcaaaaccccatctctactacgaaaaatagaaaaagttagctggacatggtggcatgcgcctgtggtcccagctactcaggagactaagggagaatcacctggtcccaagaagtcaaggctacagtaagtcatgaacatgccactgcactccagcctgggcagcaagagggagactcttgtcttaaaaataaaatacttgccacatttatgtatattatatataaactagagtttgtttctggatttcttttattgtgccagtaccatactcatttaattactgtgtttttatagtctgttttaacttctggtacagcacatatccttatgttacttcatactttgaactactttttcaagatattcatagaaatatccactcattatatcaaataactttttgtcaagttgtcttccctactcccctcaaaagaactccttgtgattttgtgctacacttaattgagttgataataattgccatctttctgacattcattcttcttatctatcagcatgtgtgtcttttcatttagtcagttctttcatgtctttctgaagttatgtagttttctccatatgggccctgcacattacttgaaatgtaagctcccagggccaggcgcagtggctcacacctgtaatcccaacactttgggaggctgaggtggtggatcacgaggtcaggagttcgagaccagcctatccaatatggtgaaaccccatctctactaaaaatacaaaaattagccaggcatggtggtgcgtgcctgtagtcccagctactcaggaggctgaagcaggaaaatcacttgaacccaggaggcggaggttgcagtgagccgagatcatgccactgactgacctgggtgacagagccagactccatctcaaacaaacaaaaaagagctccctgagggcaagagttttgttttgttcacttaatttcct

SEQ ID NO: 15823 - DNA, 26852 bp, Human; identical to SEQ ID NO: 12736

SEQ ID NO: 15824 - DNA, 133613 bp, Human
taggtacctccaagaaagagagactttaagtgacctgtgtggttttaaaaattcatggtatttatttataaggatagcctaggtaaaatagtgaagaactttagcaactatccaaaaagaccaaaacatcaaaaaaaaaatccaaatcctaaacaccttgcaggtaacaggaaataaatgtctacagaagaaatccacagcattgttaaaatatgagactactattctttgtgcatccaactttgccaagtaaaaacggtatcaacataaaatatatttaacagataccctagtgtttatgtggtatgtacatagtattttgacatgcaagaggggagaaaaatcagcggtgtgctttttgctttacatcttcaaaactggatctcaactatgagacagactaacaacatacctaacagagttgttactttgtttcatgagaaaggaaataatggtgttctttcaaatttaagcatctaaagatacacagctctgcattaaatacacttgattatttctagaccacaaaatatacaagaaaaactaaacatgttgcttttattttttaagggctttccacaattctttgggtatgacagtattatgaacaccaccattataatataggtgcttcataacatgaatgatatgaccaactcattgcccatttcccaaaaggccacagagaaataatttaatatataatcaaagtcaggttgatgaaaaggaagaaggctcacagctttcataggggactgagaagacagaaatcttctgatgttttgaaaatgcaagagcaatgtacataaaagtgctttgtaaactgagtttacatcaaaaaggagcacttcattcaacacaattattattagaatctctaacagcggaattatcatacaggcctattgtctgctatccagcacttgcagtaatcacagaatttctttggctgtgacttccagtagtccgccctgaaaaagagagacaacaaggctaagctcatgtaaaacttaaaaaaggttaaattctgcatgctttacagtttttaaagtttgaaatatatgcccctgctactgaatcttgtcttgttatgtatagtcgttttattatttatctggttggagcacagtcaattgaaattctgttgccagcggagtagaaaaagtctgtatctgattcattacaaaactcccttcaataaaatggctttcaaaaattcctcacttgttatcgtcatcgttatgaaaaactaaggaacatcttagaagaacatttatcctttctggctttgggggaggttgctgtaatggaaacctgaagaaactcataaagtttgccttaaatcaagttattcccaccaagagaacaacgtacaagactactctggggaaaactgtagttcctcccagactctcagttaaaacaaactgttcttgagcctcaaggcaagagagaactggaaaagccatgggacttcgtagacggccgacaaaaaaaaaaaaaaaaaaaaaaaaaaaaccattacgctatccagggctggccgcttccagtgggcgggggaggccgcagcccagccctagtttcacaataccctagggttcaggggcttcggaaacccaaggggtgcatgcgacccccgacagcgtcgtagagagagcactgcgtcgcttcacccgcggccgtccaaccagccccctgaaccggccgccggcctccccctagagcccgtgccccataccccagggcgttcagcggggtaacatttctaccccgccctgagaaccggccctgcaggtctggggccggtcccgagcgagttaagaacgcgtctgtcacgcccccggccgaagggcgggaggagaggaggggaagacccgggcgagaaagggcggcccagagaaacaacacctcgttgttcagggcctgagacccaactcacatgactgcgccagccgctctgcaagtcgtccagggttccactcagactcgcgctttcccagcgggacgagtcgagctcttccagccgcccgatgcccacccgaacctccctccgatccagacaccttactcagtccccgggaccagcgttccgctgttcccaactacgggtgcccagacgatccaatccgcgttcgaaatcgcctcctctcccctccccctacaggggcggtactcccggctccaaagaggtggggtcggtataaaggggttgaggtcaccgggaaggggtaaaagcgcgacgggacctgagctgaaggacgggatctcaagcctcaagtccctgcgccatcccgccgtctctgtgtcctcccctggggcccaaaacctccatcctccttctaggctcgctggctcaaggccaaggagctcagcgcgccgcctccgcccggaacgcaaacagctgttcccagagacgtctccgctctcaactttgccaactactccgcacgcactttgaccagcggagcaaccgggacctgtgggtcggggtcctctggcggagttaaaaaaaaaagaggtgaaactgcgggaccggcgctgcgagtcgctaggcttcgcctcaaactttgctgttgcagcggagcggccccgcccctcctctcccctacgacgcccacgcgctcggatggggcttgttccctagctcgggagcgtgtgggcagcagcagcggcggcggcggcggcggcggcggcagcagcagcttcagtagcgcagaggcggcggtggcgagaggtgcggcgaaggaggcagaggcacttatgcttgtcaggtgggtcacggcagtttctcatagcacttcccatatggtctagcggttaggattcctggttttcacccaggtggcccgggttcgactcccggtatgggaacgcttccttatttttctttttttttgcaactatcggtttggagggctgactttttaaatcttgtgttctggctcctttcttgtccccgtctgggtgagtttgtagaaaataagcattactgtagttagtggcgccaggagctgggctgcggcttttggagcctcgagtgccacgccgtgcctgctggagaagcgaatgcgcttccgatccttctccctcccgcctccggctcacggggctggtgggccctgagggagtttcactttcccctgggctgctcccccgcccctccggcccgtagttttccagacgcccgggaggtgatgattaactccggccttgcgttatctcctcccagcgcccccgtccggcccacaccctcttcagccgctcttgcgactcttcctatgcaggacgggctgacccccctgccctgggcgccccagagcccgcgcccggaccagtagctctagtggttctctggccgcagggtatttacgaggccccacggaacacagtgtgccttccgcgccctcccggggggacgcgctttcccggccgcgcagccgcccggcgcccctttccgccgcgtgtgcgctcgcgtctccacccgcggcgcctgagcaagcgcgaggccggcctgcgaggtcttcccaacttgacttaaggggcgctggtcgcagtcacggaaagtaccctcgaaaaaaggcctttgggaacgagaatcttttttctttccctttaaaaatacacaccacgagctatggaggagaaaaataccactctgatgagatggctttaaataagtatatcgactttccaaagggtctaacattttgagcgcggttgatttaaagaaaaaaattgattaaaacaacggcaaaacatcctggggtggaggtggggcttgggaaagagaaaattggctggagactggggaggggacgttaaaacaaagtttcactgtatttttaaatatagaagccctgtgtttattacaaagaagggacagctgtgtcagcagcatgtgagctgtaaatgaaacaaaagcgttatcttaaatgcaagctgaaattagaaaatagggtcggctataatgtttattgggcctctgggaacaaacgaagaaggaaaaagtgactcttgtagatgggtttctggtcagtgccattactgaaagcagatgttttggttgttagtatgtgtgttcccagactattttgtagctttaactgcacagtaaatttgttaatgtgatctgcgtgattaaggattaattaggcttaccttgttaaaaagaaagaaaaagcctaagtattttaaatcgtcttcattaattcaaatatttgtgtgtttgctacacaccaagcaccaccacatgcttttgaagttactgatgtttgtattctttatgttagctagtggatagaatactgaatggaataatattttggtctttgtgattagctgtgtgatgagacttttcaccttctctgttctctggctttagagccatacatttttgataacacgtatcactcacaaattttaaatagagttacaagaattgttgagcgattcctgaatagataatgaaagtggaattttcatttaaataagtaatagtgtgtcattattaagaagcagttactaaagaattacagtagttgaaaatttggaaagaaggaaagataactcggataactctgccttaattgtccccagagagggcttaacttttgactttttcttcttttttttgttgagacggagtctcgctctgttaacccaggctggagggcattggcgcgatctcagctcactgcaacctccgcctcccggattcaagctattctcgtgcctcagcctcccaagtagctgggactacagacacccgccaccacgcgtggccaatttttgtattttgagtaaagacaatgtttcaccatgttggccaggctggtctcgaacccctgacctcaggtgatccacccacctcggcctcccaaagtgctaggattacaggcatgagccaccacgccaggccttgaccttgtattttgtaatgagtttacaacattgtaccaaatggtgctaaaatggatgttattttcaactgtgcactcagtaattgcaaatagttgtactatatacctgggggtgaacacaaaggaagtagttgcatcatctctgtataaaacacagatttatctttcgtgtagttgtgcattacgtagaatatggtaaggcaacatctgagttgtagaagtgctactggagtaacagaggtgaggaatcggttctgctcaagggagaggactggagaagagacctagaggggagagtggaccttgaagaactgattggatttctcctgttggggaatgtgaatcataaagctgaggtagggggaacaagtatgaggctggcaagtagtcggtttggcaggagcacagagtgcctgcagggagggccatgggagatcaagctgggaatgtagaaaggaattttaacttgataaattttgactaggtaacaggttcttttatcaaggagtgacattttatgtcacaaaaatttttaaaccatttctgtctcttggaaaacccaaaggtagcagtggcatgtgaaaaattcttgttttaaaagattcaaacaataaagaaacatgtagaatattttgtgtccgtacattttatgtttaggagttgaatattaatttgtaattaatagaatggagaaaagcaatcagttaattagaattcactttataggaatgaaatctaggcttaaagtgtgagaataatctgtcttgctttgttgaaagtgaccttggtattcgaagacagagctgctcactactgtcagtaagacgtatatcttaaattgattaaggctaggtaatcagtttgtgaggattcattcttaacgcttgtgccattggcaggcatattttaggtgctgtctcttgggccataaattagtgacactgagtgctgtggatttacccaaataacctctttaatatttgctactgttaggtgtaattagaagatacatgaaagaggcagggtgtggtggcttatgcttgtaatcctagcactttgggaggctgaggcaggtggatcaacatggcgaaatcccatctctaccaaaaatacaaaaaattagccaggcgtggtggcacccgctgcacctgtatcagctattcaggaggccaaggtgggaggatcacttgagccctggaggcagagattgcagtaagccaggatctcaggatcgtgccactgcactccagccttggagacagagagagactccatctcggggtggggggaaaaaaaagagaaaaagtgagagagcctggacaacataacaagagcctgtctctacaaaaataaaattaaaaaaaaattagccaggtgtgatgccacatgcctgtagtcctagctacttgcaagcctaaggtgggaggatccattgagcccaggagttcaaggctgcagtgagctgtgatgttgccgctacactccaggtgacagagcaagaccctaagaccttatctcttaaaaaaaaaaaaaaaaagacgtgaaagttcagtaaatgtttgcagagatgaacgctggtatttaaagaagtagaagggattttaaagcaattactgcatttcagctaaaatccgaagaccttatcatggtctcataggtccaacattatctggactttacccatctaacctcaggtcctaccttatctaccacttcactgtatcttggctacgtaggcttcctttttgccatgccaaacttatccttgtctcggagttttgtttcttgcctttttcctttgcctggaatattccccctgtagctctgcacatctcaggtcaacattaccttctcagatcttttctgaccactttagcttgagacttcctcttccttggttactttctggttactttatgacatttttttcattttcttagtatctgaaattaacctgtttatttgtttctgtttatttcttgtcttagtctgtcaatataagttccctgaaggcaaggatatcatatgagatcgttcttgttctgtatgtagtaaagattcaaacaatagtaaagaagttggaacccttatacagtgctgctggaaatgtataatggtgcagttgctttggaaaacagtttggcagttcctcaaaatgttaaacagttaccatatgatccagtatttccactcctaggtgtgtacccagtagaaatgaaaacatgcccacaccaaaccttgtatacaaatgtttatagcagcattattcataagcaaaaagtagaaacaacctgaatgtccctcaactgatgagtgaataggtaaaatgtagtgtatccacacagtggaatatttgggaataaaaagggatgaggtactcaatcacaagaacattacactaaggagtcaggcatgaaagaccacatttttattccatttatatgaaatatccaaaataggcaaatctatagagaaagagggaaaattagtggttgccttggattagaggggatagggaggtttggggtgaggtgactgccaatgtggatagtaaatttagggtgattgaaagtcctgaaatagattacagtgatagttctataactctataaatgcactaaataatgttgaagtgtacactttaaatagataaacttcatgatatgtaagttttatctcgactaaactcttaaaagggattgaagcaataaaaagcatatagaatattttctctcttgattttacatttatcatttggatattacctgttttaaaataatagcagcctgggcaacatggtgaaacttcatctctaccaaagaaaaaaaaaaacaaaaattagctggtgtggtggtgcgttcctgtagtcccagctcctcaggaggctgaggtggtaggattgcttgaacctggggggttgaggctgcagtgagctatgatcgcaccactgaactccagcctgggcaacagggtgagaccctctctctagaaaataaaaattaaaataataatggaataatttaatggggaaacttcagctcctagttagttccacaaatgtggtaagtgcttattaaataactgatggaggaggttaggtaagtatacagataattatgatacaatacatagtttgataaatgctcagaggggactaagccaggggtcataagtgtttgatagtgttcaaaatccatatctgagtttgtgtgaggggaatgaggaaaggcctcctgtaggaggcagcattcgagataagctttgaaggctggttaggcttttgctggtagagacagggatggggacaaggcattgagaggaagcaagcaggagcagaggcatgtcaacagttactagcacattttaatggagctgagggtgcaggtaggataggaatgggaaataaggctgcgaaaatagattagggtctgtagtggacaatgtgtttttactatcctcctgatgcctagtgtgcctccaatggctcatacttaggaagaacgatacctcttacctgcagagagctggaagtgtctggggacatatcctcctcccgctcacagaccactgtcaggagtgtaactttggagcaggggctttgacttgtttccctctgtatcatcagacttgaagcagggcttggcacctggtaaacattcagaaaacatttgaatgaatgaatgaaaatcaagaagtggcaagcaaggtctatttaaagcaaagcaaagtttattttacgaagccccttgacaaggagattttggaagcctcttggatttggagctaaggagtttagttaggaaaagagatttctggtaatacgaggaatgttttaatgaaatgaatttggtagtaacgtgcaggttgaactggtggatggaaggattatgtctgtgctccccatctccactgtccctttcctgttcccactccattaggccttgacaaaggtcaaggacttcccgcagtccaataataatctcctaacatctctccttgcttctactctctccctaaatagggtggtggcagcagaatagaaaggatcagatacaacagataacactgaaggaaaaaatctacgacttcagaaagtaaatatttctaaaagaaatagagaagttatgaagcacagattttattgcagcggactggcagtttttactcttagggttggccagctagtaaatttattgcatacctgcgtgtgtctgtggctttcgaactctgaaattgtgcattgactccatgaacaagttaatactgtgagactgccaccctgtggacaaaatatcaggactaaaaccatcaagaattaaagtttcattcatttgcgatttactgttttagaactggctttggttcttccacgttggtgcatgcagtgatgctcattaaatagaaagcttgaaattaattttttctctgaattttttctgaggcttttaaataaagggaatctaaaatggaaccagtagttttaaaaagctgcaatgattcaagagtggtttttagatggtacttctttgctctagaaatttcatatggaagggttggttttttaaaatattgtggcatgtaggcctgttgtgaaatggtcatttatcccttttgttgtactgatttttttcatcccattttataagacatatggtattatccttgagagttatattttttgagaaatatatcaaacatccccccacacccttttttggctaagtgaaagtggccttcttgcctcgtttttttgtggatttggttgtagttgttaaaagttctctacgttttggatggattgccttaattgtatttatacaaatgagtttggtttatattacgctacttatttagaaggacactctgctcacaaattatactagtttggtagtttcataaactagcttgaatcaaaataaaatggtgattgtgaaatacttatttgctcactgcaactcaggaaatgtttcagttttggactcacgaccaaataaaactttcctaagagatgagctgtttacagccaataatgttataaatatcttacacacttgaattcccagaggtgtcagaaggggtggggtagccatttagggcttgaaatttgtgtcaccagtaaagcagaagtgggttgaagcagccatctgaggtcagcaattgtgccttatttaagaaggtgatatccacactgaggagaatggatgaatcattgattgacccccttgccactgatacttcaccatagagacctggtactttaccataaggaccttacgttttggtaatgtactaatggtcaaatataatgttaatgatcttaattttttttttttttgagacggagtctcagtctgtcacccaggctggagtgcagtagcatgatctcggctcactacaagctctgcctcccgggttcaagcaattctcatgcctcagcctcatgagtagctgggattccaggcgtgcaccaccatacccggctaatttttgtatttttagtagagatggaatttcactgtattggccaggctggtctggaactcttgacctcaagtgatcctcctgcctcagcctcccaaagtgctgagattacaggcgtgagccacagtgcctggtgattttaattatttaaatatttctctgagtcagttctgaaaaatgtagtgtgacaaacgcaataaactttaagtgttcggttttatttaactttttcaaagtaaatatatggagttgtgggtaacttttcaaaattattttttgctaacacatatgtctcacattctacaaacagtgctgtgtaattgtaagtgaagtagactatgatgaaagtgcacgtttatgtaggtttacaaggtaaattgccatataatgtagatcatttagattaggttagtattatttagatacagtttaagaaaagtagcttactttcttaaatttatttttaagtatttactcatttatttatttattgagacagggagtctctctgtctcccaggctggagtgctgtgtcatgatcatggctcactgcaacctctaaatgctgggttcaggtgatcttcccgccttggctttctaaagtgctgggattacaggcgtgagcgactgtgcctggccaaggaaggtaactttcaaaatacttggtgatctatttactcttcacctaggtattgaatgaagagtcaataaacttaaagatatatttgttttctagtcttctttaatggttttgctatgatatcctttttaaaattgtaaatgacaatgaacttacataaatttttagtttaacatttcaccagcacttaagagactttatcacacaatatctttctacatttttatgctataatggttactatttcaggattaatggaagtgttcactcctgagttcatttcacaaatttaaatactaaaacattttgttctttgaaaagtaattctggccaggcgcagtgtctcacgcctataatcccagcacttggggaggctgaggtgggcagatcacttgaggtcaggagttcaagaccagcctggccaatgtgatgaaacctcgtctctactaaaaatacaaaaattagctgggcatggtggtgcacacctgtaatctcagctacttgaagggtgtgtcaggagaatcacttgaacctgggaagtggaggttgcagtgagtcgatatcatgccattgcactctagcctgggcgacagactgagtgagactctgtctcaaaaaaaaaaaaaaaaaaaagagaaaaagaaagaaagaaaagtgattctaatatagacgacttgaactttgaaaaagcaataactattctataaattttgtgtgtatgcaaactttaaaacatcttttatttttgaatgcacactaatcactattgaatacacacctttgacttaaaacatttttgtgctttattttaaatttgtgggaaggtgcctagcctagtgactttttgatccagagagtcattctagattgtcgtaaatctttatttgcagtttaatcttattacttaaagttttttgaatttagagtccagagaccaagatacatttctgatttagaatgtgttgatatattgctctatatgaaacttttttatccgttttcaggtgtgtgtgtgtgtgtttttcattttcagttttaatcaaacatttaattcaacttttcaaggttgtaatgggattcattttacctcagctgttcaaacgtctgtgtttatcatcgataccctctaatgccaaggtgcacagagctgaaatagaaaggaagggtacagccacaggcaaagagaatgggataaggtgtcccagcgcatgaattgggggcagtagtgaaggaggagtatcctgaagggaggcaaaacataagcttaaggaatttggagctccaagcaggcaggtggcatcagagaatttcagatatgagtgggaatgcctttcatttgtttttttttccctttgtttttatgccatttcacatgaactacaatattactgtcccttaaagtgctacttttaaaaacttttttcttttgcattgccattaccttctagaaggttgtttgtttatgaaacatatttttagatggctttttgccacaaatgtgtgggaaatgaaggcacataaagtttatatgaaagcagtcacaacctgatactcattaggatgggtcctattaaaacaaaacaaagcagaatataacaggtattggcaaggatgtgaagaaactgaaactcttgtacaagaattcctgtgttggtggggatgtaaaatgttctggccacaatggaaaacaggatggcactttctaaaaaatctgaaagaggccgggtgtggtggctcatgcctgtagtcccagcactttgggaggcttaggcaagtggatcacgaggtaaggagttcgagaccagcctggcaaatatggtgaaatcctgtctctactaaaaatacaaaaattagctgggcgtggtggcaggtgcctgtagtcccagctacttgggaggctgaagcagaagaatcccttgaacctgggaggttgcagcgatccgagattgtgccactgcactccagactgggcgacagagcgagactccatctcaaaaaaaattttttttgaaagagaattatcataatccagcaattctgcttcttgatatatactcaaaataattgaaagcaaggtctcagagatatttgtatgttcttagcagcgttacaataataaatatttattatgttaccaaaaggtggaagcaacccaaagatcagtcagtggatgaatggttaaagtgtggtgtgtacatacagtgaaatgtgattcagccttaaaaaggaaggaaattctgacaacatgctacataaccttgaggacattatgctaagtgaaataagccagtcacaaagaagatatactgcatgattcaccttatatgaggtacctagaatagtctcatagagacttaagtagaatggtggttgccaggaactgggggtaagggagaaaggggggttattgcttaatggatatagagtttcagctttgaaagatgaaaagagttttgttgcaccacaatgtgaatgtactaaagactattgaactgtatacttaaaaaggattaagataatacgttttgttctactttaccccaattaaataattttaaaaagcaaatttcagtttgtatgtggatactctatgcacattatttatgaatgtaaacagcatctgtaatgatgcagtttcttatttcaccaatatgtgagtgttagatgctgggataaaacaatgataaaagctgacaagatcctcatgaagcttgcagtttagtgggagagacggacatggattgaacaagtaaaaagtgtgcttaagtgtacacgcatggcagggagacccctaacatagtgtagggaagggctggattgagaaggcttccctaaggacatgacgtttctgtagagatccaaaggatgactaagccttatgtaagagaaagggagaaaagggaagagagagtagattgagggagtagcattttgcaaatggtctgcaaggaggaaagagtgtattttgggaaatgaaaggcctggtgggctgtcatgtagaaagtgagatgcaatgggagatgaggctgcaaggtatcaaatcatataagacattctaggccatgttagatattttgaattttatcttcagcagagtgggcagatattgatgggttttaaatgagggattatggaggtggaatggcataggagcaagaaaaatgatgtacttttttgtacacttggtctttaactgtaaactacctgtttagtatggtgcttgaatgttggaggggattgtatattggccaccattgtgagctgttcatatggtaaagtgtacttaaagggtgaacttaagagaattgtcaagggtaattgaggataagtgattttcaccttgatactgtgatttggtagtttgaagccctagaaattgatacttgacttgggagagtctggagtaagaagaagactttgagcttttaggacctctagtggtaagtggtgaggaggtggggcagagaaaactgagaaagagtagtccagaattggggcaaaatcaggagagtgttatcaaagaagccaaagaagtgtttaaagtgataggtctaacacaacaagttctgaaagtgttcattggatttagccctgggaggtcattaactttagttagatttagtggcataataggggcagaattaagttagattaggctggttgaagaatgagcgggagatgaagaaatgagtaggtgaggacagtatatacacatcttttgaggaagtttggctgtgaaaagcagggagtgagaatgaatagtagttgtagttggggttgcggtgtgtgacagggtgccaattcaggttctttttttttttttaaaggaaaaacttgaattaaaaaaataccttcggctaggcgtagtagctcacaactgtaatcccagcactttagcaggctgaggtgggcggattgcttgagcctagaattttagactagctggggtaacatactggtatcctgtcactataaaatattaaaaaattagctgggcttggtggtgtgcccataatcccagctactcgggaggctgaggtgagatcactcgagccctggaggtcaaggctgcagtaagctgtgtttgtaccactgcactccagcctgagtgacagatggagaccttgtctcaaagaaaagactgtaggcagttccaagatggccaaataagaacagctccagtctacagctctcagcgtgagtgacgcagaagacgggtgatttctgcatttccaactgaggtaccgggttcatctcactggggcttgtcggacagtgtgtgcaagacagtgggtgcaggccaccgagcgtgagccgaagcagggcgaggcatcgcctcacctggaagcgcaaggggtcagggaattccctttcctagccaagagaagctgtgacagaaggcacctagaaaatcgggtcactcccaccctaatactgtgcttttccaacggtcttagcaaatggcacaccaggagattatatcctgtacctggcttggagggcctcatgcccacagaccctcgctcattgctaacacagcagtctgagatcgaactgcaaggtggcagtgaggctggggaaggggcacccgccattgctgaggcttgagtaggtaaacaaagtggcctgaagctcgaactgggtggagcccattgcagctcaaggaggcctgcctgcctctgtagactccacctctgggggcagggcatagccaaacaaaaggcagcagaaacctctgcagacttaaatgtccctgtctgacagctttgaagagagtagtggttttcccagcacagagtttgagatctgagaacagtcagactgcctcctcaagtgggtccctgacccccaagtagcctaactgggaggcacccctagtaggggcagactgacacctcacacggccaggtacccctctgagatgaagcttccagaggaatgatcaggcagcaacatttgctgttcagcaatattctctgttctgcagcctctgctgctgatacccgggcacacagggtctggaatggacctccagcaaactccaacagacctgcagcctgagggtcctgacccttagaaggaaaactaacaaacagaaaggacatccacaccaaaagcccatctgtacgtcaccatcatcaaagaccaaaggtagataaaaccacaaagatggggaaaaaacagagcagaaaaaccaagaattctaaaaatcagagcacttctccccctccaaaggaatgcagctcctcgccagcaacggaacaaagctggacggagaatgactttgacgagttgagagaagaaggcttcagacgatcaaacttctctgagctaaagcaggaagtttgaacccatggcaaagaagctaaaaaccttgaaaaaagattagacaaatggctacctagaataaccagtgtagagaagtccttaaacgacctgatggagctgaaaaccatggcaggagaactacgtgacgaatgcacaagcttcagtagccgatttgatcaactggaagaaagggtatcagtgattgaagatcaaataaatgaagcgagaagagaagtttagagaaaaaagtaaaaagaaacgaacaaagcctccaagaaatgtgggactatgtgaaaagaccaaatctgcgtctcattggtgtacctgaaagtgacggggagaatggaaccaagttggaaaacactcttcaggatataatccaggagaactcccccaatctggcaaggcaggccaacattcaaatttgggaaatacagagaacaccacaaagatactccttgagaagagcaactctaagacacataatcgtcagattcaccaaagttgaaatgaaggaaaaactgttaagggcagccagagaaaaaggtcgggttacccacagagggaagcccatcagactaacagcagatctctcagcagaaactctacaagccagaagagagtgggggccgatattcaacattattaaagaaaagagttttcaacccagaatttcatatccagccaaactaagcttcataagtgaaggagaaataaaatcctttacagacaagcaaatgctgagagattttgtcaccaccaggcctgcgctgcaagagctcctgaaggaagcactaaacatggaaaggaacaactggtaccagccactgcaaaaacatgccaaattgtagagaccattgatgctaggaagaaactgcatcaactaacaagcaaaataaccaactaacatagtaatgacaggatcaaattcacacataacaatattaaccttaaatgtaaatgggctaaatgctccaattaaaagacacagattggcaaattgggtaaagagtcaagacccatcagtgtgctgtattcaggagacccatctcatgtgcagagacacacataggctcaaaataaagggatggaggaagatctactaagcaaatggaaaacaaaaaaaggtaggggttgtaatcctagtctctgatagaacagactttaaaccagcaaagatcaaaagagacaaagaaggccattacataatggtaaagggatcaattcaacaagaagagctaactatcctaaatatatatgcacccaatacaggagcccccagattcatgaagcaagtccttagagacctatagagagacttagactcccacacaataataatgggagactttagcaccccactgtcaacattagacagatcaatgagtcagaaagttaataaggaaggatatccaggaattgaactcagctctgcaccaagtggacctaatagacatctacagaactctccaccccaaatcaacagaatatacattcttctcagcaccatatcgcacttattccaaaattgaccacatagttggaagtaaagctctcctcagcaaatgtaaaagaacagaaattataacaaactgtctctcagaccacagtgcaatcaatagaactcaggattaagaaactcactcaaaactacatggaaactgaacaacctgctcctgaatgactgctgggtacataacgaaatgaaggcagaaataaacatgttctttgaaaccaatgagaacaaagacacaacataccagaatctctgggacacatttaaagcagcgtgtagagggaaatttgtggtactaaatgcccacaagagaaagcgggaaagatctaaaattgacaccctaacatcacaattaaaagaactagagaagcaagagcaaacaaattcaaaagctagcagaaggcaagaaataagtaagagcagaactgaaggagatggagacataaaaaacccttcaaaaaatcagtgaatccatgagctgttttttttttttaaagatcaacaaaattgatagaccactagcaagactaatgaagaaaagagagaagaatcaaatagatgcaataaaaaatgataaaggggatatcacaactgataccacagaaatgaaaactaccatcagagaatactataaatacctctatgcaaataaactagaaaatctagaagaaatggataaattccttgacacataccccctcccaagactaaaccaggaagaagttgaatccctgaatagaccaataacaggctctgaaattgaggaaataattaatagcctaccaaccaaaaaaagtccaggaccagatggagtcacagccgaattctaccagaggtacaaggaggagctggtaccattccttctgaaactattccagtcaataggaaaagagggaatcttccctaactcattttatgaggccagcatcatcctgataccaaagccgggcagagacacaacaaaaaaagagaattttagatcaatatccctgatgaacatcgatgcaaaaatcctcagtaaaatactggcaaactgaatccagcagcacatcaaaaagcttatccaccatgatcaagtgggcttcatccgggggaatgcaaggctggttcaacataagcaaatcaataaacgtaatccatcatataaacagagccaaagacaaaaaccacatgattatctcaatagatgcagagaaggcctttgacaaaattcaacagcgcttcatgctaaaaactcttaataaattctgtattgatgggacgtatctcaaaatagtaagagctatttatgacaaacccacagccaatatcataatgggcaaaaactggaagcattccctttgaaaactggcacaagacagggatgccctctctcaccactcctattccacatagtgttggaagttctggccagggcaattaggcaggagaaagaaataaagggtattcaattaggaaaagaggaaatcaaattggccctctttgcagatgacatgattgtatgtctagaaaaccccattgtctcagcccaaaatctccttaagctgataagcaactttagcaaagtctcaggatacaaaatcaatgtgcaaaaatcacaagcattcttatacaccaataacagacaaacagagaaccaaataatgagtgaactcccattcacaattgcttcaaagagaataaaatacctaggaatccaacttaagggatgtgaaggacctcttcaaggagaactacaaaccactgctcaatgaaataaaagaggacacaaacaaatggaagaacattccatgctcatggataggcagaatcaatattgcaaaaatggccatactgcccaagataatttatagattcagtgccatcaccatcaagctaccaatgacttcacagaattggaaaaaactactttaaagttcatatggtaccaaaaaagagcccacattgccaagtcaatcctaagccaaaagaacaaagctggaggcatcacgctacctgacttcaaactatactacaaggctacagtaagcaaaacagcatggtattgctaccaaaacagatatagaccaatggaacagaacagagccctcagaaataacaccacacatctacaaccatctgatctttgaaaaacctgacaaaaacaagcaatggggaaaggattccctatttaataaatggtgctgggaaaactggctagacatatgtagaaagctgaaactggatcccttccttataccttacaaaaaattaattaaagatggattaaagacttaaatgttagacctaaaaccataaaaaccctagaagaaaacctaggctttaccattcaggacataggcatgggcaaggacttcatgtctaaaacaccaaaagcaatggcaacaaaagccaaaattgacaaatgggatctaattaaactaaagagcttcttcacagcaaaagaaactaccatcagagtgaacaggcaacctatagaatgggagaatatttttgcaatctactcatctgacaaagggctaatatccagaatctacaaagaactcaaacaaatttacaagaaaaaaacaaacaaccccatcaaaaagtgggcgaaggatatgagcagacacttctcaaaagaagacatttttgcagccaacagatacatgaaaaaatgctcatcatcactggccatcagagaaatgcaaatcaaaaccacaatgagataccatcttacaccagttagaatggcaatcattaaaaagtcaggaaagaacaggctggagaggatgtggagaaataggaacacttttacactgttggtggtactgtaaactagttcaaccattgtggaagatgtggcgatccctcaatgatctagaactagaaatgccatttgacccagccatcccattacagggtatattttcaaaggattataaatcatgctgctctaaagacacatgcacatgtatgtttattgtggcattattcacaatagcaaagacttggaaccaagccaaatgtccatcaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccgcatgttctcactcataggtaggaattgaacaatgagaacactcggacacaggaagggaaacatcacacactggggcctattgtggggtcgggggagtggggagggatagcattaggacatatgccaaatataaatgacgagttaatggatgcagcataccaacatggcacatgtatacatatgtgacaaacctgcacgttgtgcacatgtatgcttgaacttaaagtataataataataaaaaaaaaaagaaaaagaaaaagctgtaaccccagcactttgggaggcccaggcaggcgaattacttgaggtcaggagttaaaactgtgcaaagtgaaactttgcctttactaaaaatacaaaaattagccgggtgtggtggcatgcagctgtaatcctaggtactcaggaggctcaggtaggaggatcccttgaacctgggaggcagaggttgcagtgagcttagatcgtgccactgcactccagcctgtgtgacagaacaagactgtctgaaaaaatataaatacataagtaaataaataatatctcctatagagtttaggaaatatttgaaaaatatacactttgcttaaacaggatctactgaatacaaatatgaccttcccactgacttagtctaaatatggtattccgggattgtgtacacacaggtattgagatgtgaaggtctgtatgttactatactaacttctgatcatctggaaagtaaaaaatagagaatcttgagtccacctaagacttacagttgaatctttaggtgtaggactcaggagtgtgtgcatctttagatgattctggtgcatctgatctatggactggctttttgaagtcttctggatgccctttttttttccccctggaaaaagggtctcactctgttgctcaggctggagtgcagtggcgcaataatggctcactgcaccctctgcctccttagctcaagtgatcctttcttcttaacctctgaagtaggtgggactacaggtgcgcgtcaccacacccggctaatctttctgtgttgtttgtagagacaaggtttctccatgttgcccaggctggtctcctcagctccagtgattttcctgcctcagcctcccaaagtgctggggttacagtcatgaaccactgcacctggctctggatgatttttaatagttctgtcttgaggattaaatgagatgtgtatgtcaaggacttagcaaagaaagactttgaaaatgtcgtctgcttatacagttcggatggtgtaataggtttttttttttttttttttgatgaaaccagcttgatcctttttttcttactgtaaaagtgcttcatgctctgtataggttcttctctagctgctttttgtacttcttccctctcctctctgcattctagccatgatgcttcctcctaccccactgcctttgtttgtgcctataattttctctcctgatggtatgcttcctcagcctctttacatgactggctgcttaacattcaggtttcatatccacggtcaccttttcagaaaggccatccccaatcactctatctaaaataggttttcctggtcattctttgtcacttgttgatttccttcaaatggggacagggaccatgtttgaattgtttaccttagtctgcggaacagtgcttggctcatagtaactacttaaataccgagtaacaaatatgagtcatagaaatcttactagccagagtaagtactgttaactctttgtgcagggatccccagccccctcaggcctgcagacttgtacccatccgtggcctgttaggaaccaggcggcacagcaagagatgagcagcagatgagcgagcattactgtctgagctccacctcctgtcagatcagcagcagcattagattctcataggaatatgaaccgtattgtgaactgtacatgtgagggatctaggttgcctgcttcctaagagaatctaatgcctgatgatctgaggaggaacagtttcatcccaaaaccatcctccccaacccctgccccccatccgtgaaaaaattgtcttccacaaaactgtccctggtaccgaaatggttgggcactgctgttttagttgaccatcattgcatatactgaaatgtagatcatgcatatataagtattatgtgatcacatactgttttgtaacttttatatttcacttaaatatgtcctggagatttttccatacctgtaccattttatttagacaatagcagtatggtacattccatataatgggatatagtttctgtgacgtttcccgatttacataatagtttgtttctagtttcttactactttgaacaatatcgtgctgaatatatatctacatctttgcacgtgtatttattttgttagaataaatcccaaggactgaaactgctagataaaaagatagaggcattaaagtcttttggttgtgaagttgccttctggaatgatactctttggactctcataaataaaatatgaaaacatttttttccatgtaccctctctaatcatttgaatctttgctaatttaatttagtaggtgaaaaatggcattgtttttctgctctgaggttatgagaatgaacatcttttcctgtatgactacatttcttttgtgaagtgcctattcatgccttatgcctgtttttctattagggtatttgtttcaattaacaatagctttttccctccatattttattatgaaagttttaaaacacacagcaaagttgaaattttataatgagtactcatacacccactacctaagtttttattaaattgcagatattagtacattttcacttaaatattttagcatgcatgtcattgagcagtgtttcagtattttagtttttttcttttgagataaaaaactgtcttagaactaaatacatatatctctttaccttaaacactttattttaacttaaaacctagaattggatgttaattgatcaatcttttgatgaagggtccaagaccattttctttgagagtgagcccactgtcacagttctgtattgtatcgtcttaactgcacatccacaatatattgcctaagatttctagttttcgttttttaagtgaagcaagagatttattttggaaagcatttgctgagttttgacaaatgtatttgcttgtgtaagctaaacttaagaataggtttttttttttttttttttttaaaaaaaggactttttgtcatatttttccctagtttgttcctagccttagctttggttatggtaattttaaaaattatttatttacttacttatttattttttaagatggggtattgccgtgttacccaggctggtctcaatctcttgggctcaagcgatccacctacctcggccttccaaagtgctgggattacagatgtgagccactgtacctggcctaggttatagtgcatttacatttttatgtactaaaatgtcatccttttcctttacttttttttcctgcccttttgtcatacatagaaagtcttttttttttttttttttttgacaaagtctctgtcacccagactggagtgcagtggtgcaatctgggttcactgcaacctccacctcctaggttcaggcgattctgcctcagcctcccaagtagctgggattacaggtgtctaccaccacgtctggcttatttttgcatttttagtagagacagggtttcaccatgttggccaggctggttttgaactcctgaccacaagtgatccactgcctccgcctcccaaaatgctgagattacaggtgtgagccactgcgcctggccagaaagtcattctttatcaattagtgtataaatgtttatccatattttattccatacttttacatttaaatgtctaattggaataatgtgatatagggacttaaaaatttttggcagtgcttttaaattgttagctaatgccatttgatgaacaaacttttttgctttgaattttttcagacaagatagaatctaatgtttttatagataccttttctttgagacggggtctcgctgtcacccagactggagagcagtggtgccatctcagctcattgcaacctcgatctcctgggctcaagcagtcctcctgcctcagcctccccagtagctgggaccataggcttgagccaccatgcatggttaatttttgtattttttgtagagatggggtttcaacatatttccaggttggtctctaactcctgggctcatgttgtctgtccaccttggtggcctgataccatttttattatcatcactgcccaaagtgctgggattacagacatgagccacctcacctggcctgattccatttttattatctaagtttatatgtaatatcagatctttttattttacatcctgtcctatttattcctgtacttagctgcttgaggtaatttgtggcatattcctcctcactattcctttttttttttttttttaaggtttcttcactttgctaacatagtctttctttgggtgaactttagcagatccttgagggatggggagaaaaaatatagtggggagacagtagcaagagtgaaagtagagaggttggtaaactctggagatttacctcaataacttgtaattgaattcttagtctgtgtagcacattatacatgcatatttttgtatccttaaatttgggaaatgtctgttgaggatgttcaaactaatttcttttttcttttttttctttttttttttgagacggagtctcgcttagtcgcccaggctggagtgcagtggtgtgatctcggctcactgcaacctccacctcccaggttccagcaattctcctgcctcagcctccctagtagctgggactacaggcatgcgccaccatgcccggctaatttttgtattttttagtagagatgaggtttcaccatattggccaggctggtctcaaactcctgacctcatgatccatccgcctcggtctcccaaagtgctgggattacaggcatgagccaccgtgcccagcctcaaactaatttctaaagttcaaaatatttttgaggtttgaggtttgggatgttatagaaagggcataggattctggagtgaaaatggatttaaatgttggctttaagtttactaaccatgtggccacaggcaagttgtaatttttgaccaaatgtatgtatcacagatattatttctcattattctgttacttgactgggtgattcttgagatctaggctgacccatcttggcctaaaggcttaatcgccttcaggagagagacttggagatagaaacttgagaacattaaaaacgcttagcacattgtatatgacacttagcacattgtatgtgcccaagaaacatttcctaaaatgaatctaagtctaaaatacttttaaggttttttttaatatatatatatattttattatactttaagttctagggtacatgtgtacaacgtgcaggtttgttacatatgtatacatgtgccatgttggtgtgctgcacccattaactcgtcatttacattaggtatatctcctaatgctatccctccccactccccccaccccacaacaggccccagtgtgtgatgttccccttcctgtgtccaagtgttctcattgttcaattcccacctatgagtgagaacatgcggtgtttggtttcttgtccttgcaatagtttgctgagaatgatggtttccagtttcatccatatctgtacaaaggacatgaactcatcattttttatggctgcatagtattccatggtgtatatgtgccacattttcttaatccagtctatcattgttggacatttgggttggttccaagtctttgctatcgtgaatagtgccgcaataagcatacgtatgcatgcgtcttcatagcagcatgatttataatcctttgggtatatacccagtaatgggatggctgggtcaaatggtatttctagttctggatccctgaggaattgccacactgtcttccacaatggttgaactagtttacagtcccaccaacagtgtaacagtgttcctatttctccacttttaagttttaaagtgtcatttgtgtcaatgatttgacttcaagtatggagggagagaagcagagtagtttagctatagccaaaacgtttcatttgtcatgatagtaaaacatgagttcaaagaaagtattaattgttcatctatatggcattaagaaatatgaataaataaagccagagtctaaaatcttatttgaacattcctttttgctgaaacttagctgcctgcttctaattagaaaaaaatttttttttggccggctgtggtggctcatgcctgtaatcccagccctttgggaggccgagacaggtggatcacgggatcaggagttcaaaaccatcctggctaacacggtgaaatcctgtctctactaaaaatacaacaacaacaaaaaaaaattagccgggcgtggtggcgggcacctgtggtcccagctacttgggaggctgaggcaggagaatggcgtgaacccggaaagtggagcttgcagtgagccgagattgcgccactgcactgtacttcagcctgggtgacagagcaagactccatctcaaaaaaaaaaaagaaaaaaagaaaaggttttttgttgtcgtcaatttttgttgttgttgttgttgttgttgttttttttttaacaagaagttgtgttaagtaaaggcctgaaagggacagaagacaaaaagtcgaatggaagggccactttaccctaatcttttgggagttttcctttttttttttttttctttttgttcttttcctcatctctgtatctctttctctctaaagtattatttttcacctattaatgtatatgggggtgttgaggtatagaccctgggtcaaatccagaagctattctctctttacagatgcagagctttactgctgtagacttgattcctaaacagggctaccatacccatcctaacccagctgttcagagaatttagattaagtcaggaaagtgagaaagtggccttggctttttgtgtactttagacctatacagtggtctaaatgacctgagaatggttcaattgggtggaaaagggaaaaaaaaaaggtttatcattgagccaataattagttcaatttctgaatgtttcatttagcagatatttattaaataactactgtgggacaggcatgctatcatgctgaaataaatgaccaatgaggcgtgtaaacaaatgatacggaatgtaatgttctttaccaggtattctagcagagtaggaagagtattccagtaggaagagttctgaaggaaatctattcatccttgagtgctcaaaatgcaaagagtgctttgcgcatagcagtaaccataagtgtgtgtacgaatgaataaacatgattcaaacaatgtgattagatcatttacaaaatactgtgagagcacaaaggaggaagtgaccaattcttccttttaatgacacagtgaggagagaaaggctcttgggagattcagtaggtggagaaggcctgaaaaggtagagtgaaaaagcatgacaatgctctgaactaacaagttcagatgtagagtatatgctgggggcgtagaatgccgaggtaaggcatgataaggtagacagaagtcaagatggataaatgttttgtattggaatttattctgtgggtgctgataggccagtgaaggtttttttttttttttttttaataggaatattaaggggtagaatttgagacattcctttaaaaataaattattcttgaattgggaaatcaaatgatagaattgtaaaaattataagcatatatgttggcaatgattatggctaataagtcgtataatatatggtggaatctgttttatccctttcagataacatataatcttagtacagataaaaccattttaatcaaaatatgcatgatgtcatcagtttgtttttgaaagagatttatttttactttatggaattattacagactgtattctttcttaaagattctggcatttttttaaaacttattttgaaatgatcttaagtttagaaaagagtttcttaaatagcgcaaagaagtcgtgtatattttttatccagtgtccactgatgttaacgtcttatgcagtcatagtatagtgatgaaaactaagaaactaacattggtacagtgctattaactgtagactttattaggattttcccagcttttccactaatgtcctttttctgttccaggatctagtccaagatataccacactgcacttaatggttatctctctcatccccccaaatctcttttttgaccttgaccctttggaagagtaccagtcaggtattttgtagaatgtccctcaatttgattatatctcttgttttcttgtgattacggcctgaagtaatgagttttggggctcttggaggttttttaaaatttcattttatttttcaaattatcataaagttgacttttttgtggacagctctgtgaattttgacatgtctaagtttgtgtaaccatcaccataatcaggatatagaacaattcatcacttccccaaatcctcatgctctctcaatagtcacaccctccccaaaatctgtatccctggcaaccactgatctgttctccatcaatgtagttttgtctcttcaagaaatgttatataaatggaatcatatagtattcagtggtccctaacctttttggcaccagtgaccagtttcatggaacacaatttttccacagaagttggtgggatggtttcaggatgaaactgttccacctcaaatcattgggcgttagattctcataaggagcacgtaacctagatagtttgcatgcacagttcacaatagggtttcctctcctatgagaatctaattctctggctgctctgacaggaggcagaactcaggtggtgatgctcgcctgccttggggttgaggacccctgcagtatgtaaccctttgacactggcttctttcactcagcataatgcttttgattgtcatctaagttgtatttatcaatagttagctccattttattgctaagtatggatgtactgcagcttgttcatctgcctcttttcgttatgtatttgagaacatactatgtgtcctggcactataacaagtaatttaagtgaattattatgtgaaataaggattataactgtccctttcacagatgtgaaaacagaggcttagagagtttaagtagctttaagttaaaaactagtcaatagtagagttaggactcagcctgggtcacccactccaaaccccatgttcttaatcatgaggctacacagctagttgctaatgttggtttcctcatttctctgttttgaccagaagtgtaactaagagaagttaaagttcacatttctttaacgtgtcctaaaattccctttcttttctcttttatcaaagagcaaaaataataatagcaggggtaattttttaaaaaatcattttgggggctaagagttctgtgattcaggcctaaagcaaaaggttaagccaagtcagtcatcagtccgtaggacattatgacttaacatttaacattgagtggttctgtttatgagcattgtaaccatagtactaagttttttctttggtttgtttttttttttttttagaaacaaggtcttgctctgtcacccagggtgagtgcagtggtacaactgtagctcactgtgacctcaaactcctgggctcaggagaatcttctgctttggtctcctaagtagctgggactacaggcttgcaccaccataccaggctaattgttttattttttgtagagacagggtctcactgtgttgcccaggctggtcttgaactccttgcctcaagtgatactttcacctcagtgctgggattataggcatgagacactgtgcccggccctgttttttcttaatctccttataaatagaatatttgttttacagataattaataaatatcgctgggcgcaggggctcacgcctgtaatcccagcactttgggaggctgaggcaggaggatcacctgaggtcaggagttcaagaccagcctggccaacatggtaaaaccctgtcgctactaaaaatacaaaaattagctgggcatggtggtgcatgcctgtaatcccagctactcaggaggctgaggcaggagaatcacttgaacccgggaggcagaggttgcagtgagccgagatcgcaccattgcactccagcctgggcaacgagagcaaaactccatctcaaaaaaaaaaaaaagtaaataaataaatattaaataaaaatggagaggcattctaaatcagcctggtttaaaataagagggttgccttctatgatattgctttaaattttactaatgacaaaggtagttgtcttttaagaactgaaattttggtgtatttaagatgaccctttttgaacttgtgtgctaacagcccatttgctgaaatattctactgctataagataaaaagaatgtttctagaatgttagtgtagtatttctacattttattagtgaagtatgatatgtataattacattttcatggattttataaaacttctatgttattctgggtatctggtaactttatgtgttaccttagcaaattatataacaatttgatgaggagacttttttttttttttttttttttgacacggagtcttgctctgttgcccaggctggagtgcagtggcacgatcttggctcacagcaacctctgcctcccgggttcaagcaattctctgtctcagcctccctagtagatgggattacaggcgcccaccaacacccctggctaatttttttgtatttttagtaaagacggggtttcaccatcttggccaggctggttttgaactcccaacctcgtgatccacccacctcagcctcccaaagtgctgggattacagtcatgagccactgcgcctggccaaggagacttgttttaagtgtagcctcagtttgattttttgttctcagttctgtagatactattctgagaacctggagaggctataaaatcaaatgtcagaattggaatggatcttcaaaattatcagctctctagattgtcccaatattttacaaaaaaggaaactgaaattccatagtagtgtgaaataacttgtccacacttacagttagttgtagaagctgcacgatacagttcctgctctcaggtacattactggttaatcagtgtagaaacagacttgtacaaaattgacagtaatacaaaatagaatgttctagatagtaaaggtactgcttttcttttctttttttctttctttctttcttttttttttttttaatagggtctcactctttcacccaggctgtagagcaatgatgccattatggcttactgcagcctcaacctcttggcttcaatcctcccaccttagccacttgagtagctgggaccccaggcacgcaccaccatgcctggctcatttcttttatttttttgtagaaatggggtttcatcatgttgcccaggctactgttgaactcctaggctcaagtgattcacctgcttcagttccctgaagtgctaggattataggcgtgagccaccatgcctggccagatacaacttttcttaaacagtctcgtcacctccccactgcaccccccaccccccaaaaaaaacaacccaaatcaaaaaagctttctcttgaccctttcacaacaaaattactttctttttatgtgtgtgagacagaatctcactcctacccaggctggagtaaagtggcatgatcacggttcactgcagcctcaatctcctgggctcaagcagtcttcccacctcagcctccccagtagctgggaccacaggcacacaccaccaagtctggctaatttttatttatttttattttttgtagagacaggttctcactgtgttgcccaggctggtcttaaacttctgggctcaagtgatcctcctaccttagtctcccaaaatgttgagtttacagatgtgagccaccacacctgacccaaaattacttctgttttcggtttttcatctcttattctctcttaaactttacctaatcagggttttttgtttgtttttacctttgctgtaccatgaaaactttcctttcaaaaccaacagtgacctccatgttgccaaattcaactgtcatttttttctcagaccttatctaacttgatctgccatcagcatttggcacagttgctcattccttattcttggaaacacacatgcctttttttcttcctacatttctgagtattccttttagccttctttgttgttatgcctcatcttttctacttctaaatgatggagtgtcccaagagtctgtcattgttgcttttctaacctatagctttaatattatatacatgttaatgtaatataaatataaatatatatatatggtaattattcccaagtttatgatctctagcccatacctttaacctgggctttaggactgtatattcaactccaggactgcatatctaatttggtgtctctagtctgataactaatgagcatctgaagcttaatgtgttcagaactgaactctgatattcctctacctcaaaccattgccatttgtcatctttcctgtctcagttttggtaactgcagtctttccagttgctggagaaggagggcgccccagctccaagaaagagagaattcacctttctatccaggtccttagccaattgatggtgcccacccacattggatgagggcagatcttccttatggagtccactgattgaaatgcttatctccctgggcactttggctcacgcctgtaatccttgcactttgggaggctgaggcgggtggatcacttgagcccaggagttcaggaccagcctgggcaacatggcaaaacctcgtctctccagaaaacataaaaattagccaggcatggtggtgcatgcctgtagtcccagctactcgggaggctgaggtgagaggatcacctgagcctgggaggttgaggctgtgatcaggccactgcagtcaggcctgggcaagagatcaggactgtttcaaaaaaaataaaaaagaaatgccagtctctctggaaacaccctcatcctcacagacatacccaaaaataatactataccagttatctgggtacctcttaattcagttaagttgacacctgaaattaaccatcacagttccaccccttgtcaacttggcacccatgtggcacccatgtgcacctacttaaaccatatttaatctccgaatagagacaattacgaaattgtagctctgcctaaaatgatacaactaccctgcatacaattgaaaatgcactgatttatcctcagaagaggaggtaaagctcttgaatgttgttctcttatgtcccacaatttaattatatgatgtaaaattaacaatacttggccgggcatggtggctcacacctgtaatcccagcactttgggaggccgaggcaggcagattacgaggtcaggagtttgagaccagcctggccaatatggtgaaaccccgtctctaaaaatacaataataaaaatggaaaaattagccgggcatggtggtgtgcacttgtagtcccagctactcgggaggctgaggcttaagaatcgcttgaacctgggaggcagaggttgcagtgaaccaagattgcgccacttcactccagcctgggcaacagagtgagactctgtctcaaaaagataaaaaataaattagcaatacttaaatactgatataaagtaaatacatcttatattacatagtaaaggaataagaggaaagaacacaaagatatttgctttgttatatctatgtatatatacacacaaatgtattctgaacaaaatagggagaatatagtcatgacagttaaaatcctcatttccctaactggtcaggtggttatagctggcattgattactgccttcttgtactacatattctgtattctgtttgccttcagcaaacgccttagctggtcgtggttctttatttggtggggtgacccaaagcttcattcttaaagggtctgggctattagtagaccttcctggattgggttgttgtagtttcccgttgacttatttaaagggcatgataatacaaagagatgccccaagggatctcctgtattccagacatactcttctttatctgcactgtgagttagtagtccagcttcccattcctagtttagattaatcacccccagctatgttgactcagaggcatgaggagcccaaagtggctggatggtagttttgactccagttccatggaatcattattgtgtttcctggtggaagtattcctctctctctggaactaagacttctaggccaaaagagcataaagttacgggaacaggaagtaaaaattttgcttgtgggtaatggtgagtagtgccattcctatttgtattccttagttcaggaaacaaggaatattgactcctggctgtgggaaaaacagtaccatgtagtggatgctaactcagaatgtgtacagccttctggagaacctagtgctagacctgcaaggtattatcacctagctggcactgtaactgaatcttctaagggccatttcaccatcctgtcaagctagctgcttcaggatggcagggaacatggtaagaccaatgaattccatgagcttgagcccattaccccacttttgtgactgagataagttccatggtcagaagcaatgctgtgtagaatgccatgatggtagataaggcattctgtgagttcatggatggtagttttgggagaagcattgtgtacaggaaaggcaaatttgtatctagagtgtctattgcagtaagaacaaactgctgccccttctgtgatggaagcagccaccaggtagctggcggatcaccccagggaatggtgccatactgggggctcattgctggtctctgctgctagcagattgggcactcagcagtggccatacccaggtgagctgtagtgagtggaaatccatgttgctaagcccgtgaataacctccatccctgccaccatgtccaggatgagccccctgggcaatgacaggtggctggggaaaatggctgactggtatccataaaacaggtcatgctatccacttgattattaaagccctcctctgctgaggtcaccctttggtgagcattcacataagacaaatatcttcacatcctttgcccagttaggagagatctgttctgccccaaatttctttgtcaccaattttctggttatgttccttcgaagtccctgagcatcctgtgaaaccattatctattgcctatgcattgacgtataatcacacatctggccatttctccttcacagcaaagtgcgtaactgggtgtgctgccctaagttctgcctactgggaagatttcgtgactgggaagatttcatgactggatgttccagaaaaagggctgtagcactgcagctgtccgcttttgggtggtgctcgcatgtcgtgcagaaccatctgtaaacaaggctctgtcagctgattgtagaatattcctcatgaggccagaggtacaatctgggtgagaaaagacagtgtagcaccaggaaccatgggcatttgggccatttcatgtaacttgtgcctttaggacctacgcaggcccaatcacatatatgttacctccacttgatgattttaatggtgctatgcacgcccagctttgtggcttggagtgggtcaggtaacacccacttccaagtagattgcatgataacttggtggcccgtggtgaatgttcagtttctactaaggtccagtagcaggtcaagagctgtctctcaaaagggaagtattatctgcagttgatggcaaggtcttgctccaaaatcctacaggcctgtgctgtgatttagctatagagagaggcctgccaactgctgatacctcaagtaccattggatctgctgggtcatatggcccaagtggcagagcagcttgcagagcagatttgttacagatttgttacagagccttctattctgggcccccctcaaaactagcagcttttctggtcacttggtaattgggccggagtaacactcaaatgaggaatgtgttgcctccaaaatctaaataaaggagttaagtgttgtgcctttttcttggtagtaggaggagccagatgcaacaatttatcctttaccctagaagagataccatgacatgcctcacaccagtagacccctagacattacactgaagtagaaggcccttgaattttagtcagatttatttcccaacctctgacatgctatgtgttatcattaagcctagagtagttgctactcgttgctcattaggtccaataagcataatgtcattgatataatggactaatatgttaccttgaggggaaaggtgatcaagatccctgtgaacataggtctagggggttgatatatccctgagttaggacagtgaaggtatttttggccttgccatttgaaaggaaactgcttctggtgggcctcatggacaggtatgggggaaaaaggcatttgccagattgatagctgtatgtaacagataccaggagatctgttgagggtaaagaatgagctcacatctggtacagcagctgcaatcggagtcaccacttggttaagcttatgataatccaccgtgattctcctagattcatctgtcttctgcacaggccgaatagggtttatttatcagcagtatgtctcttttgtttgctgtctagcaaggggctagaacagtacctggcacatagtaagtgctgagtaaatatttgttaaatgaatgacaaagagtccctcaaatcagtcactaacttgacattgggaagtcactttgtacagacctcttatctctatttttaaaatgagactggattggattcgtgttttaagctgtcctacagtgaagacttaaatgtatggagtgtcaaggttccttgaagcctttataaaaattcagctgcttaagtaaaaagtttagaaaccactggactggataaagtgtctctaaggtctctttcagttctgcgataaccagttctcacagtaattgtaagtggggctgttgaggagatccttctgtagaggaggcattgaaattgagacttgatggatggatgttcataggcagaggtcgggcataggataggaaataaggtaagtgcttttcaggcccagggaacagtgataaggaagtgagacaaataggaatggagcaattcaggaaatttccgtacagctgtcaggggctagggagtgagggagagtcaggaagatagggctggaaaagttagggaaattaaagtcagattgtgaaagccttgaacgccataatagtctggcttttaattttgcctctaagaaatcagttattttatttctttttgttttttgggccataagtgataatcatttcactctcagagttgttctttaggaagacttctctaatagcagagtgatgggtgaatttaaagtaggcagttggtggtagagaaagattctgtcagttaggaggagactgtgatgttacttttcctgtgatatgatgagtacttttttacctgaagagtagcaaaggaggagcttaagtttcactttaaactcagtataaaaattagatttcctctctgcaacatttagagattattgaatagtaggttaacaaatgtctttgagtggctgctgtgtgaagagcagtaactacagtagatgctagggctacatagaaacacagcaatggtggccatgtgtggttgttcatgcctgtaatccaagcacattgggaggccgaggcaggcggatcgcttgagctcaggagtttgagaccagccttggcaacatggcaaaaccctgcctctacaaaaaaatacaaaaattagccagacatacaaaatacaaaattagccagaaatacaaaaaaatacaaaaaataaccacattgtggtgcatgcctgtagtcccagctactcaggaggctgaggtgggaggatcgcctgggaggcagaaattgctttacgctgaggtgccaaggtcctgccactgcactccagcctgggtgacagagcaaaactctgtctcaaaaaacaaaaacagccaccccccccaaaacaaacaaacaaacaaacaaaaacagcagtggttctcataagcctgacctccacctgcactactgaatccatttccaggagttggcatgtgtcttcataaagctccttcaggggtacattcctggttacaggctactgaagtaaaagatacattatttttaatattgaatttaaaatttaattatgagagataaaatatgtctatacaaacaacttgagattgcagtcagcatattacctgggagctttataaagaatataatcataccatcaattcttggttatttttaatatcagaggaaacagtaatacccagaataatacctgcaatagaaccttgaatttgtctatatcaagtcataggggccaagtcatgtctttaaagatatttcaatgtttacgaaaatcctgatatgctacatttttcccctcagtgagcagttttaggaaagtcactcattcatgtctctgaatttctgctgagttttgggccttgtcctaggtgatgggaatatagtgcagacaaaagccatggccccttttgcctttgataagcccctgaaaatacatagactgttgcctaagaggcctgctttttgtgggtggtaaaaagtaccacctagttacctgtccgtgcagaagtgggaaagaggatttggtttaacaaagctagtgatagagcatagaaaattaactgtgttttacgtttaagctcacatgtagaaattctacacaattcttggaacctgggattatatttttgagaggcattaacatcaacaaaataaattctgcatgattgaaagattcataacactcaatctcagtcttctgaattttatttttctatttaaatagtggggaacattgattttggtcatttgccattttaatggtgtgatcttttctttttccatctctgatagtcatagcatgttagctcccgacctatggggcggattcaaacaaagctttttttagcctaagtttcctagatatggaaattagagtattctgtatttttgtactagaagttttgagatttgagttcaaagggaagaggtaacagtaaaaaggaaaaatgagccctagcacaataaattctttttataaattctgttttggtggaggaaataaatagtatctgaaatttagttggcatttaaattcattcagttgactcaatctctctcagctaatagttcaaatatacatgttgacaattccatgagcagccatgaaagctttatataaggtatatactgacttgatccatatctaattttataaataaacatacccacagtatgtacatttcatatacctaaactagatttatttcttccttcctcccttcctcccttcctttctttctttctgttctggggtacatgtgcagaacttggatatttgttacaaaatgtggaggtctgacacagagtcttgcttggtcacccaggctggagtgcagtggtgcaacctcggctcactgcaacctccacctcccaggttcaagcgattctcctgcctcagcctcctgagtagctgagattacaggtgtctgccaccacacctggctaatatccgtatttttagtagagacggtttcaccatgttggccagcctggtctcgaactcctgaacttcagtgatccacctgccttggcctcccaaagtgctgggattacaagcgtgagccaacgtgcctggcctagatttctttttgttaaaatcagttttattgaggtatggtttatatgcagtacaatttgccctatttagttttatagctctatgaattttgacaatgtacataagtcatataccggtaccacagtcaagatacagaatatttctgtcaccctcaacagttccttgtcttcctttgtagtcaaccccctcccctcatttccagcccctagaactgataggatttctgtgccttctgttttgccttttccattatgtcacatataaatggaatcatacagagtcatggagtcagtcttattttgttcagcctaatgcttttaggttcatccatgttgtcacatatatcagaaattcagaccttttttgttgctgagtagcattccattatatggatatactataccattccattacatggatttatccattcacacattgatggacattatttgggttttcaatatttggtgaatgataaaactgctatatatatttgcatagaagttttaaaatagacacatatcttcatttctcttgggtaaatgcctaggaatgggattactggatcatgtgataagtgtatgtttatagaaactgctaaactatcttccgaagtggctaaacttttgcattcccaccagcaatatatgagagttgtagtcgctccatgttctcatcaacacttggtattattggtggtttttgttttgttttgttgtggtggtgtcacattaatttgcatttccctattgagtattgatgttgagatattttcatgtactttttttgccatctgtatgacttctttagtgaagtgtctattcagatttgaccatttaaaaaactggattgttttcctatttttgagttgtgaaagtgctttatgtagtctggatagcagtgtgtggacttattttaatcctcataatctgtgtggtagatactattaggctaaatgatagataaataagttatgatgcaggattgttaagtaattgcccaagattacatagctaataggtagcagagctgggattgaaacccaagtagattgactagaacctgtgtcaaactgtttgcctttttttttctctttgatcctctcatatgcagagattgacttattggggctgtaaatagaacaaggatccagttcctgtaggtgatagaataatgctaatagggatacccctgggcagagggataatatattgtaatggcagctctggagtcatctccttaggaacagctaagatatttgtttctgttgaagaggtgtaattattttccctttaattctcttcacattactggtggccagagtacttcctttaaattatgtttggaatatttgccattattaagtaatgaggtgcattatataaatggattttctcaatagcagaagcttatccttttagatacctgttctacataaaacatctcacacacttgatgttacacactttggctttcgaaggcctgtcttaaactaatgctgacttggagacacttagtgtatggtaatatacttagggaatattacaacttactgaccttatataatggcttcatatctgaatacttttaaagttatgtttatttttagttttgtaaggtgggtttttttaatgtcattatcagctatttcactttttctgacatccttttataatactgttgccctcttttacctgttacagtttttatttctaattagccaaaagaagataatcaaattgttaggtttacattcatgttatctaaaataaatttcagatatggaaaattacctggggggaactttccagggaacaagtgaatctcccgtgactgctcagcggaccttgtttcttggtgcatgggctctgaatagtcattttgtgtaagtgaactaaagtaagctaaatatgacatttgacaggagaaaacatggtctatatttctttttaataaatttttaattaacagtttgtaaaaccatggagattatttttcagtaaaaggataaaccaagcaatcttcagtgtaaggaataaatagacagcaggcagaaagttggttcacaatcattgctgttttgcagcattttgtaaagttcctaagtcagtgacagcttgtgctctcaactatgcctctggtaagccagaataaactcccaactaattaactaaagggagaaaaccttgctaaatcctatttactttttgtaagataccaggacgaaggctatctattgagttgcatttatcatttcaagcgctttggaagtacttagtgctttcaagccattttgattaatttaagctcttagaataaattaataagtattcacccagaggccagaataagtaggtgtagtaatatttcagtggcttgggcactttgtcagatgtattctgacttggaaggcagagcttcactggccacagttgtccccttaggttggccttgccacaattgcagtggagctgtagcagggtgcctggcacaagaggcttgaaatacatgtagaaaattttgcttgaaaggtaagtcaaactgtagctatcatttggaagtagtagagttatgaactatgatcgtaccaatacttttttaaaagggttttatcaagcttgcagtttatttaaaatcattttgctttgttggactttaaattcctaacattggggtgtgggtttttaaaaattctgtaaaccagtttaattcacacttatttttccactgaactttgaattttctagtggattttatctgtttagtgaacttacagatctgcatctggctttgtagtttgctagcctttccagactacatagcaatatatctctttcatatgagggttaatgagtagccagattacactcaccagtccattgttacattaagagccacagagtttgctatctcccttccatcccctttcatacttttttcctttcacagttttatttgatatagtaaagcaacttttaaaaattgagatttttatattttaaaacaatatatagtttttaattttgctcccttgtaggttcttactctattttattgttagttttaaattatggcaattaatatgagcttagtaatggtctaatcaaggtagatcttgctccttgcctcttcatccccactttcctataccgtttttacctgcagatttgcatgtttgacctagcagaataattgggtccacagcaacatgggcgtgcctcccttagaaacacttggtttcatgtatgactcataagctgaagcacagacaccacttccccaatctacaggagccattttaacagctaaaacttgtcggattgctttttattttcaagctcaaaagacgatagagaaagaatacttgaaggtaacttgttacaattttgtatgtttgcttctggctttttcttgagctgataaacagagggtggttcttacctgttgaagaacatggctgaatgtgttctttaaccctctgataaaatgtgtgtggtcagtcacatgcctgattgaacttaattgctagggggaaacaaagcactgaaattctggaaagttttagatcttcttgctaaagcattttgtatgtctttgtgattttttttctatgtaatttaagaataaaagaggttttttgtttgtttatttgtttttaagtaccacaaagcaaactaaggtcaaattttaatttaaaaaacctaattgtattttttggggtagttgaagttacagttaagtaaaccgtattattcctgtgtgatatagatgttaaatatccaggggcagtggctttgttttggcattttagctaagggtgaagttttgggacaactcagccataggtgttgctcattgactgttatttatttatttttttctccctctctgttttttaaagttaatgaaattatattaaatgtttcattttggaaacccaatggaaatttaaatgaattgttatttagataataagtaaaaatgaatattagattatttagataacaagtaaaagtgaatattaaatagaggaagaaagactagaatgattcatttactattagaaaaaaatgaagttttataattcacactgaaaacttgttctgagtaacaaccttagaagtaaagctgtcttctaaggaaacgtagttatttcaattttgtgtaaaaagaaaaagtgatgagtattggccttccttttgtattactgttcttaaaatttgcctgccttgaattaaaaaccttctgtaaatgaaaagattgctcagtcttttcctgaagtacttgtcattgtagttatgagattttggctggcaagtatacatcctactgtgccttaaagttctaggtgctctgtaaagatgagtgcagtagtattttatttctgaaacatatttatgaagataaaattggaatatgcagtgattccaaaaaataaagtttttggatataaaacttgccaaatcatttcttgttgaccaaaatgatatttagctagttctttgagaatttgctatgcacttactaagtgcttgaaggcctgtcagattaaagggaagagacaaaggcaatcagttattatttcttactcttttgtaaggattgttgatattaacagatctcaattttgcggtcttacaagaaagacacagcggacattttaccaattcagctgagccatttgctatcatctttgtttgcatattgctggtttagtcagcctttgagtaagcaaaagctgtatttacttctagtctggtctgtgtgaaaaatctaatgaagacttttctatttttttttttaacttttttaaggtggtgatccataagagaaaaatcaagaggcacacaaataagcggcataattaagatcttatttattaaagagaagtagaggaatttggtttcttaaatttaagaagctggtacagttaaagtagtatagatattgtttatgtattttcttacgtgatagagactgaagtggagtttcaaggagaagggagaagggggggtaaaaagaagagaaccaagaaaagaccagaacaatttattaagtatttccctctccacgtttttccttccataagattgaatgtaagtttgaactgacccatcagaattaaatttagaattagtgatttatagaactttagtgctgaaagtgactgaagattgtccaactgcctcacttttatagatgaagaaacagtggcccacagaggtcctgtgatttgcttgaggtcatgcagtacctaatggcagggcttcgcagtctggaactgcttgtgccagtcacaagtgatgctttgtttgaaatgctctatatttccttaagagtaaataaaaccttaattaagatgtttggtgataatcttggtgataagttgcaaccaaatggatcaaccaatgattttgaaaatgtagttttctttttcatcagaaagatgatgcattcattttatttctacaacaactttttgtttttcactgttagaatttttttgttcatgactgcttattttaagatggctttagatggaaatatgaagaggtgggaattaaatttgagcttctagatacaaagacagttttatttctgctttagttttagctcatatatatatatatatatatatatatatatatattttttttttttttttttttttttttttttttttgagacggagtttcactcttgttgcccatgctggagtgcaatggtgcaatctcggctcactgcaacttccgtctcccgggttcaagcaattctcctgcctcagcctcccaagtagctgggattacaggcatgcgccaccacgcccagctaattttgtatttttagtagagacagggtttctccatgttggttaggctggtcctgaactcccgaccttgggtgatccgctcacctcggcctcccaaagtcctgtgattacaggcacaagccaccgtgcccatccttgcctcatattcttttaggagggcaaatattgtttaatgtgataccttgttatactaaagtatgtgtatgtgtaaaactttgcatgtgactttacaaaatccagaggtgtctaagctttaacattacacttatcttaaatttgaccttattataagatagtaatctcattttatttatctttgtcacatcttctcctcctcctttgaaataagagaattgtttggtatatacaaaatcttttgtctgttaactttttggtgtgttttattggggtggttggaaattctctaggtctgaaattcagatttttaatggtttatgcataactgctgaatctcctaaatttctgagtgccctaactcaattcggtgcgaaatcgtccacagtgtggccatcattgtcctaaaaaacaaaaagcacaaaaggctaggaacatgggctttatcttcataaacttaaattcctgttgggaaaacagggcttgttaacaagtgaagtaaagaacagaaccaaccactgactaggtaaattcagattcagattgcctagagataaaagatgactgaaagaatactcaggagagtttatcttgaaggaatgatgaatgctgaacgttgaatagcatttacctatgttaagaagagtgtcttcgtcaataagaataagaatatacgctgtttgagaggagaaaggttttattctgtttttctgtctttttcaacctttgacaaagtaccaagcacatatgagtagacaggtattatttgttgtattaaacctttggctactcttttttgccatcttacgtgacaaattcagttggccatcttgctgaagttaaagatggcacatctttaaaaagcatgtggccctcagcttaatctctgactggtgtctgcatgttgtaggtaatactatgatagtattacctttaaagctgtaattgtcaacctttggtgtaacaaagaatcacccagttttaactcagaaattctgattcattaggcgtaggatttgcttaaacaatcagcattttttactgtgtaccctaaatgattatgacataggtgcttatatgccacattttcagaaagagagtttacaggtttaaggctatgaagaggaattagctattttgcctttaaatatttgaagttttaggcagcaatgctattttgaagcccatagcctctagtaaggaaggaaagcaactagagtactttattatcagtattagaacccatttgggctcctttcccatcccagttatccctttctctagtctgtttttttttgctgtgctatatgttgttcaactatgtggctatccgtctttccttttctctgatccacccccgaaacctactgccatattggccataataaataatctttgttttttaatgtaattaacctattttttatttctcagtgaactcttccagtgttagttgttttggttccaattgttgcttcttggtttccctctccatactcttactcctggggctttaggaaaaacacccccttactgatttagggtggcatttacagccttttgaaagctcttctctcttgagaaatacactattattatttgtaatatttttgttttctttctttttttggggggagggcaggggtgacttaaagactagcacaatagtatgtacttgtttgagtctgggaggaagtaactttttttttaaccctgtaatgcttggatatgatttttgaagcttcttcagatatttaactgcatctttgattgcatatttgtaggttttgcctaacattacatctcatctaatgggacattgttaggtattcactgacttggataaatgagaagaaaattcccctcatttgaattgtttgaagataatcattgcttccataaattagccagactattttgctcctttacttaggagctgcttcatataaatggttgaaattaagttagtaccattattgagtcaactccaatgattaggacagtttccaactatctgaacaatcttccttccattagtatggagaacctacaaaagagttttttgtgtcttgtcaaatgagctgtatactataataaaagtggctgttgagcagtactacaaatgtcttttctggtcatggttctaagcaccttaagttattatatgaggaaaataactcattgtgtgctatttgctttgttgacagagagggagaaattatgcagctgagctttggatatacaaatttctatgcagaaatgttttgattccttctcttccaggtattaacatcatcctcattgtcagagccctcttgccttctatagtttgtatgaagattggtttaacaatttttatattaaaagctatcaaagtgatatatgcacaccattcaaaatttaattcataggtctataatgaaaaggagccttcctcctctgccccttctgactctcagtcctgctgtccaaaggtaaccacttagagaagttgtttttattttttaagtttgtgttttcatgtgatttgtcctcgtcctgtgttctactctatatattagaagctcttcaaagtagcaggcaccagtatgactttacatgctgcagtatctacgtgatagatgcccagtcatatagtgatcattatgtctgggctgttacatggtacaattttaaaaatataaatataattaaagaaaattagtttctgggtttagaaaacaatcccataaatagtaaaactataaaattttataataaaactattaaaatgaagtgtaacaatttatgtacatcttattttttatatcaaaatactaaatggaagtttagtattgtaatggggcaattcattattttttctttaaaaatgaaatgtgcatgtaggaaaatatatataaaacatagagtttaaataaaactataaagtgttacaacatgggtaaatattttgtattttatttaaacagttttgcctcatatttataagtatcttgagaaacaacccatgttaagaaatatagagtatgtctattaccctagaaggcccccactcctattcatgtttgtttcctttaaaaaataactactatgctgacttttgcgataatcttttctttatagttttacctctttgaactttatacacatgaatcacaccatatattctgtagtgactttgcttctttcattcagctttgtgacttatgttacttttcgttgcaatatagtattccattgtttgtctgtaccagaatgtatttattctctcttgttgatggcattagattattttgagcttgggaacacttgtacatggttccccgggacataaatgtagaagttctgtagagcagtatcttcacattgagggatgtgaaggctttgcagagtatagatagtttaatgtaatttagagttcttcattatctttcctaggatcagatatctgccgatgatgacttctaacccattcagaatctttctatggtatattgccctggggtgtaaaatcctccaggaccctaaacagatggacagttgatgcatttcagggtaagctgtagacaacaatatatttgacccctgaaacaattcagtatgcttgtcatttgttaactagagttatttcaaacataattttgaataaaaaataaattttaataaatacatgttcccaattatgcatataaaagcaatcctactatcttgatgtatatgtagtaaagttataaaaatatataacagagaagataccaattttagaatagttgacaagtgggcactgtagcttatgcctataatttgagcactttggaaagcctaagtgggaggatcacttgaggccagaaattcgagaccagcctgggcaacatagcaagaccctgtctctacaagtagaaaaaaaaaatttttttttaagttagccaggtgtggtgtcacactcctgtagctccagctactcgagaagctgaggcaggaggattgcttgagcccaggagttaatgctacagtgaaatatgattgcaccactgcacttcagcctgagtgacaaaacaagaatctgtctcttaaaaaaaaaaaaaaagaaaagaaaagaaaaaaaaatcaaacttagaatagtcaaagaaggaataaaatgagactggagagggatattagaggaagctttaactgtagatgacctttttttcttaaaaacaaaacagaaaaacaaaaacaaacaaactatggtaaaatataaagctaggtggtagatagatgaatcctctttggtttaactgtttcataatactcttttttttttttttttttttttttgagacagagtcttgctctgtcgctcaggctggagtggagtggcacaatctcggctctctgcaacctctggctcctgggttcaagtgattctgctgcctcggcctccgaagtagctgagattacaggtgcccaccatggcgcctagctaatttatctttgtatttttttagtagagatgaggttttgccatgttggccaggctggtcttgaattcctgacctgaagtgatccgcctaccttagcctcccaaagtcctgggattacaggtgggagctactgcacctggcctcataatacatttttatctgtaagctatagtttatttttgccccacatttataagtatcttgaggaataatgtttaatttgaccggtagtaaaagctgacttgaaagaatgtggcaataaactttgcatcagagccaggggcactgagatgcacctgtagtcccagccacttgggaacttgaggttgaaggaatgcatgaccccaggagtttgagacctgggcaacatagtgagaccctcctatttcaaaaaaatgaaaactctgcatcagttaaaaatgggatcaggcacggtggctcaagcctgtaatcccagcactttgggaggccaaggcaggtggatcacttgggcccaggagtttgagaccagcctgcaaaatacgatgaaaccccttctctactaaaaatacaaaaataagccaggcatgatggtgagtgactgtagtcccagccacttggggagctgaggtgggaggatcacttgagcccaggaggtcaaggcttcactgaggcatgttcgtgccactatactccaacctgggcaacaaagtaagaccttgtctcaaaaaaaaagttaactgcctatttcagcaagagggattgggtagattcagatgtaagtgttataagactgtgtgtctgtcccaaataactaagaagatctaggcatacttctagatgaataaatagtaatttccagttgagatccattaacaaattggagctttagttacctagaagtaatttagttaggtttcatcttcagaattatcccacattcaaatacttctcaaaaacacatttcaaaacaaaaacattcataaaataattagtatagtattaacatccatgaacttttaagtagctaatagattgttgaatctaaccagatttactggtatattcagtgtttcatcttgcttcctgatcagtgtttcatgtagcttccttagaattcttactgtaatggtagcaatttctgaatctttagtgatttttgttgttgtcattataaactagatatacattcttcaggtaaagctttcaaaatttaacaatgtaaatgtggaaactgctatagaaagtgaaaacatagatcttaacccaggtttttactttcatcatcccttggctctctttcctgaaatacttcccatagtgtatgtataagcagtggcatggacaaagaacaaatggaaatagaagtcataagatttcattgtctgagggttcctataaagtcatgtaattagaggtctcttaaatttttattatataccttttgatctatattattattgattcattcagcaattattgcctgttacatattattcttgatgttgggatatagcaatgaacaaaaaataaaaactattcataaattatatgcatatattttactaattaacctccatttaaaatgtattataattatataaagattagagaaacatagataaactagattagttttcgatgtgctacatgtgatctaaggcaaggaaagtgtgcacacacacacacacacatacacctcatacctatatgtatttttttgggggggtgggggggagataggggtgtagccctctcgcctaggctagagtacagtggtacaatcatagcttgctgcagcctcaaactcctgggctcaagcaatcctccacctcagcctcccatgtagaattacaagtgcataccactatgacgtgcaaatttcttttctgtgttttttttttttttcctttctttctttcttttttattttatttttttattggtgggtatgcggtctggctatgttgtccaggctggtcttaaactcctgggctcaatcgatcctcttatcttggcctcccaaaatattgggattacaggcatgagccaccatgcttggcccaaagcatgtatatttaacagcattatttttaatcaaggaaaaaaaaaatcccagggagtttttttttttttcaatatgctattctgagaaaagactcctttaaagggcatataataagtaataatatcctgtaagtaaaaaacatatattgataaatatgacctaggaaaacaaaggctctttgtggtcctcaatacattttaagaatataaagggatcttgacaccaaaaagtttgagaactgctgcactattgcaactagtaatttaaatatcattcttagagttttacattattaaattgaagtttaaaaaaatgcaagctttctaaaccagaactagagtaaaaacattaattcgaagttttttttcccaatgagaaaaatcatagactgtcacctttaccatttatttacttgtgtctcctagccctttccacgaagaataaccaattctttaaaattgggaagtatattaaagtattacatttaaaattaaaatatattaaactttctagcaaaggaatgcaaattaaagtcaaatagcccccctgtgtttttatccatcatattggcagtagttcaagcattgtgggttgttgcaaatgatgttaaatgtccatgcaggtattctgttgctaacagtataaactgaaaaaatcttctgcagggcagttggcattatgatatcaaatgctttgaaagtctatgtgcctttcagttcttggtgtaggtatcctaaagaaaatttaaggatgggaccaaagattcagttgtaaggatatttgaatcgttcgttgtgattgtgtagcagttctcaaaccttatacttttttttttcaagctttatgatctttgcatcgtctttatactattaaaattgaggctcccaaagagctttggttcatgtgggttacatttaccaatattaaccaatgttagaaattaaaacaaacttgaaaaatattaatatatttatttaaaaataatacgcccattacattttaacataattatttttataaaggacaagtttgagccaggtatggtgacccaagcctatagtccagctacttgagaacctgaggcaggaggattgcttgagcccaggagttcaagtccaacccaggcaacatagcaggaccctgtttttttaaaaaaaaaaagtgcaaaaaagacaaatatgtttcccaaaacaaaagctgtactgagaagagtgtaaatcttttagctttgacttcacagaagacagctatattctcatatttgcttttgcatgaaatctgttggaatatgttgcttttgttgaagaatatgaagaaaattcagcctcacacagatgtctagtcacaaaaagtagatgtattttaatggccacttcagataattgtggatattctttgatactacaccaaagctcatcaacaaatgctagttttttaaaagttagaacaatgagattctgaaaacctatgaatgaactttttgtcccctgtaacattaaaatccataggtctgtcttgtactttgaatggattgatttttttttttttaacctaagcaagattttgtaacatcatgcgtgagtcatttgggtattgcaaatgttgacatagtatcaaaatcacaccagtctcatcagaaaagccttttaagtgtattgagaagccaacagagtcaaagcggtagatacatacaagttttccaaaattctgattttcagttgaaagcttgcattttataattggtgacaattgctgttagttgttttccttgaagtgatgggcatgctttattaatttttggaaaaatttctgccagatatccaattctgaataataattagttcttttaagtaaaaattacatttcatgaaagcagcagctagtttggctcacaggtcgaagaataatagcataaatgctttttctcaagacaacaatgctatttctgtttatgccagaagtagtactttatttgtacctccaattttatcactcagaatattaaaaacatatgtatttaatggttgagattcaagaaaatagtttttactcttcttcaaagacattcttaagtgaagtcgcctttttaaaatgtgagtgcccagtggtaaggagtagactcatggcttgagggtgcagccttggtcagggcagaggcactcgcagtttcatcctgctttgcttttgcatcatcagggcaagtgtcaacacagtggaaaagccaaataataccttgccattattatgaaaagagttgtgatctcaggagccccctgaaagggtctctggatcctttgtgggtctgaggattacattttgtgaatcgctgtgaataatgcagcattagaaataatacaaatgtctaaaaattaggggttgattaaataaatgttatatggaagaaatatacttttattaaagtttatgttaaatacaagcttataacacagtatttttctgtttttggcacctctctaatgaggaaatcaacattcgtcaaagaaagtgaaggcgttggttctgagtctcagtgcttccatttagttgatgcctttgtgattaagaaaagggaagttgaatagcaggagggggcagttactggcttctccagtaggctaagggatgtttgtatagcaaccttatttttacagcaaaaggaattggcagtggtatcaatcattttttgatacttaataataatatgtggaatgtgccttcaaatgaagttcctccagtagactcaatttatatttaggcattttctgatttacattttcccgttgtgttcttcttaattgaaagagctttcagttgctgcatattatttaacttcagactgaattaaagaaatgagttataagcaggttagaaggatactgttgagttgagccccttgggcttcctgctaagacctccacacagggcgtttctgaggtgtattatctgtactctgcagcagggaggaacactttttgtgagcggcatcattgaagataggatgctttgtgcatccgagatatttctctgttatagtggaagcctaataataatcatgacttgtcttgagtaaggtttaatattttcctaagcaccaagttctaaggagggtttgatgtttaaagttcctttccaaatagccattgtgtttattcaaaattttatgttttagataaacttgggtaaagtatgctggaagaatatatacagcatgctatgtacataaagttttaaaatatactatacaaaatgtacatatgtactaaattataaggaaaaataccattaagattttagatttaagtttgaataattaattcgaattaatgttacatgtgttttagtttgaagggcaacttaaaaagtttgtatttagacataaggtatattgtgtaaattattttattcaaaatgttttcatggtatgaacgttgcaaactagacatcgtgcctgatcctttgatctgtagatcagagaaaaacttgcatattgttataggataatttacaacctgttagtcttaagaataaactgaaaggaagatgtaatacttatctgcccttggtagaacagaacagttacacatcgttaactgtgtttgattgttgggtaggtgatggacactaggttctctgcagctgctctgagactccccaactcactccccatcctgccccccagttagggttatttcactaagcatcagagccagaggataggggaggggagctaatgtgtaaggaaatgggtgatgttcttcttccttcattcttccttcatggtttggggaacacttactccttattccctagatattggggacaatttagccaatacatttacaagtgagagcagagatatactaaagatatgctaggaaggcactaataattcttagactcctataaagaatgagcaagatccttctggttgaaaaatactgggtaaaaatgaaatcgtttttcaaagccattcatttaagaaatgttacttcaggagcctactaccatgcttacagctgattattaggtatatgttaagttctctttaggaaagagaggtcacaggaagctgaagatggacttctgtgaagtaaaatatgaagagtggttttggacattgacctagaatggaatagcactaaactctggtggaattgtaattgtggcaacttatgcttattatagcctaggtaaatattgaccaatatgaatggataagatagctgcattttgcccaagtttatgatacagaatatgaatcatatgagtaatgaattgaattcattcttaaggattgattattagtttgggaggcagtttggcatggtgaaaggtgagcacaccttagttataattaactggaaggttggttaacatgacttgaagcaggcaggattcacctatggagaacagagttctatttggttgtatatagttgaatatatatgagtaaataacatgagccaagtttgggatatacaggaagtgagaagggagtagagatagtttggttgggggatataaattgtagtacaggagagtgctgataagaagccatggtaaaaatgaccaaagatcaaagatgcaagttatcagtcctgctttgttgatagtcagttgcttaaaggttgttttttttttgtggtaggttttttttttttttttttttggataggtatagcagaggttggggggagggtcacatatcaaggtggtcaagtgttacttatgtaaacagttgggtaaaatagtttgagggcctgttctgttgtttagacacttggttttttactcagtcattgtggttttcaaatcttaatttgtgtggtgtttgctcctaagaatacttcttcaaaagactataaatgagtctttgcgtgcatattgaatcttagatcccaagaccaaaatacttttttattggctctgtttgcataaacactcttcaccatttatatgtttgtgctactgtactttcatatattttcacacaaactattggactatttataaaacaagacataaagatgtaacagagaaggcaggaaatacttgacatttgtgtgccatatcttactctgtgcttcctgtcagttaaaccacgatgagaggaacagagacacagatgtacaattgctgctttaatttgccactggggagaccagttaagcataaagctagttttattaaacttttgtcacttgttgattcgagggacgttgtaggcttgtttggtattatatggattgtatgcatcatgtggtggcaattagatgtttgctacagcacctaataggaacatatatcttttacatatttaaaaggtatttacttttgtgacattttttaggccataaaaaaattggcatttgaattcatatatttgatataaattcactatgaaatattaggctaatattttgatcttgaaattttagtatctaattattaacttttatgtattagtatatcaggattctgtaaaactttcaaagcattttgtagtttaccaagtaaattcttacttggtacaacttcaagatgaaagatgaaatggaaagttatagaggttgacttatctaagaaaatacagttagtaaatgatgttcaactacaacttgaatgcaggtgttctgatggtagatcctgtatccctaatgttagggaaaaggtttgttttcattaaattcctattctacctgtttctcagtgattttaacttttagggtcacctttgcttattcttcccagaatatcccccaccccctttcctttcatgttctctctccttggaaaaaaacagatgtgggctatttctttagaaataagtaacatgttacttccttatgaagttttttcaggttctcacaggtatttacccctctctattcattctgtcatcttttggttgacttgtttatttacattgttttgtaattatctgtttacattgtttctttttagatgttgaaccactttgggacaaggatcatatcttatttatctttatttttgtatacccagtaaatggcatatagtagatttcataaatacttgttgggggaataaatacatgcctgatatttattttcttttttctagaatcataaactggttaaagaactataatgtgaatcttttctacaggttgcctttatggtttatttctaagaaataattttattgtaaaagttattttgtacttcagctccacccacccccagtttgtttttgctgtttatggaaatgagatatcttagtgaaattattagtgttttcatcctagttaaaagtggagataacatattggtccattaaaaaatgtagctgaagagcttaattattttagctcgctaagcatcaaaaatctcttacttttggcttcaatctggaaaaaatgtctagccattcattgtggtcctgatatctccactgaataaatggaaataataattctctttattactttttgcttctccctgtattattttctgttgtcaccaagttttttgtgcctcagtgattggagggttataaattgcagtcgtcttgtcaacagagcaataattttcacaaataggactttagcttagatctggccattctaggaatgtcttataaagtttatatattaacagtttttccagccaaaaattgatagaagttactatgtctttttaaacaataaatctaaatgatcaaagtcaaatttaaggatttaatttttaagattgaaggaaaaattatgaagctatatgaatttaatttttaaggagttttagaagaaccaaatagttattttgtttattaaaacttaggtagacatgtggaaaatagtttatagggtttttgagtgtccttttacatgtcagacctcccttttttgtgctctttgttggggggtgttgatgtatttctgagtttggatcagaaaaatacatatatgtacgtcactttgacaatagtcagtgaagcttagcttaccaccagttggttctgggaagcaagtacatgcatcatgtgaaattctatagaatgctaaaacaaacgtatgaaaacactaatcttttactgtttaatgaagaattttagtaagtaaatattaagaaaataaaaggtcctttgatcttgacctagtttgactttttaatatacactttacttaatattcttttaaactgtgtttattaatatatagaaaaatttattatatgtcttttgttttcaagtagcttataatcttaagagatgggacatagtaaataattactgaattacatgggagaatgaactttgcccacttctgctatagcatacatattactatgatttgcatttgccttagttgatagattgtaagcgcctgtagggaaagtcttcttagctacttgttgctttcctacccttctcccttacccacaagtgtctggcagataggtccctaaagagtgcttgtccaaaagaatatagacgacactgatttatttatttatttatttttttgagatgggacttgcctttttttttttttttttaaggtaaggtcttgctctgtggagtgcaagtggctctaacctcagcctccgaagtagctgggaccaccagctcatgccaccatgcccatctaatttttaatttgtgttgagatgggttctcgccatgttgctcaggctggtctcgaattcttggcctcaaatgatccacccactttggcctcccaaagtgctgggattacaggcatgagccactgcacctcgccctgatatgatttctgcaggccatctactattaaaatataggaaaagacaatataggaagaattatttcttcttctccaggtatttctatttataaaggggatgtttttaaaaatcccagtacacagtgtcacatttcagttggctcaaagtcaaaattaaatcaaaatgaaggcgttgaggttacccctaagtaaatcagctttacctggaacagcctccttttggatttatctgtacctatttcccccccagattttcccttcccctcaccttatatactcacagatcgtctctgaaaggtaaaaaaacttctccccacaactcttagtcccccatttactgtaggagacgtcacattctctgtgtccagttgtcaggggttggattgtaactaggagttagatattgaacgagagagacagaagtttctttcatgggttttaagataacagcctatgttgcctgacaatccccatttttttttttctttgaaacaaggtcttgctgttttgccctgcttggagtaagtggctgtctatagttgtgatcacagtgcacggcaaccttgaactgttgggctggagtgatcttcctgcttcagccccctgctatgggagcgtgccactgcatctggctttacatttttaaagcagaatattttgaggggaaacagaatgttgtgattaagatcactagattctaagccctatgagggcacaaattttggtcggtttgttcactgctgtattcccagcacttagaacagggtctctcacgttgtatgtctgttcttatgccaaccacgctattttggttattatagctttatattctattttgaagacttgtagtgtggtgcttccagctttgttatttgctatttgagatcttttgtggttccacaaaatatggatgtggttctctttttaaaaaaaagatagatggagtcttgctatgttgcctgggttggtctcaaactcctgggctcaagtgatcctcccatcttggcatctcaaggtgttgggattacaagcatgagccaccatgcccagccttcatataaataataattaaaaaaaaatgttggccaggcacagtggctcacgcctgtaatcccagcactttgggaggccgaggcaggtggatcatgagatcatgagttcaagaccagcctggccaacatggtgaaaccccatctctactaaaaatacaaaaattagacaggcgtggtggtgggcacctgtaatcccagctagttgggaggctgaggcaggagaatcgcttgaacccgggaggtggaggttgcagtgagccgagactacaccattgcactctggcctgggcgacagagtgagactctgtctcagaaaaaaaaaaaaaagtgtttttcctatttctgtgaagaatgtcattggtatgttgatacagattgcattgaatctgtagatttctttgcgttgtatctaattatttattttatgatttatttttatcatctttcctaatctccttgaggacgtgtcagatttttgtatctatgcagagatatcagtagttattagagatgtttaaggattaaataaaaagcagtatactgtacatgttttactttgtaaaccataaagaacttattagacattaggtattgctagtaaataataatataaataaaccttattgtgatattgtacaattcctggatgtgtctttatagtaaagtatttttttaaatctagtaagtgcccattacatctactgagacaactttgaattcttgaactttccaagagtacaacaaagcgataaagcagaaaacacctctgataaagacccaggttcggcccagtgtggtggctcacgcctgtaatcccagcaatttgggaggccgaggcaagcggatcaattaaggtcaggagttcaagaccagcctggccaatgtggcgaaaccccgtctctgctaaaaatacaaaaattagcccggtgtggtggcgtgcctgtagttccagctactccagaggctgaggcagcgggagaattgctggagataatgacactgtgctttagcctgccaaacagagtgagactctgtctcaaaaaaaaaaaaaaaaaaaaaaaaaaaaaaagccaggttcaatgcagcctcatttggtcaactaattatttttacaaaagcatcttctgaatgtcaccttgtaagaaaatgaagattttgtgaatgctggtgatagcagtctgtatttcagtgacgaagaaaggtggttctgttatttatatcacatatttcttcattggataactaagtcagcatcatctattcaaaatatttaatactgagaagatatagtcatccaaagatgcaacagttcatatatttcaaagttacactggtgttcaagtgaatgatgggcagttttgatgttcagttgaataataagaaggattatgtggtaattagtcatacgttttcgaaaatcttattttcctatttctcccctcttccaattcttaggtgaagaacaaaaacatggagtaaattaggtgatttaaagagttttgccacaccctgagcagaataaaaagcactgttgagaatctctattttaagtaattaatgaagaatttaaggagggcagtatacacattggtgatgcgaagttttcaatgtagcagtcaagctgtggaatgtctgtttaaactgtcctcatcgtttttggatggtggttgccacatcccacttacatgacttgcattgggctttatagtcatcgaccaccatctattgttgcaacccagtttgataacctccagcaactttttttacttcttctcaaatcatgcctaaattctactgcctgactttctatttcccattgtgaactcttagctcttatcaggctgttaactatctctaaactttggtcatttttgagtctctgcattcttttgtgtcggcattcacgtacgcatacacgcacagacacaatatattttactatcttttcctttcccctttagtctctccaactcctaccttccttctgaggttcagtttagttcccacattatctgtgaagtgttttctttacctgtttgaccatctcgtcttctaaaatactgcatttatgcatttagttgcttctctcggtcttgttgcaaaaaacaagtttcatgggaacaagggccatgcattatctttatattttccacagtgctgagcctaagggaaattcaataaatacttaacaacattttaccacgaactccatcaataatagcacaggtgcctctaaaattagatatttgggatcttttgattagttctggatgcatcaaataagcataactaaactattctttttttgtttgtttttgagacggagtcttgctcagtcgcccgggctgaagtgcctcagctttctgagtacctgtgactacatgtgtgcaccaccatgcccagctaatttttgtattttttagtagagataggatttcatcacgttggccaggctggtcttgaactcctggtctcaagtgatctgcctgccttggcctccataaaacagtttcctattagagaaaacctaatgccaggatatttgatgcactttagttaatagtaactgaaatggattcaactgatttaaaaattgattgagaaattatattatgaaagatgaaagtctaaatctttaattgttctgtatatgttttacttattaatggtatttaaagtttgcttctatctaagatttgtacaatagtaaaatataaagttaatgtataatttataaataccacatacaggcatacatcagttaatgactgggatacattctgagaaatggatcattaggtgatttcatccttttgcaaaaaatcacagaatgtacctacacaaacctagatggtatagcctactacacacctaggctatatggtatagcctgttctcctaggccacaaacctgtacagtatgttactgtactgaatagtataggtaattttaacacaatggcaagtatttgtgtgtttaaacaaacatagaaaaggtgcagtaaaaacatggggactactgttgtatatctgcttcattgttcaccagaatgttgttatgtggcaaatgactgtatatatcttacagtactaagcccatggccttccatattttcatttctcatcttgtggttttgctgcttcttttgttttgtttttttgagacagggtctctctgtcttccaggctggagtacagtgatgctatctcagctaactgcaacctccaccttttgggctgaagtgatcctcccgcctcaacctcacgagtaagctgagactgcaggctccaccacacccagcgaatttatttatttttgtagagatgaggtttcacctttttgcccaggctggtctcaaactcctggcctcaagtgatctgaccacctcggcctcccaaagtgctgggattatgtgcatgagccactgcgcctggcctgcttcttgttttttgggttcatttgagtttagaagcttagatgattgccagacagttacaaagatgattgtaggaagaatctcattttaaagatcctgacatgaaacatcagaactctttgatgatatccaagctgacttagaatcgttttatgtaatttaaagaagaaaagaggatattgagtgtggtggctcacacctgtaatcccagcacttgggaggccaaggtgggaggaatgcttgagcctgggaatttgagaccagcctgggcaacatatcaagactccatctcttaaaaaaaaagaaaaaagatggccgggtgcagtggctcacacctgtaattccagcactttgggaggccaaggtgggtggatcacaaggtaaggagtttgagaccagcctggccaatattgtgaaaccctgtctgtactaaaaatacaaaaattagcctggcgtggtggcgggtgcctgtagtcccagctactcgggaggcagaggcagaagaatcgcttgaacctaggaggtggaggttgcagtgagccgagattgcaccactgcactccagcctgggcaacagagtgagactccgtctcaaaagaaaaaaaaagattaaaataataaatgaagaagaaaagaggtagactgtgaaaacagatcattcagggttttttttcactcacacagggagcaggaagttttgtgcacaaggaatcataaagtctttcaaatgtgttggtaacttgggaaaagatggaaatgtttatttccctggagattatgtccttaaacctggttgcactgtgacttgaaagaggatcctaaaatgtcacaggaacaaaaggttgtgattgtcagagagtagttggaaaggtctggattcggtggcagtgagtacagacagaaggcctggaaagaggtagtatatattgggttcttggtgagattaaggcagggctgacttcggcttcttcaatagtgggatggggaagttggggaactataaaatgcagaactgctggattgttgtttttgagatgatagtgaagagtattaagattgtgttggagctatagtttaaaaaaaaaaaagactttattttttagagccattttagattcacagtaaaattgagaggaaagtacagatttcccatatacctcctgcccctgcacatgcatagcctccccgttatcagcctctcgctaatcacctgcaccagagcggtgcacttgttacagttgatgaacctacactgacactttgtcacttgaagttcatagtttacattagggttcacttatggtggtgtacattttatgggtttgggcaaatgtcacttagtaataagcatttaagtttccacatgtctttttgtggcttgatagcttatttctctttagtgctgaataatatttcattatgtggatgcactacagtttattcacctactgaaggacatcttcgttgcttacaagttttggcaattatgaataaagctgctgtaaacatccatgtgcaggttttgtgtggacataagtttttacttcctttgggtaaataccaaggagcacagctctatggtgtaagagtatgtttagttttgtaagaaactgccaaactgtcttccaaagtgtaccattttgcattcctaccagcagtgaatgagaattcctattgttccacatccttgcctgcttttggtgttgtcagtgttctggattttggccattctaataggtttgtagtgacacctcattgtcattttagtttgcatttccccagtgacatatggtgtggggcttcttttcatatgctaatctgtatatcttctttgctgaggtgtctgttaaggtctttggcccattttaaaatcaggctattttctctgagttttgagaggtccttgcatattttagataacagtcctttaatctgtggtttgtcttttcattctcttgacattgtctttcacagagcaaaatttttaattttaatgaagtccagcttatcaattcttcctttgataaatcctgcatttggtatctataaaaagtcatcaccaaacccacatgcatctagatttttctcctatgctatgttctaggagttttattgtttcctattttccatttaggtttgcgatccattttgagttaatatctgggaagggtataaggtctgtgtctagattcttttttttttttttaatgtggatatccagtttttctaccactgttggttgaaaaaactcttttctttattgtattgcctttgtccttgacaaagatggttgactatatttatgtggtgccattaaccgtgctctctattctgttccattgatctattttgttctttcaccagtacctcactgtcttgattactataggttataggtgtatttttaagctcaatccatagaatatttccgttcacttctccagtctaggtattcagacatcctgtcttacaaatctgactaccatttcctcacaccttccacatcatgaggagctattttagccttgttaatacatttggagttttgcctgtaggtgatggaagccattaattgtcagagaagtaagttgatcatattttcacttttggtaaatgactcctactccaggcttaagagccactggagtggggctagaatagaggtagtaagggccgatcaaataaatatatgaaagagcatttcacctaataatgagcatgaagtgatttagatgacctttaaatcttgctttcagttgttggtgtgcctccgtgtaagagtgaaacttcttataacagaatacagtttctaccagaagagagttatgctgtgtgggaattggaggtgggggaggcgtgtcatgtagcaaaatctcctggggaactttgaaacaacatatccctggcttttcacccccaatcagtgccagcatgaaacagttactaatgggaatctgctgtattctcagatgggggaaccattgcactagggcatgtcttttctaagaaaatggaagtattaactgggagaataaagggtcacagaaatgaaacagtttacttgcaagttaaatcttgtttgttggagagagaaatttttttaactgcctgaacaggttttgctgataaagacgttttagcatgtttatgttttctttttaatgaacagaattaaaacagtatctcataactgttagatatttcgcttgtttatttctttctttttgagactgagtcttgctctgttgcccaggctggagggcagtggtgcgatctcagcttactgcaatttccacctcctgggttcaagtgattctcgtgcctcggcctccaagtacctgggattacaggcacccccccaccatgcctaggtaatttttgtatttttagtagagacgaggtttcaccatgtaggccaggctggtcttgaactcctgacctcaagtgatctgccctcttgggcttcccagagtcctgggattacaggcatgagccactgcacctggctgatatttctcttttgattttgaattctctttgttttcagaacatgctcaaaaaaagagttaaacttgagaccacaggtatggacaggtctaggtattcagtctgtttggctgttctgcagggtgctataaatgctaccctggtatcagtgtattctgataccaggttagtccaagtggccaatgatgggaagtgaagaactatgtgaaagaactggaatttcaggtttgggtagtgagtaattgtggccctgccttcagagtcctggaacttttcacctggttgtcagcaaaaaggcaaacacatagaaaagtcagtctgtttagtttgatcatattgattttttttttttattattagcatggttgaagctaaggtgaccttgatcaagttgccaaaacctgtttcaggtttgcttaagtcaccagaagtttgattgagacatcctatacaaaaaaaaaatcgatttgtgctttatttacataaaaataaaactatacttttgataacgtcctgggcacttccctctgcttactccccctcaattaaaaaatgcctaatttaaattaaagaacccggccaggtgcagtgtttcatgcctataatcccagcactttgggaggcctagacgggaggattgcttgagctcagaagtttgagatcagcctcaacaagatgatgagaccccttctctacaaaagaaattataaaaaattagtcaggtgtggtagtacacacctatagccccagctactcaggaggctgaagcgggaggatcacttgaggccaggagtttgaggccatagtgagcaaggatcatgccactgccctccagcctgggcaacaacgagaccctgtctctaaaaaataaataaaaactagttcctcgcccgctgggtgcttaagttgggcggatagtagcaaacgggctccgctagaggacagagccgcccagccccgctccccccagacccatcggtgcactgcccacacctgcaggcaactggctaattgggtcttgtagctgaaatgtgaaaaaggcagcagtcccaaaatgaaggaacacctgctgtgtctcaagcgcctggaaaccagaggcccaacaacatctgttgcttttgttggtgctgttgttgcagctgctcctgcctcactgttaggaatgaagaaaggggaaaatgcaggaagaaccacacacactacaaaaatggagagtatccaggtcctagaggaatgccaaaaccccactgcagaggaagtcttgccctggtctcaaaattttgacaagatgatgaaggccccagcaggaagaaaccttttcagagagttcctctgaacagaatacaacaaagagaacctacttttctggattgcctgtgaagacttaaagaaagaacagaacaaaaaagtaatcaaagaaaagagaaaaggctagaatgatatatgaagattacatttctgtactatcaccaaaagaggtcagtcttgattctcgagctagagaattcttgagttagagaggtgatcaacagaaatttgttggctcctaatcctcacatgtatagttctctccagccccaagtaacatcttttcagatgaattccaggggatgttcaagactttgactctaatgaaaacactacaaaaggaaaatgttgccctaactgatagaaggtcccagtttgggaattgattttattcctatgataaaagctctaagatgagtagggaaaaggaacactatcaagcattgatgacaataaccaaatgtaatatttttaaatatgtcatatgtgcaatgtgaaattcattcttccttcattatttctcatattaaatctcatttcagaaattttagaattttaaaactgttgacttatacctaactgctatcactgcataacagcttttaaacagttagaaataaacattttagaataataaacagattgtgtttctatcctaagcttggatacatttcctttctaaagatctagctcttattgctgtattaaaagaatgccacatacaatgcttactaatggaaatgtgtgttcacagatgcacttagggagcgtagtgtaaaaacatcaggaacttaaaattacaaatttgatttcaagttacatttctgtctcatgcgactttgggcaaatcgtttatcttctctgagttcattttctcatctgcaaatgacaaataaaataattatcaggatggctatgagcattaaataaacgtggaaagaataaaatgtgacattattttatcagagttcttcaacacaataattgttattttatgcttgtattaaatgtcattttaatgcactttcccctatttttttccaaaacatacaataaacatctgatttagctattcatcagaacatacaatcatattttaagatggaacactatatcaatgttattgctttgctcaataatgtgatcccaaatcactacttgcagttcaccatcacctcaaatctatagaaatgtttctttcaatgacatacatagatagatagatatacaattgtaggttaaaattaaagtttaaataagagaagtcatttgaaaattttatttccaaaggaaataaaacaacattcccaaggacagaaataatatcaagttatttgctaaatatataaatgagttataggcctaagactaagatataagagattgacaattagaaaacacttttcaatattaaggtagtatgattttctttaacaattttacaatgaaaataaaaacttaataaaaggtggtaacgggccaggcatggtggctcacacctgtaaccccagcactttgggagactaaggcgagagaatcacttgagcccaggagttccagatctgtctttgcaacaaagtgagaccctgactctaagaaaaaataaaaatgtttacaataaaagtaaaatttaaaatagtaatgtgtccatgaaaactttaattttagagtagttttatatttacagaaaaactgtaaatagaaaggtcccttacagacctatgggacatctgtcaaaattaataaaccagtattggtcattaagttcatactttattcagatttccttagtttttaacctgatgtccctttcctgtcccaggatcccaccacattacatttagttgtcatgtttccttaggcttctcttagttgtgacagttctgaaagcttccttgtttttgatgacagttttgagaaataaactggtatttcgtggaatgtccctctgtggagatttgtctgatgttttcctcatgactagacatgggtttttggtttttggaagaacacaaaggtaaagtgccatgcttatcacatgatatcaaaggtatatgccatcatcaggactcttcttagttgtgacagtctctcaaactttaggcttctcttagctgttgatgttaaccttgatcacttagctgagttagcatctattatgtttctccactgtaaagtaacacattttttttttttttttttttgagacagagtctcgctctgtcaccaggctggagtgcagtggtgcgatctcagctcactgcaccctccgtctcccgggttcaagcaattctgccccagcctcccgagtagctgggactacaggcacacaccaccaagcccggctaatttttgtatttttagtagagacgggatttcactatgttgcccaggctggtcttgaactcctgagctcaggcattccacctacctcagcctccaaagtgctgggattacaggtgtgagccactgcacctggccaaagtaatatatttttaaagagattatattgaaggtaaaatttctggacatttacactgagctaaacaaattctgagcagattcttcaaccctgatattaggttccattaagtgattactaatacatgctataaagaaaatacagtaaagtagaaaaataaaagtccaaaagtcttatcctgaatattcacctaatagaggcgaaagtgaatttttcccttgaactatctgggtaaataattacaataatcctccatatactttcaatattaaatatcttagtcttactcattgtcataagaggtaacttaaactggtagttttgcttagtgcatttctatattgccctccactagtcaatgaacactgaatattgaaataatgtaaaagacctgatgtatttcctaccagctttaaccaatttgtcataaatatgtttcttgtgtatgatttttgaatgtttgctaaataatgtgtttggttttgtaaaattatgtatcgaatgtgtataaatttttactaccatgttcatcatacttaatctataaccatatattgtactccaccaatgtttattagtggacaataaagaagttttaaatgcatgaatacaacttaagagacaccacacttggttattttgcaatgccagaataacagtggatactcaataaattgaatagttaatccagattatgtttcctccaatttaagcttttctggttttttaaattcccccttcctagaatcagttttatcattttacctatgtacaataatatatttctggaaaatgctagaattttcaccatgtagtagaatttgagcacgacaataatgtaaaaaaattcagaagtctcaaactaggtagctttctttgagttttcaaagtaaatcaagatagagctgttttcattttactatattgtggaaatctatggatgttgtgtaaaatgcatgtgcattacactgacttaaaatgttttgaattaataaagaattcaacaataaaaaaattaattaaaaaataaaagaatgcttaattttaagtagctatcttgcatacctacctaaaatatattcatagtaaatacatggtacctgtttagattgcaaaaacatagttttaaactttctctcaactttcttaaattcgttgaatatttgaaaaaatttaaatgaacagttggggtatagaaacattttctttttcaattatgagaacactgagtgcaatgaaatgatttgtttgccttgtgacattaacttgtgttttttcccttcaactttgtgtgtagagtacctggtttagagaaagcaggagctgagaaagtatgactattcttttttgggaaagttcaaatctggtttcttaactatacctacattttgggatgtttctttattgttttttccatattcgcatattttaatgtaaattctagcaataatactgtatttaaaatagctagaaaggctaggcgtagtggctcatgcctgtaatcccagcactttgggaggctcaggtgggcagatcacttgagctcaggagttcgaggccaccttgggcaacatagtgagacactgtctctactgaaattacaaaaatcagtcagacgtggtggtgcacacctgtagtcccagctacttgggaggctgaggcatgagaatcacttgaacccaggcggaggttgcagtgagctgagatcgtgccactgcactccagcctaagcgatagagcaagactctgtctcaaaaagaaaaaaaagaactagagagaaaaatatcagtacaaatctattttgaagtattttaatgagttactaaattgtggtagccttctaaaaaggcttatacatgtttcctttttactttttaggctgagtgaaaatgtaaggcaagatgatatgatatagtaaacttgggagataataatagtaaaactctaagacttaaagtagtaaatagggaaatctacaaaccctctgcaccagttgtttcagttaaaaatatggttgaaaatgatttatcccaaatatcaagagattgcataatatataaaagcattttaattgacagttgtactggggtatggtaaggtacttttgctaggtatttgtctaggggatttcttatttttccagatattctgctaaggaaaaaatattaatgaagttctgttaatatagatataaaggtaccagtaggaaatctgggcttttcttgctttctttgccactaactggctgtgtgtccttggacacatcagaatgctctaggcctaaattcttttttcttttcagtgaatatgttgtcctaggtaatccttagatctttttcagctctaatatcctgtgatttcacacttttagattgagaatgggcaaactttggaagactgtgtgcagtttatcttcataccactgacttcatttctgctgggagctaatatagagccttctaccatgttataatagaaaacagattttttaaaagaccaaactatggtcaatcacacaggaattcagtcattacagattatgggtttattgcttgcttctcatttctacttggtataacttcacttcttttctctcactttcttactctgttttctttcatttctgttatattttttcaatggtttttccgaatattgcatttcttaccatgactatctgtatatactgaaaagagcccttttattaggttaccacatcttgtgaaagttctttctgttcagttacttggtgtctagagttactgtagcattccagttttttagatactgccaacctacaaacatgccatatgtacataaacagacacagtctgaattacatacttcattagagaagtcattcaaccacgtcattgctttaagctggtatatttcaccttctttatcccagaattgtctgatctaaaacctttttgtttgattgattctctttattaattttctttcttttcttttttttttttttttgagacagagtcttgctctgttgcccaggctagagtatagtggcgtgcctcggcttaccacagcttctgcctcctgggttcaagcaattctcctgcctcagtctcccaagtagctgggattacaggcactcaccaccatgcccagctaattttttttttgtgtttttggtagggacggggtttcaccatgttggtcaggctggtctcgaactcctgacctcaggtaatctacccgcctcggcctcccaaagtgctgggatacaggcgtgagccacggcaccggactatttattaattttcaccataaacagttggtaccatagtaacttaaaaggagagcagtgattttcggccgggtgctgtggctcacgcctgtaatcccagcattttgggaggccgaggcgggtggatcacaaggtcaggagatcgagaccatcctggctaacacggtgaaagcccgtctctactaaaaaatacaaaaaattagccgggcgtggtggcgggcgcctgtagtcccagctactcaggaggctgaggcaggagaatggcgtgaacccgggaggcggagcttgcaatgagccgagatggcgccactgcactccagcctgggcgacagtgagactcccactcaaaaaaaaaaaaaaaaaaagagcaatgattttctaaaaatatatttatgaattcgtgggtttaatatccttgtgtctaaaaacctttctgaaggaatcttaaatttacattcaatcagtgatcaattttgactatcatattttttttagtacctgaaatcttctataataaattaaacaagtagccatttgaagtggttgtagtagctagtagtgtggctgagggttttgtgtttaccatcagtgaagtcattttgtttggaatgaggcataatgggactctgtgttagggaagcttgccagacagagtgaagtcctcgccttgaagcagcaggatttgttaaaaagacgccaaaccttgaagcactggaatagaattacagttttgttgacaatgggctataatgttctttttctggagtctagcaaatagctatggtaatagagacttccagggagtacagaaatgacccttaaggaattattagttacctagcatgcacctgttacatatttcttgcatatacttacagcgctaaagaagctaatgttaattcagtgcatgttatgtgccaagtattctgcacatgcatttttgcatctacacaacagctctaggttttggtattactttacccgttttacagaaggaagagacttgagactgacacctattttatggaaagaggggactgagacaccaagcaagtaacttgtccagtcttctgtcacactgcagaagattggcacccaatcggtctgactccagagcctgttctctgaactgctttgtgttactattttactttaactccaaagcttattttggggatgacaggttaggaaccttgttgctaagtattcctgtggcatgtctccttggagaataagaatatggtcctcacccaattaagagacatctgagccagcctaagattttttattatctggtagatgtctgcctggatgccctctgaaaactgtgcaaataagttgaccgcttatgtctgtgtgatgaagaagtagtttcacttatgtttttccttgttactttataaagactgacactttgaaaaaaacatgtttgagaactattaatacagcagagtgcttcctgactataatagataattaaggatgggtaaatttaaacaagttttaaatttactgaggacctttcaatttgttaggttagaacagaagccttttttctaatccgagtgcccatattttttttccatctaagaccgtatttgaggaattagatgatgcatttagttttggacatgttttttacacactgacttcaaggggcactgatgtagacttgtcttatagtttagtgactggatttggagctcagaagctgaacctagagatggagattttaaaaattttttacatatgcgtttacttaatctgtgttataaactgttatagcagaaaggactttggtggattttagaggcccagctgtatattacagttttagagagagtcctgatttaggaaacaagaattctagttttagttctgttttgcttgtagaccgtgagaacttgaccaccccaatttactaattaaaaatggaatcattgatttagatcttcagtcttgtctgttactgaaaaaattgtaagatacctgggctttgtaatcaaagattataagaatctttgatatctacaggtgctccctctggatcaggtatcagaaaatgtattctcaagaatcaccttgatgcagaagagtatataagtacacaggggagaggaagaggagcaggaaagatgacagagaatcaaagacatgattgagccagtaaaatgcttttctttgcttacacattttcagtttgtggacttctctatagaaataagcaaaagctacatgccagagcaaaagtgtctttttctgctgcaataagtggcttagtgattgtggggagccatttcagttttgatttattactgttagttgttagtatgtataaggtgtgggtatgttggttgcttatcctgattttttagatttctgaaagacaactgttaaagcacagtagcagtgtggaagtgctggtacgaaaaggtacatgacagcagtggaaaagaaagtgaaacttaaatttacctagacgtattcacactggccattggcacaatgtcattttgcatttatgaacaaatgggttttgaaatagccttctggaacctaatcttttacagagaaacttctgtatcagcaaacatcccttgattctggttatgttttcttactctcgtttttcaagcttgtgataatagtttcctctttatcagaagtatatcagttattcttttttaaataaaggatatttgtagaaatagcttaaatatctaatgatatttatttattgaacacagagtctcattctgtaatgcaagctggagtacagtggcaatcatggctcactacggccttgaactcctgggctcaagtgatcctcctgcctcagcctcctgagtagctaggatcacaaatgcacacacaccaacacagccaactaattttttattttttgtaaagacgaggtcttgctatgttgccccggttggtcttgaatgtgtagtctcaagtgactccttccccaccagcctgctaaaatgctggtgttacaggtgtaagccaccatgcctggcctgataagatatttaaaacagtatttgtcatcaatataatcctttttgtcatcactgtgggcacacaggtttgggaggtacagaagaaattttagacaatggttatttccccagaagaggttttgcttcagttgtcttggtgcctggcacattgccttgcaaataattggtactcaaacatgtattcagttgaattaaggggacacagttttcaaatgtaagacaatgtactacaattcatgctaaattggttgtacgggcagtaattgctgtgtttttgaagggagcagtccttgtagtttgaggcatagatgttgggaggctttgtgaaataaatggggcttgagcattgaatggaaaagatgggattgaatgctggcaagtagaagatgggtgtgttgcaggcataggaaataacagaagttgagaaaagaggcaagattgaatagtttgtgtggaggaacataaggcaggtctactacagaggaattgggttggataataatttaaggaaaaaggtattataaataataataagtacaaggccaaatgtatctatctgtgatcaatttaaatcaaaacactttttttttccctcttctagatatggtacattgctcaaaaaccacctgaatgtgctaaaaatactttcccagtgttggagttaaacttcctgttaaaagggagtggatgagagtgggaaatttgctgggttggaatttagtgtagtgagtagaaatatcatctgaattggattcttaattcttattttattttgagttcttgctaggaaaatcacagtcatccatgatgacccctaaagcccaggacacatagggacttggctttacagaaattaggaaaccgattaagtgatttggctgacacatactagctggatttacgttttcagggaaactgattcactagatcagcttcatccccagacttgtctctttaaaattattaggaaattactggccatcctttccttggagtcaacttcttttttaaagtgtttgtaataaaactgtaaatgctaattcaaagaactaatgttatttaatgtgattatttttgtatctttcttttcaggccataatcatttgatgaaaatgtagtaagattgtgataaacacctaaagaattttttccttttgttagtattgataactttttttttaaataggcaaacatctttggcagacattttaaaagcctttgtcccttcgctgtgaaattgttttcactactaagttgcgtttctgtttttctactattgtaaagtgcagttctttgcatgttctaatttgccatgacgtggtcaagtgctgtttccttcctgttgcttgcaagcctatactagagataaggatacatttcagtgcattaaaaaagaagccactgaagacaggcttaagcatggtaatttttaaaacattttacttatcagaagcctttttaaagaacagaaagagtgggctttaatttctgcttatttttaaaagatttaaaaatacttcttactaaactttaaatgtatttgattttaaatccttatataaatcctcttaaaggtgaaaatatatacgttgtgaaattactcattgggtagcagtttctatgtatgtgctttgctgagttggtgaaaagaaggaaattgtttatatatcctttattgcgattacaaccctcattattgctggggttttttgaccttttttttttttttaatattgagtacttttaacagtagtttaactggagagtgggggagagaggcataattttcagtagtgacagatgatcttagcaggagcaaactgttcaaataaaatatgtaacttttaaaaaagagcgtatgtgcattagtcgtgtcgattttatttaaaaacgttaataataaaaaaatgctttagcgatactgccctctgtatcagttattatatcctaagtgggtgattgctttttcataactaatctgagcttttgttttttaggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacaggtatgagattcagagaaaatttcattttaatgactttattatgatttttctattcatatcagaaaattatttcctttaaaagacaatgagagaaactttattgaaagtaaaaatttatagatgaaatatttggaggaaatattatactatgttttaagcaccagttaattcatgaagaataagtcttatccttagctttgatatggtaacaaggaagtaatacctttgggattcagcttgtttttttgtaaaatgagacttaacactaaatgccttaagtaattatttttaagtactttgaaaagttctagagaatatactgccttttaatgtatgtggttaattaatgtttgtaatcatgggctacttcttcaagtagatgagacaacgttagcggtcccataatcatacatcatttcagtccaaagcatgtgactctgaggaagttacttaacttctctagatctagatttcatcatctgcagaatgaggggattgaactgaagaatttctaaatcggctttcagtgaatttatataagatgtgcaaattactgttttcagtacataaaaaagatctaggagatactgagtaaaggatctaagattaattttagtctccttcccccctccccacaacacacacacacacaaaagaactggaacgaggctagagtttcttgggactttacaattaacttcattttaaacaagttatatagggaatgtaagacatgatatgggagaaatagtgtacgtgttggagagactcagacagggtactaggaaaaatattttgagaaccaacctaaagttgatttatcactgaaataagcctaatgctcaacacctaattttaataggccaattataatatgtaatgcctttattctggaaacatagttactacaaataataaaattcttacttttggcagagtgaatttaatgatttttataaaattaaaatttttttagctgtgttgtccattgaagtgacagaacaaaaagtttataaataaacctacaaaaggtgaggatttggattaagttgccttaacagcaggatgagctttgactagggaggataacaggttcagggagagaattgcttagtcttgattaaaaatatattaatagtgatatggatttaatctagagacaatacaaaatatattttaggaagaaaggtgttttgaatttggtttaagacaggatgtttgtgtgtatattaaggtttgaaacagtgtgtttactatgcagccctcttaaatgaaagatgctgtatatagatgctaggcttgatgtggtgaggtttgatctcaggatgtagcagcagaggacaaagccctaagccactcactaatatgctctagttatagtggatttgacactctttggaacatgagagaagtgaattttacattatggtaccatattcatacatgtgtctacatagcctaaaaagagttttgcaaaacaacacttatacacttactatgtatgatatacttagtttgttttgcagaggttatttatgtttttggaaagggagatggtactgttagcttaacatcagcatgtacatatatgtattttcttaagttatttgtttttgtctaacaaaatgaatctatattttgtgcaggtgttataaggattttataagtattaaccatgtaaggtaaatactgatccccattttataatgaggaaattgagatatcaagaggttaagtcactttcctggaatcatacagccagtaaatagtagagccacaatttgaactcagccagtttgattctcactaatgatgttttatatattcttgcaataatgtgtgacaatcttactgtgttataatcagcatcaaaatgtttacaactcttggtgagttttggcgtcttcagtctgtggccatcagcatagcaaatgtaactgctttgcaggagggtagatccagtgctgttggtgatattagcatcttacctaacctggggctctacctccctgtttgcttattaggttaatttgtttttaatggaaaagcaataacgtgccatttgtattaataaaagaagtcacctaataaaaagatacataaaataactagtgaaaaatctctcttcacccttagtcctaatcttgttttccttcccagaagaaactagtattaagtattaatattttgtgtgtaatttttttagaaaaatgtctgaacaaatgaacatacatatatacaaaactgcatacagaggttgcttttaagacacaaatgaagttatgctaaatcttttttgtgtctcatttgtttccactttattataaatatttgtgtgtatgttgattctacatcatttatattttacatcatgagcagcccattatttattttacagttcctgacatggctgttaccagcattttgctatgatgtacaatattgcagtgaacatccttgtttggaaggcagtagatctacctagtagtagcggtggttaagagctcaggtactgaagttgaaatgcctgggttgaatcttggctccgctgcttattatctctgtgactttgggcaagttactcaacctttctgttccttggtttcctcatctgcaaaatggggatgaaaataatagaacctaagttataggattgctgtgagaattaaatgagttgatgtttctaaagcttttagaactatgtctggctcatagctaatatttacggagcactataattttgtcattatgtgtgtgtgtgtgtgtgtagtgtatctttgtacacttatgtgattatatctgtagggttattaaaaacagaattactgagcttactaaaaatataaatacaaatattcttttaaaaggctgtgttacgtggacataaagatggacaagtctgtgttacgtggacataaagagggactactagatgggggaaggaaggaagcaggcaagggttgaaaaactaactattgggtgctgtgcccactgcctgggtgataggatcaatcatacctcaaatctcagcctcacctatgtaacaagcaatatactcatgtaacaaacctgcacatgtaccccctgaatctaaaataaaagttgcggggggtaagaggagctgtattaatttctactactactaatagtgtatttcccaaaccattatcaacagaagtcctttttttttttttggccagtctttagggtggaaatgacattttactattttaatttgtatttccttgactactagtggtgaagtggtttatttgtaaattttatttattttcaattagagttttctttgatttacttattaatatatccttttgcccagtgggaattttttaagtattatggtcactacattagaatcattgatattttctctcagtctagtgttgtcttttaacaatgtgatatcttgtgcgctatagaaattttaaatgtttttaataaaatatgtcaatattacaaattaataatattagttttgggggcttttcttgccttctgcttaggaaagctttattctcttcactcctgtcactcctaaaattagtatatactctctttacattttcttttcttttttgttttttttttgagactgagtcttgcctcgtcacccaggctggagtgccgtggtgtgatcttgactcactgcaacctccacctcccaggttcaagcaattcttctgcctcagcttcccaagtagctgggactacagacacgcaccaccacgcccagctaatttttgtatttttagtaaagacaggctttcaccatgttgcccaggatggtctccatctcttgacctcgggatctgcctgcctcggcctcccaaagtgctgggatttcaggcatgagccaccgcccccggcctacattttcttctagtatctttcatatgtttggctcctcagtccatctgcagtttatttttgtatgatgtgaggtattcatgatttgaagattcttcccccactcccacaaatagtggtgttagcccttcaccatttattgaatgttttatgtttttcacacttaaactgccacctttgttaatactaaattaccatgtgtacaggcttcagttttgaacttcctagtgtattctccttcgttgaactgtttttatattgtgccagtatcacattgttttcattagaatcattttatagatttgatatccgataggatatcctcctccccccaaattggaataggattttgaatgaattttagagttagcttgttaagctacatgaaaaccctgttgggatttttaactttttaaagttaaaaagtatttatgacttttaaaataatgtattctgttttggctgtttataaaatcactgaaggcaccagattagaatatattttttgttttcagttatggtctaggttataaatatatattagtctaaagaaactgacactattaatagggttgccagcattttgatcatcttcccttattcagttcatattttccagaattgcttggcactcttgagtggagatggcaggggtcatggcgggggtgttggaaaggaaatatcaatgctgttgatgctgacaatttaaaactctgttgttgctgtctgttctaaactgggaatatttgtagctgagaatgaagcacttctatgggagagcaaccccatcagtattgaatgcaatatccctttatgcaatggtgctttggtttgatcttaacaagcgtgttagcatggtgaatgtatgagaagaagaagcaagcagaagtctatggatacaagtttctaaagagaaggaaacctatttacttaaatgttccaggagttaatttaatgaagaacagccggcatagtttaatgctttttataattttgatatattatatgaaaaaaacactgtatttttttttcagtcattggttttaaaagtagaatttctggcaaatcatatttgtgtttaatagacttaagtcactagagagaagtttggtgacatggaaaaaatgaacatgtggaacaacaaatttttatagaatctcatcacaatataagaaggtagtcttagcactttcctctctagggtgtaaattggcttcctccgactgctaattcctggaggttaaagagtaacagtgccgggtgcagtggctcatgcctgtaatcccagcactttgggaggccaaagcgggtggtgtatatcacatgagagcaggagttcgagaccagcctgaccaacatggagaaaccccatctctactaaaaatacaaaattagcaggcgtgatggtgcatgcctgtaatcccagctattcaggaggctgaggcaagagaattgcttgaacccggtaggtggaggttgcagtgagctgagatcgcaccattgcactccagcctgggcaacaagagtgaaactccgtctaaaacaaaacaaaacaaaaagaataacagtgccttgctgtcttttatacaagctgcccagtgattttttcatgcagtgtttgggaaacactattcaatgtaacacagataaatgcaaagtgctgtggatactgagaatggagccattgactgcactgcaactttgggaatgcttcaccatggaagttgaactggatctcaaaggaggatctagtttatctgacagatgaagaagaggaggtgttctagagcagtagagtgtaccaaaacttttaacagattctcttgacttcattatcagtccaaacatcttaatttatggttagaaacttttcacagtgtgcctgtttcacactatgtaattttccagaatgctttcctgcttccccactgtttgctcagaaatgatctccaacattcatacctgttgcatatttaagtctaataatctttcaagattttagaacaaagcatactttttccaggaactcatcctaaaataattccttcaagaattaacaactttattctgttatttctatgttgcttattatcagtctcacgtttgccatcttaaattttcatatacacattactaattttttcaaatgtgttaaattatttgaagtaagacattgtcttttttccccttaatattaccaaagcctttaatatcactgagtcctcttaaagattttttttctttttaaaatctgttgaataagtgatctcttctataaaataggtaaaacttacctgttgctagatgatctgggatatataagtgttcagttatggttcttatcatatcagagcatctctgaataatgagagggtgataccttgcccacagctgtcttgaccacagaatacattttcccaggacctattgtccacattctcatttggtgcagggacaatgtagccatgtcactacagttctaagaccagaaacagatgctcatggaatcttttttctgaagtatttggaactgatctgttgtacatttagtggaaaacacttcaaataacttttaaagattgtcattgaaattgtaaataaataaaatgtgttaaatgacagttgttcacatttattaaatctggttgtaggcatgtggatgcttttgtttttccctctactctgttgtatattaaaattgtttttcaaaaaaaaaatcagagaaactaacattcatatagaactttcctttttccttatatgctatttcctgtatgtaagaggataagtcacaccaacctgccatttttcaactggaatggcaagattctgttaggtcagagattaggtgtacctcataaagtaaggtagaaggaatgagttgatagtgtttaatgtgtaacttattcagcgccagtgatgagaagggcaggaagctggagtgttgctactgatctgtacatggacttagtggatcctctgttatttaccttaaaattccaggttctatctgctttggttgccttctttttaaatcttgtcatatcaaacttaagaaatccattaaaagcttggccatttgtgaaactaatatacagaggttgcttgtttatttttggtacacttggaaaagtctttatcaaaggagttatgtcttagagtccccagctacaagcctgattgccttctgggggagatctgactttgcataaaggctgaggccctcttcaggttaagtgaaggaacaaccctgcctgtggtctaacatttggcttatctctttgcccattcttggcagcaaggaggctgatagttgttatgaaagaggagtcagtgtggagagtaggaacttattactcttttttgcaaaatcttcctttaactgccccctagccatcccacagaggcccagggataacgtcctgaaaatgaataagatgagatcattgtatagggtagaacatggactagatgggcttcagaaactttcagtggtgaattttagtagctagtgtttagtgagcatcttgccccatgcactgtgctttatagggattatcctatttaattcttacaacaatcctaagaagtaggtgctcctaattctcactacaaaagagtcaagtgaggctcagcgaagggaagcaacttgcctgtaatttcatagctactaagtgataaagctaggaattgtaacccagcctgtgcctttaaccactaattgaataatactagccactgcaacatgtaagtggtgaaaagtagtttaaaatatggaagaattattatatcctgcatttatgattttggcaaaaaagtgttactaattttagctaattagtataattacaggtagatggttcttatgcctggcatacctgtatatgtaccttttaaaaaaacagctttattgcaatgtaattcacataccatataatccatctacttaaagtgtacaaatcaatggttttaagtttatacagaattgtatgtctgtctccataatcaattttaggacatgtttatcaccccaaagggaaatctgtacctgttagcagtcatgacctattcttccccactcttcctagctcctgggaactactaatctactttctgtctctgtatgtttgcctattctggacaattcagttatagtaaatggaatcatagaatatgtgctgtcttgcgactggcttcttttactttggcatcctgttatcaaggttcatctgtgttgtgccatgtatcattactccattctttttattactgaataatattgtatcatatggatataccacattttatttatccattctgtacacattttcaaagaacactttttaaaatgaggtttgtgttggtcagtttcttgtcagaaatagagttggcaacgtcttctcccagaaaatactcaatcacctagaatagccttcctgggtaaaaaaaaaaaaaggaaattagcacctctgttgcttctaaaaataacttaaaaaaatttcccctaacatttgacacctttgatgtgtcttagttttgctatgtgatcttgaaaatttttgtctcctttccatttcagtgaacacatagcacataaaagataggcagttatataaacagttagtgtaactggccttttttaaaaaagagggtcattttcaacatatttagagagtactgatgaaaataattgtttgtgtgtgttttagaaatagtaaccaaaattctcaatattagagcaattcttcttttggaaaattgccaaggaattgttgttagaaatgctacattataatattttgactggtaaaacatttgtaagctgacccatttaacctgttcccactaaatgtgatgttgaaagtactgaagatacgagaccaggaaacttatcagcaggatgatgcgaagattaaagttaggaaagaagcttccctcctaaaaggtgatcttttaggtgacagtttaatgatttattatattttatggttttacatgatttctgcatttgccctattctactttattttgtggcatatgcaaaataaaaacaagaacttttagaacaaaattccattgttctgttggaaaggagctactgggaagcccagctatctgtaatctcctccctcccctttcctacctcaacacacacattcggaaataatgtattatttaaagacttaggtgggagatgattttttaaacagtgattgattagtgtgtgttcagtccactgcccacaactttgacataacatttaatcatgaaaactgatgtttgtcaatcaagagtctgtgtgatatggcattaaaaaaacatcaatttgggagcctggctctagctgtgtaactttagacaagtttttacatatcattgagctttatttctttcacaaaaataacagaattacctcccaaggttatgagcattaaatgcttatgcaatgcatttacctatagcatggtacatggaacagtcctcatattaatgacctgagataaatcaagaaaaagctttaatagctcttgtcttacactggataatctctattatccaactgggtaagtgaggtgatgaaagtgatttttgtgacttgcataccagttatacaaattcattcagatcgttttgttttgttctgttgtcacatttttcctttgataatccagaatggctgtcttgattctagaataagccaataaacttgtgactcaggattttaaaaatctggtggacttatgccgtaagggagcattttcctttaacatttgtttcgacatagtttgccctggcgttgttcagtttttttggagtaccactaatttctcccatacctatgagcaggtagtatgaattttccattctgggagagactctattgtagctaaactgcctgtattcaaggatgccttacctcattttattctttgctgtgtacatattgtataagattcttgtcaaagtccatcttttcatagcagaaattgccctttatgattttttaaaattctttgagttatatggaatctgcatgtttaaaacacttacctgtctggtagtgactactctgatatttattaatctacttagtttgtaagtaaagtaaacatttacatctggttaaaatttactatacccccccccaaaaaaaaactacctgtttgtttacctcataactgattctgtttacatatacccacacatacacaacccaccaatactattaagcttttaatgtggacattccaataagaaaacagatcattctcattgactcttactttttgagatgtatggccaaattgtaatttatcctggctacaaaaagaagaatctaggcaaagactaaagaaagccaattgtcatgacacagttacactaggattagactttgttaaaaaataactccacaaggatttgcaatggaatttcaaacattatcttggggaattctggagaaaagaccattttacttagacctttatgtttttgatggtgctgtgcaagagagaagccaggattttttcagaaacactcaaatactggccagacgcagtggcgcatgcctgcaatcacaacactctgggaagccaaggcagaaagatcgcttgagcccaggagtttgagactagcctgggcaacatagggagaccccgtttctattaaaaaaatagctgggtgttgtggtgcctgcctgtggtcccatctactcaggaggctgaggtgggaagatcacttgagcctgggaggtgggggctgcagtgagttgtgatcttgccactgcactgtagcctgggtgacagagtaagaccctgtctcaaaaaaaaagaaaaagaaaacaaacttgtttcagctgtaggtctaatacagtgatcatttagaagataactatcaatctatatataatatacattttttatccaagcgttaattgaaatgagactttcattatgacttagtaataaattctaagtagtttatctataggatcctgtactggtagtggttaaacttgtggactctagagtcagattgcttgggttcagatttcagctttttctggctgggtgactagtatgtgtcaataatatatagcctagtgttgtggggattgagtggataaagccatatgacgtccttaacatagtagctgcttccgtcatcactacattaggggtaccactgtattctattttatagtttattatattgaaagactcccaaagacagagactagagaacactttttacacagcgctgtagtgagtttttttagttgaaagtacattgaccagacacttgaatccttttttccccttaattaaaccacatgtttatctatgtgacatttatagcaggtacataatccataaaaatgaggatattagagaacaaacgccattgggaagtgtaaggaggctaatagagacaagtatgttttcttggcacggaggttaacatccaaacatacttggcacgaagattaacatccaaagcagcatctttgcatgttaacctccatgccaagaaaacattacttgccttagtcttgaatacaatgtaaagataacactgcctaacatcttgtacagctctttgtagtttacagtcttttctgtatacacttggattcttacaagtcactgtatgatagagatcgtatttttcccgttttctatagtataatgttatcttgaatttattactaagtgactaggagacctgtattagaatctttcacctgtgatagatttgtagggcaagcttacaaaggcatccagagtaattactgttcaaagtaacctagctgaattactaaataagtctagattccagttctgatttagtaacactcttttagagtatcaactagaggataatttgtcttttagctgttcgttaatttcctcattaatcttgacgacacttgatttgtttgtttatattttaagggatgatgggataatgcagaacagtataaggatttgctatatcatttgagctaatgcattgaaatattttaagtttttggaatggtaataatgtagatttttttttctttgaaaatgtgccagtaacaatgaaagaaactgaggaaattgccagggaacaatccccacatgcacaaaacctgtaggcccagatagtttcgtgagtgagtgattttcaactttaccagcccgggcaacatagtaagactctatctctacaaaaaaatttaaaaattagcatgatgtggcagcctgtacctctgatctcagctgcttgggaagcggaagtgggaggatctcaagcctaggaggtagaggctacagtgagccatgattgtgccactgcactctagcctggagtctcactgacagagaccctgtcttaaaaatttaatgaactaatttaaacagtttcggttcagagagagtttcctaattcagttttacaaaactgacataacactgataccaaaacctggcagaatttgcatacacacatataaacactaggctaatctaaaaatttatgtgctgtttaataattaatgaacacttattgtctcttacccttgccaggccctgcacgtgatatgcattttatattttcatctttaaaagcctgtatggtgtgacaactcttgttatccccattttacaagtaaggaaaacatgtataatgaggaatctcaaagaggttgaaggaatgcatgttacccagaaacacacaactgtaaagtgccacttgtattgaaattgactgacctgagagagcccaaactcttaaccattatgctagggtataagagagaaaaagaaccataaaggaaaaagagaatatggaagactattaagtaaattgtcttttatactgattatatctaggattagtgcgattttttactttttcccaaatacatttatgtataacatttttaagaactagactcatgtactacacctgtagtcagtaaaactatgatgttcttataatttagaccaatgtgttgagcagtgggtactacaactacataaacttttctgcctggttgctaaaactgctttttattttataataaggaataggtccctgggcgcaatggctcatgtctgtaatcccagcactttgggaggctgaggcagatggactgcttaagcccaggagtttgagaccagcctgggcaacatgacaaaaccccatctctacaaaaaacacaaaaattagctgggtgtggtggcacatgcctgttctcccagctattcatgtcgctgaggtggaaagattgcttgagccccagaggtcaaggctgcaatgagctgtgattgtgccactgtactacagcctgggcaacggagcaagaccctgtctaaaaaaaaaaaaaaaaagaatatagaaagtgtttacagggagcttgagttaatcaacagaaatatttggagctgttttagtggcgtatttttttaaagtatgtggagaatttggctatgaagaattcttcacagaaaactttgtactgggctttggaaatctattgtacaatcctagcttgctttgtgtaatacatcaattcctgaaatcatttaaaatacactttggaatttagaaatagtagaaaccattgaggaggggcactatatggaaaggaagcaatgatgtttcatactcttggaatataaatatgttctgtattatttattcccaaagataattattaaaaatgtgccatggggatttgttgaaaggatttcaacttttcactttgttcaccagtcaccctaattttttgtgtgtgtttatccatgtagatgtactgtgtgtagcgatttcctttaattttatcatggtttatatgaggtaatgaaggaataccatcatagtattttgaagatgttttgaagttttgtttctcccatcagatggacctctgctttttaaacttcttattgaagtgtagcattaatataaaaatgtatgtcggtaataagcatgcagtttatgaattttcacaaagtgaacacacatatgtatcaacatttgcttttagttgaagctaaatgttgttgctaagtgtggatggttaaggtttgttcacctatgttttgaaaagactattctcattaaaaataaaacaaaatcaaatcccaacaaagcttaaaggttaaagaaagcaaaagaaataataaataaagcaaaaaataattaataaacaaaaaggacaaggcatggtggctcacacctataatcccagcactttgggaggccgaggcaggagaggattgcttgagcctaggagtttgcgaccagcctgggcaacatagagagacctcatctctacaaaaaaaaaaaaattagccagacatggtggcatacgcctatagtcccagctacttgggagactgaggcaggaggattgcatgagcccaggagttcacagatgcagtgagctgtgatcacgccactgcactccagcgaggcgacagagcaagaccctgtctcaaaaaaataaaaacaaaaccatgcctgtccatgtgagattgtagtaagtcagtttttgagagtgtttatttctatccgtatcaaatattgaagggctttaatcatcaaaacattttatttattgcttactatatgccatgcattatcacaaatgatttatttacacattattcttacaacaattccagaagatactattattcttattttgaatagatgtaggaactaaagcttagagaggctggataacttgcatgagttcaaatacccaggccatggtggagtcctaccttaaataagaacctgagtttttactgttacaccctgttcaccatgtgtgtatgtagtgcatttgctgcatggtaaagtactgtcagatcgtgttgtaatagagtaaggtgctgggtttttgttttttaaatcaaatgtaaaaggaagtgatttcaagaataattcagaagtcctcaaagcagtgtcttcataggataaggctttggggcctcagtctgatttgaaggctgggcacagggatttgtctcaaagatgtgttttcatagcaagtgcagtgtttaatttgtgtgcttattggacaggctttggagtcaggggagctgttgaagactgtgggaggagtaaggcaccagacccctcttggtgttttcttgccttgatgcaaagatgttgcgtgaactactcgaaggtgtgctcattttgcacctgtctttaaaaagtagtgtctgctttggaaaaatgctagagactaaatttaacttgctttttgttttgggaaaatattttgtaggtatttcattttaagctattttagagaggattttgatgggatgtttcacaatcaccatataccagattgagttctgctattagagaaacttggtaaacaagttatatgaaagttcttgtgctttttgatacccaaaaacttgatgaacaaaattattaatgaagttggaataatgattcatggtttctgaaatatccacataggaccttggattgtggtatgtggaacaagcaagcctagttaggggagtcacataatgtcctgcttacattggtcgctttccttctctttttaacttgatggtattgccacatacgtgatcaaccacaagtggaaactatatcgtggacaatgttgaaatttggggaactgtgactctcttctgctaaaacttggtttgaattttattattgctccaaaaatgtttgctgaaattttgctttcaacatatatcctaaatttatctataattaatagaaaggggaaatctctttggagctgttaagaccttcaagaaagttatgaaacaattgaaaattactttatcactgcagtaatttgcttctagatattgaagctttggaaaccctgatctttgatagattttagttccaggagatcttccctctcttgttcccatggtttgtggtttattttggttctgttcaaaaaccaaaggggaaaataatctgcaagtgacaaatagcaaaagatctaataatataaaaatgtaattgtttgaattactaatatcccagatcttagcaagaataattagagctgactcaacttagggaatgcagttttgaatgttgtcattcttcagagcggtggtcctgaagcctggatgcaaattggacccacctggggagctttaatattaggctctggtcacacccccagatagtctgatttattttatcccatgtggggtcaaatattgatattcttaaatgtttcccactgtacagcgaaaattgataagcaccagtagaatttaattagatttcatgatgcaaataaaagaaaagatgcttaatctaattatttaaatgatgagagtttttagaagtgtttggaaggtttggaaggtcattttttaaagtagcagccagtcaaatggaatgtaatgtttttgttaaggcatcaaagaagcattgaaaccttcatttctttttttttttctttgagatgaaatcttgctctatcacccaggttggagtgcagtggcataatctgggctcattgcagcctctgcctaccagattcaagcttctcatgcctcaggctcctgagtagctaggattacaggtgcacaccaccacacccagctaatttttttattttttagtagagatgaggtttcttcatgttggccaggctggtctcgaactcctgacctcaggtgatccacccgcttcggcctcccaaagtgctggggttacaggtgtgagccactgcacccggccaacaccttcatttcttaaaagtaggtaacatcttattgcttactattaggagtgtggctattttatgaatatctgctatcttcctgaagcccatcttttaaataaatcttgggaaagggtctgtttgaaatggtgtggaaaaaattgaggtgggtaagatttgatgatcttcagcaaagaaacctgaagagtaatatccaatctcaatttagaaacaatgaaaagactagtttatacaagttatttcgggcagagggaacaaattgttaaatgacagacttaaaaccaaattaaattaagtcctattattggttgaattgtgcctgcgtgcacacccacacaccaattcatatattgaagttctaacctctagtacctcagagtgtaaccttatttggttgttggaaatagggtcatggcagatgtaattagtaaagaagttacactacaggagaggggagcccttactccactacctggtgtccttataaaaaggggaaatttgggctgggtgcggtggctcacacctgtaatcccaacactatgggaggccgagttgggtggatcgcttgagctcaggagttcgagaccagcctggggaacatggagaaaccccatctgtgcaaaagatccaaaaattagccaggcgtaatggtgcatgcctgtagtcgcagctacttgagaggctgaggtgagaggatcgcttgagcccgggaggcagaggttatggtgagctgagattgcaccactgcactccagcctaggtgacagagggagagctgagatcacgccactgcactccatcctgtctcaattaaaaaaaagtcggggggtgagtggagttggatttggacacagagcccatgtaaacatgaagaccagccatctataagtcaaagagagagacctggaacagttccttcccccacagtctgcaaaaggagccagccctgccaacaccttgatttcagacttttagcctccagaactgtgagaaaataaatttctgctgagggacccagtttgtagtactttgttgcagcagccgtagcaaactaatataagtcccaatattttatttgttttgaaaatctaaacctaggaaaattcagcatttgaaattttactatttctttaaaaggtagggaagcagttctctagaaggaattgtagaatgtgtggttctagagttcttaggttcttgatgactcatactttagccagttactagtcaatccagtttacaaagcagttcatcatgagcccagatcagcagctggagtttcaggagtgtgcattttttttctatttatggtagtagagtgggaagaatctttctagtcacctgagaggtgtttcctaaatgtattttgtatatacagattcaagcctcttacctgacttattcatagtctttctttttttttttctttttgagacggagtcttgctccgtcacccaagttggagtgcagtggtgcgatcttggctcactgcaacctctgcctcctgggttaagtgattctcctgcctcatcctcctgagtagctgggactataggctcatgccaccatgcccagctaatttttgtatttttagtagaggcagggttttaccatgttggccaggatgttctcaatctcttgacctcgtgatccgcccgcctcggcctcccaaagtgctgggattacaggcgtgagccactgcgcccagcacctaactattcatattcttatgaaaatctgaagttggtctctttcttatatatggattaatagcatcctggggaaacgagagatgaacaactttgaatatacatcccatgtcagtggactagaaaagaatggaccatgcctttcatgataaaagcaagtacctcagaaggagaaggctgtaggactaaattaggagtgatcctgggaagtgccctgctgaccaagaagaactggctattcccatgagaaattttgttatagactctgattggtgaagccttggaaataatagtgaaactcatacctccacctcaaacacagctccttaattattctggttttctaaacagagccaagtaagtatgccagcagaacaaatctactatgtttaaagctgactacaatagtgtataagtaaaggacatggaccctggagtcagttcaagttaggtttatgacttggagtagattatttcccttgcctctgttttctcatgtgtaaaatggatagtccagtgtgtctccatcatagcattttgtgatgattaaatagagtgataattcacgtaaagcaatgtgcaaaatgtctcgtgcatattaaatgttggttaatagcaatggcagcagctatgtggccacagtgcatgctactctcccattttagtgtgtaagagtgaataatctcttctcgtgaaatgttataagctcagacagtagaatccatgaattcaaaatattaacaaagcaaaacctggaagggcctgtaggatcaactggtgctcttcattcatttaaaggttcagaaaataaggtcatgaaatcagggttggagaaggccctaggtctcctggttcccagtttttcttttctgctacatgtggctgccttctaaatcacagaaccatgtgtctcttttcattcttcttcttctttttttttttttttttgagacagtcttcttcactcaggccagagtgcagtggtgcgaccttggttcactgcaacctccgcctcccaggttcaagccattcccctgcctcaccctcctaagtagctgggattgcaggtgcccgtcaccatgactggctcattttttgtatttttttagtaaagacaaggtttcaccgtgttggccaggctgatctcgaactcctgacctcaagtgatccacccaccttgccctcccaaagtgctgggattgcagacatgagccaccactcctggccactctctttttttaatcccaaagacttcaaaactacttttcattcttaataaaccttttgcttcaaaggaaacgtttttttctcttgacgtttgtgtgtttgaaattttccttattaaatagtttaaaaattattaaatttaaactgaatttaattatgattgtttaaagcaatttggagtatgcctgactgtacatttactgtctgtacagtaacagaacaaagaaattggtagcagtgattgcctctgggaagggcactgtggtagaagtgacattgattataaaggagaattctggagaatagagtaactactggttagtagaacaggacaaggaataaagtagtaacaagtatctgtggttaaccaaaactcaagaactgtatagactcaaaaatttggaagtatcccttgttatgtacacattagcactctctacccaagctacaggagccaaatagatttggttagggaggaatactttggtttcatttgggtgagaactgctcctgtgaattgcattttacacgcctgtctctgacttatcagtggatgaagtgatgagctctgttcctaccttgtacatgggtttttgcagcataaaagtgcttaattctggactaagccttgttagaagaccaggagcttaattgagcttttagaagagaagaaaaggaaaagtgttttaacaagtccatgtttatgctaggtgggattgcatgtctacaatttacctgtcaaaaaagggaaagggaaggctagctacacttttctttaaggtgtgtgaagtgtatttatgtgagttacggtataatttttttctttctttttttttcagtgacagggttttgctgtgttgcccaggctgaagtacagtaggtattcacagatgggattgtagcacaggacagccttgaactcctgggctcaagccatcctcctgtttcagccttccaggtagctgggactacaggcacataccaccaggcctggcttctatagtataatttttgagcctcctagtttctgttttaaaatttgttttactatttgaagagccagttacttttctagctagcttcctcttttctaaaacaggaagaaagattttgaaataaaacgatccaaatgtgttttaggattattaaccataaatttcagaacatagcattctcgaaggcaaggatattatctgtttagcacctacaatgtgtatttaatttaggtaattaaattattatgacaagtaatgtctaacctcagtgtgtagttttgtaaacattaattttaaaagattgaggctgcttagttgcaatgaaaccataaataatattttgaatatagcagacttacttaaggaaaatagcaaggtgcctggcattattatctatgagcaggaactttttcttacatttaagaagatggcttgaacctgggaggcggaggttgcagtgagtcaagatcgccacactgcactctagcttgggcggcaaagcaagactccatctcaaagaaaaagagaagattctttatagagaagtgtttagttaagaaacataaaatttacatagttttgagttaacttcccacaagatacatattagtaacttgataatagagaaacctggtagatactaccttaactaagtgatcaaaattaatctaggcatggaggcatgcacttgtagtcccagctatttgggaggcagatgcgggaggatcacttgaacccaggagttcgagtccagcctgggcaacagagcaagaccctgtctcaatagtatgaacataaatatatattaaaaattaatatccccagcaatggggggacaaataggtattttggaccccctgacatgatatatttgaaagaacataacattatttctttggtattcctaccaaaaatgcaaactgaatctaatcataaggaaatatacaaacccaaattggtagacattctacaaaacagatgacctgtactcttcaaaagtgtcaagattgtgaaagacaaagagcaaagaacttctcagattaaaggaaaagaaattgttccaggttaaaggagttattaagaaacatgatatttactaaaggaaacctataaccaaaaaagatttttttttaactttttaaaaggacattagtgggacaattagaaatttggataatgtctaaagattagataatagtattgtattaatgttattttcctagttttgataattatgctgtctttatattagatagtatttttatatttaggaaattaacacaaagtaggattaagaagcaatatgtctaacactttcaaacacatcagaaaacaatataggtagagaatgataaatagatgtggttaaatgttagaactgagggaatatgggtgaaggttgtatgggaattatttgtgctgtttttgcaacttttataagtctgcgattatctcaaaatgataaaggaagtagtatcttaatgaggtttgccgctaattaactgagtttttagtaggttgttaaaaaccctctctgggtcagtttcctcatctataaaatgaggtagctgacttacattaaattgtatgggtcctttccattctaaaattctgtgatattataactagacattaggagtaatagtttatactcttaatatagccatacttgaaaagaacaataatagaaaatgagggttaattttcccacttaagtcaaaagctgttgttaaaacacagcctttgtgccaagcgacagtgtaatattaagctcacagatttttttgttttgccaaaaaacttttattgagatttgatttaattaacattttatttgtatgtcacttcttggttcatgcttatgcattaatggcatcttattattattatttattttatttattttttgagaaggagcctcactctgtcacccaggctggagtgcagtggtgcgatctcggctcactgcaacctccgcctcccaggttcaagtgattctcctgcctcagcctccctagtagctgagactacaggtgcatgccaccgtgcccagctaatttttgtatttttagtagagatggggtttcaccatgttagccaggatggtcttgatttcctgaccctcgtgatctgcctgcctcggcctcccagagtgctgggattacaggtgtgagtcaccgcgcccagccttcatttttaaattttaatgccattatttggttgtaatagatacaaattacctaatgcctagaaagattatagagatacagcctgatgatctaaaaattaaattgatggctagtataaaatagttttgagcattatttaacaaaagcaaaactgtgttaatcctttgttttcattttcctctccctaacccttcccagcttggtgatccagctatttttcctgccgtaattgtggaacatgttcctggtgctgatattctcaatagttatgccggtctagcctgtgtggaagagcccaatgacatgattactgagagttcactggatgttgctgaagaagaaatcatagacgatgatgatgatgacatcacccttacaggtgcgtgtgtctccatccagtaggaccttgctgcagcacagctttaggcagtgtcctaatcctgaggatgtgggggcataaaacgcccctaacttggttttaaactgtattaccttcagaaactacagccctacatggagaagaaaattacattttctgtttcatctgctggatttagtactgttttgtcatctcccatttctcctttcctaaatatattgagatgaatgtgacaaaataagaggcatttaaaaggaaccaaacctcaattcatcaagtcttcactgagcagttttttttttttttaagagatggagtcttactgtattgcccagcctagacttggactcctgggctcaagtgatcctcctgccttagcctcctgagtaactgggacaacagtcatgcaccaccccacccagctcactgagtactttcttatatgccttcctccatattcctgtgaacaaaatgagttgttttgtagggaaagagagaggaatgttcttttcttaccactgccacaggaagcaaaatggtgggccatgacccaaatgtacgataaggtcctgggatttatagatttcttttctggttcagtcagaactagtaagatattttaaacttgaagattaggctacataaatgtgagattgtagtaataatactttcatcacttagaaattggtacatgctttctctttttgttcatttacagtcatatatcttggccagggatgttgtggatatttgagaaaactgtttggaagcaaatatttgcatctttattcgtaaaagaaagtttatcagaaataggcaagatgaggtatatctgtagatttcatggtggcaagtactggggctgccttgttctcagctttaccttagcatgtagcacaatgccttagaactgaatagtaagtctaaaggcgggttctgatctatttaggaagttaacatatgatacagtaatgttttaaatcggggaaaggtagaatgactgtatccatctggtgggggagaggccccactgttaacattggttgtcaatacctcatctttgtgttgtcctctgttttagtcacttctcacattgctataaagaactacctgagactgggtaatacttataaagaaaagaagtttaattggctcatggttctgcaggctgtacaggaagcatggctggggagacctcaggaaacttacaatcatggtggaaggcgaaggggaagcaggcacatcctacatggctggagcaggaggaacagaaggcagggtggtagggggtgctacacactttcttttttttcttttttttttttttaaatgcacaaatttattttttctcaacaaacacacatcttaatgcctttacaacttttatctccccaaatatatcttgcttttctttatacatgctgtatacagagttgttttccttatatttagtagttattgcttttttgtgcccttttgggtcctgaatttacacatcaggcatagatcttgggacaggaaagagctgtgaagcaaattcctggaagatcaaaccccttccagcatggccaggtagcacagctgagccagggatgatggggccatattgggtttggctctgccttgcagctggcagtccaaacactgaggacatgcatatttctgcaggcctcactatggtcatctgtccaaaccccagaatccagagactcaaaacgaaatacagtcatacagtaagatatgtgcaaggtttcagggagcccagcagccagaccttacacaaatcaagcaagtttaagaaatattccagaagtagcagttttatgaccttaaaacatgtaataggctgggcacagtggcccatgcctgtaatcccagcactttgggaggccaaggtgggcagatcacttgaggtcaggagttcgagaccagcctggccaacatggtgaaatcctgtttctactacaaatacaaaaattagccaagtatggtggcatacacgtgtagtttagctattcggaaggctgaggcaggagaatcacttgaacctgggagacggaagttgtggtgagctgagatctcaccactgcactccagcctgggcaatgagagcaaaactccagctcaaaaacaaaaaacaaattaaaaaaaaaaaagtaatagagacgatgtaaacctgtcagtagacccaggcaaaaacaattatatttaactgacaatcctgaagcctttccaactttctttttttttttttttttttttttgatcattcttgggtgtttctcgcagagggggatttggcagggtcacaggacaatagtggagggaaggtcagcagataagtgcagataagtgaacaaaggtctttggttttcctaggcagaggaccctgcggccttccacagtgtttgtgtccctgggtacttgagattagggagtggtgatgactcttaacgagcatgctgccttcaaatatctgtttaacaaagccatcttgcaccacccttaatccattcaaccctgagtggacacagcacatgtttcagagagcacagggttgggggtaaggtcacagatcaacaggatcccaaggcagaagaatttttcttagtacagaacaaaatgaaaagtctcccacgtctacctctttctacacagacacggcaaccatccgatttctcagtcttttccccacctttcccccctttctattccacaaaaccgccattgtcatcatggcccgttctcaatgagctgttgagtacacctcccagacggggtggtggccgggcagaggggctcctcacttcccagtaggggcggccaggcagaggcgcccctcacctcctggacggggcggctggccgggcggggggctgacccccccgcctccctcccggacggggcggctggccgggcggggggctgacctccccgcctccctcctggatggggtggctggccgggcggaggggctcctctcttcccagtaggggtggccgggcagaggcgcccctcacctcccggacggggcggctggccgggcggggggctgacccccccgcctccctcccggacggggcggctggccgggcggggggctgacctccccgcctccctcccggatggggcggctggccaggccgggggctgactcccccacctccctcccggacggggcggctggccgggcagaggggctcctctcttcccagtaggggcggccaggcagaggtgcccctcacctcccggacggggcggctggccgggtggggggctgacccccccacctacttcccggacggggcggctggccgggcagagggactcctcacttcccagtaggggcggccgggcagaggcgcccctcacctcccggacggggcggctggccgggcggggggctgacccccccacctccttcccggatgggcagctggccgggcagggggatgacccccccatctccctcccggatggggcggctggccgggtggggggctaacccccccacctcccttccggacggggcggctggccgggcggggggctgacccccacctccctcccagacggggtggctgccaggcggagatgctcctcacttcccagacggagtggctgccgggcggaggggctcctcacttctcagagggtgtggctgccgggcggaggggctcctcacttctcagacgcggcggttgccaggcagagggtctcctcacttctcagacggggcagccgggcagagacgctcctcacatcccagacggggcggcagggcagaggcgctccccacatctcagacgatgggcagcctggcagagacgctcctcacttcctagatgggatggcggccgggcagagacgctcctcactttccagactgggcagccaggcagagaggctcctcacatcccagacgatgggcggccaggcagagacgctcctcacttcccagacggggtggcggccgggcagaggctgcaatctcggcactttgcggggccaaggcaggcagctgggaagtggaggttgtagcgagccgagatcacgccactgcactccagcctgggcaccattgagcactgagtgaacgcgactccgtctgccatcccggcacctcgggaggccgaggctggcggatcactcgcggttaggagctggagaccagcccggccaacacagcaaaaccccgcctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagctttggctcggcattagggggagaccgtggaaagagagggagagggagaccgtggggagagggagaccgtggggagagggagagggagaggagggagagggagagctacacactttcaaaccactagatctcatgagaactcattcactgtcacaagaacagtaaggggaaaatccatctccacgatccggtcacctcccaccaggcccctcctccaacattggggtttacaattcaacatgagatttggagcggggacaaatccaagccatatcactcccttttttttaacaaagcattttttgcatgtattcacattttttgttcagagcaaaccaataaaagttttttgttgaatctagagttacttttcccttaccagtgagggaattggactaatcaggttagaagtttctattcattgctgtctgatctgtatgtgtaacagaataaacaccactatgcatgtatctgggcttgtagttagtgggggtttagcagtgtatcctgatataacttttaaagccttagggtaaggctacagtctttgtaagttgaggaccaatgtctttccggaaggagtgtttcttcctagttctagtcatcagggaaggcattagttctcagagaggaaaccagattctctgtttgtgttttttcttccctttgccttacctcccaacttaccaaagctttgtttaactcttccatccttttctgagcaatgtcatgaaaaagggaagaaccttgtaatcttcgttattccacagtgggggtgacggggagcctttgagaagctctaggggaagaaagagataaggataggacatttttgttcttacacgtgttaggtggcgcttcagatgatgtgttagtttgctaggactgccataagaaagtaccacagactgagtggctcaaatgagaaatttattttctcacagttctggaagctagaagtctgagatcaagatattggtagagttaattccttctgaggcttctttctggacttataggtgacttgtcttccagtgtcttcacatggtcttatgttttgtacctgccagtgttcatatttcatcttagagggacactaaccatattggattagggcctacactaataacctcattttaactcagttatctctttaaagacattctgaggtactgggggttagcatgtcaacatagaattttgggggataccattcagcctataatagatgatattaaagaattactgtaggccgggcacggtggctgacacttgtaatcccagcactttgggaggccgaggcgggcagatcacctgaggtcgggagttcaagaccagcctgaccaacatggagaaatcccgtctctactgaaaatacagaattagctgggcatggtggcacatgcctgtattcccagctactcaagaggctgaggcaggagaatcgcttgaatctaggaggcagaggttgcggtgagccaagatcacaccattgcactccagcctgggcaacaagattgaaactttgtctcaaaaaaaaaaaaaaaagatttattgttagtatatttaagatatgatagtagtattgtgttagacatcttttagatacacatgctaaagtatttagagataaaatatggtattttagattccttcaaaataatcctgtacagagggtaaggacttgagggcagtgagtggggtatggatgaaagaagattggccatttggtgataatagttgaagctaggaatgggcacatggggattcattatatatactatactccacaatttttattttgtttaaaattttcataataaaaatatttgaacagatgcagcggctcacacctgtaatcccagaactttgggaggccaaggagggaggatcacctgagcccaggaattcaaggcctggcttgaggaattcaggcctggcttgaggaattcaagtgagcaacatagcgggaccctgtctctaaaaaaattttaaaaattagctgggcatggtggcctgagactgtagtcctgtctactcgggaggctgaggtggtaggattgcttgagcctaggagtttatggttgcagtgagctataattgagccactgcactctagcctgggagacagggtaagaccttgtctcaaaaaaaaaaagcaaaaccaaaaagatttaatgattttatgaaatttgaggcttagattatattttgagctgtcatcaaaatacataaatttttttttagtcttgccaaaaaaaattaaagttgaatttcatcaagcctccagatatgactactcagttagagggggtatagaaaaacatgttaagctacacaataggaatatagttggcaaaatccaaactatgggaaattctacatgaataaacagcctgagttcttcaacaaataaattgcaaagtaaaaaaagctagacagatgaatggcaactcagaaatgtaaagaaagttaagaaatgtatcagtcaattgcaatatgcagacttaatttgatttaagcaaaaaactgtcttgtctttccttgcactgccaccatttatgattttttaacacaattgaacatttgaatgctggttggctatttaatattaaggaaatattgattttttaatgtaatagtttctgttttttttttttaagacagagtctcactctgtcacccagactggagtgcagtggtttagtctcagctcattgaaacctccaccttctgggttcaaacgattctcctatctcactctcctgagtagctgggactacaggtgcgtgccaccacgcccagctaattttttgtatttttagtagaaacagggtttctccatgttggccagtctcagactcctgacctcaagcaatctgcttgcctcggcttcccaaagtgcgggattacaggaatgagccactgcgccagccaggtttggtatgattttgtgtgtttatagtttatatatatatataaactaaaatattaaatgatgtattctggttctagagataagcggtgtatgactttcagagtaacagatgtctcgtagttaatttaattttctcttcaaatgtgttgcagttgaagcttcttgtcatgacggggatgaaacaattgaaactattgaggctgctgaggcactcctcaatatggattcccctggccctatgctggatgaaaaacgaataagtgagtgattatgattgtttatgtttatgtactttgttaagttactcttgccatctttctttattagtaaaatcaagagattagaaatgatgttatatattttttgttacaatcacattttaaggtatagtaggaattgaggtgcctttgcaaaaacgtagagttaaagatgacattttaatttgagaatgaagcctttgggaacaaaaaaatgtaatttattacttaccaaatagaagatcatgcagaatttcttctcttaacatattgatgagagtattagggtatcaagggcccaaatgattataatttagtcatctctgtagttatcagcaaataggcaacaatctattgaaaattttactgacacatcatggcataaaattcactgccacattattgatctgctttaaaattcctgttctcctttgggcttttctgacaagcaatcaaattcataaagtaaattattgctaaatcagtctaaaatgtttattcaatatttgctatattcacagcagcaataattaggcaataacatgagatacaaatgagcagatactgttcctttcctcaagcttacagtttaattttgaagacagttacttatgtaaataactacaaagccaagaataaaggccacaagagtgatagcgaattgctctagtagcagtgggtattctagctgagaatatcagagactggcttcattgaaggagtattctgacctgggctgtaaatgacaagcttttaataggtagaagagacatgaaaggtcattcaagctggagggaatggagttaaagatacaagacacagatctgttaaaaaaaaaatgaatgaaatctttgagatcaagatgttttggtgtggttgaagtgtaagcttcatggtgggtgggaaatgagattggaaaggtaggtttggaactagattacagaagctttgtaaggcatgctatagagatgggttgtgattatttttttgtttgttttttgtttttcctatgaactatggaaaggtatgtcagttttgttttttattcccctaattttatggtcaggtcagacttaggtttcagaaaataactctcacagcaatgtgaataatcaagaggagagatgagacagactggtgataggaagtcaagtaagaaagacattgaaatagctcgccgtgcctggactggtttagggtatttgattttgggaaggggaacttaaacgcaggaatagatttcaagattttatttctactttaatcttctagtcataatagaaacaagaaattttctcaatcgttttttaacttataatacacagtggactataattagttgattttattttcattagataataatatatttagttcacctgaagatgacatggttgttgccccagtcacccatgtgtccgtcacattagatgggattcctgaagtgatggaaacacagcaggtgcaagaaaaatatgcagactcaccgggagcctcatcaccagaacagcctaagaggaaaaaaggtaggtgggttactttgtttagggcgcatagtcaagtcttggtgtgaaatctagatatcacttttattctacatagttctttcctgctgcagttaaaacttatgtaagaaaaacattgaaggcacaaaatggaaattatgagttatttcttggccaggcacggagattcatgcctgtaatcccagcactttaggaggccgaggcaggaagattgtttgaggccaggagtttgagaccagcctgggcaacaaagcaagacctcatctctacaaaaaattttaagaattagctgggcacggtaggcacctgtagtcctagatacttgggaggccaaggtggaggatcccttgagctcaggagttacaggtttcagcgagctaaggtcatgccactgcactccagcctgggcaacagactgagaccctatctctaagaaataaaataaaataaaaataaataaataagaaaaagaggtatttcttcatagtagaatcatttcttttaaaaaattaaagtattgggccaggtgcggtggctcatgcctttaatcccagcactttgggaggtgggggtgggtggataacctgaggtcaggggtttgagaccagcctggccaataaggtgaaaccccgtctctactaaaaatatgaaaattagccgggcatgttgacaggtgcctgtaatcccagctacttgggaagctgaggcaggagaatcacttgaacccaggaagtggaggttacagtgagctgagaccacaacattgaactctagcctgggcaacaagagtgaaactccatctcaaaaaaataatgataataattaaattattttatacttttaaaaagtttggtctatcttacagaaaagggattttccaactttttaaagcctcaaatttttatctaaacccttttgtccttgggtaaggtctagtcagcttccttcccaggggttattgtttgaaagcctccagtctgtaccggtgattccagtataagactccagttggaaaaatacaatgggttggaaatcagcaggtaagtaactgaagaggagtattttaggatgtgttgagtgggaatttttaactttttgccaattaggaccacacttgcattctaaagtctgacaccttttccattttattgccttctgattctactcatgcttgcttagtattttgagtataatgtcttgattaatagcatcaccacccacccagtaacctaagttcatgtgaaagtcagggaaattccaagagctgaaaatgaagaggaaaataaaaatagtaaacatgagccgacactgcagcagctcagaagggctgagaaggatatgccgaggggctctggttttattgtccgtgttgaggcagaagcttaggtcttgggctacgcaagatggggtatcggacagagacctcagcatgtaactgggacccttgaagggatataccctcttgggggaaagaaatccacccattggcacagacagatgtcaaggaagcttgggtcccattcagccaggcctctgagtggagaaattctggtttaatttcttttgggtaaatacttagtagtggaatggctggatcacatgttaagtgtacattaaatatttttcagaaacacaaactgctttccaaaaaattttttctccatgtattaaggtggggcagtcataggacttgcctcatttatttcctgtctctcagggatcactggcttttgttgaccgatgtccaatttcttcagtaccattgtttcatacctttttttctgtgtttttaattgtttcaggtgggaagataaatccatgttctgttattccatcttgactagaagaggaagttcccacctagtcttttttaatagccttattcttcgaccatgtttttgttcttttgctttaaaacctctaatcatactatgtaaagtttctatttaataattctgttatgtgtgattcttagagaactaatcctagggtttcctagtctactgcttctcactcagaaagtgtcttcctcatgtattctgtgataccaaaatgtgagttcagcttcaacggggctttatctgaggaaatcttgtatggcctaggttgaatgtataacccacctgagcaattctataagagcttctgcctggtgccccatagttattacagtcctggggctacatctgtgttaattacttggctggcaattcctaatgttagtggtagtttaaaatctagttgtaaacccaggttaagacaggcccaggattaactatgtttatagaaaaatttgtacataaatggctgatctcaactcattgcatcctccacctcttgggttcaggtgattctcctgcctctgcctcccaggtagctgggattaaaggcatgtgccaccacacctggctgatttttgtatttttagtagagatgaggtttcaccatgttggccaggctggtcttgaactcctgacctcaagtggtccaccgcctcgacctcccaagtgctgggattacatggatgagccaccctgcctggccatttatgtacaaatttttcttaaatatgtagtatttgtttacccagtcagcagttaatgggatttgggttgtttgtagtttggggcaactgcaaataatgctgctaagaacatttgtgtatctttttttttttttttgagatggagtctcgttctctcacccaggctggagtgcagtggcacttttatcaacacagtaaaaataccactcaacaataaaacaatatacgattggtacattcaacaaaaatggatgaatctctcaaaataattgtgctaaaagagggaagccagaagaaaaaatatgtttctacagtttacccccaaacaatgtgggggttagggccgtcagcctctgcagccaaaaatccatgtaaaactacaggcgagccccaccatacccagctaatttttaatttttatttttgtagaggtgggtctcactatgttgcctagcttggtcttaaacttctaggctcaagcattcctcctggtttggccttcccaaatgctgagattacaggtgtgagccaccatgcctggccaaaggtcttcatgcttgttgtgtttatgttggctaggctgaggagggaggaggaagaaaagggtttggtcttgctgtctcaggagtagcagaggtggaagagatggaggaagtggaaggggaggcaggagacacaggcacacttgatgtaactttattgaaaaaagatccctatataagtgggcctgtgcagttcaaagctgtgttttgtttgagggtcagttttatttttatataaagctctagaaactaccaactaatctataatgacaggaaacagatgagtggttgcctgtggattgggcagggtgaggaagggcgagatgtaaggattacaaaggggcacaaagtacttttggggtgatgaatatattcattgttttgaatgtagtggtggtgttagtatacatagtcaaaacttgtcaaattgtaaacatcaaacatacgtagtttattatatgtcagttatacctcaataaagctgcttaaaaaataaaaggctaatatcctacttaatgttgaaaaactattggtatgataaagaaccaaatggaatttatagaaataagaaatgaaattgggccatgctcagtggctcatgcttgtaatcccagcactttgggagtctgaggcgggcagacatcctgaggtcggaaattcgagagcaacatggtgaaacgcagtctctgctaaaaatatggaaaaaaattagccaggcatggtggtacgtgcctgtaatcccagctacttgggaggctgaggcacgagaatcgcttgaacccaggaggcagaggttgcagtgagccaagatcgcaccattgcattccagcctgagcgacagagtgagactgtgtctcaaaaacaaaaaaatgaaatgaaattgaaaacatcatgtgtggattaaaacatagactagtcactgcttaagaaagaattagtaaactccagtaaatttagtgtggattaaaaaatatgaaacagttacagacatggagaattaaatgaaaaggtctacatgtttaatcaaagttccagaaacagaatataaaaagtgaggaagagacaatattcaagagatagtgactaagaattttccagaatcacattaatcctcagcattgtgaatcctgagtagttcagctacaataaatctaggcctaaatgcattgttggtaaaaatgcagaacaccaaagacctctcttcaagttctccccactcaaaaaaaagaagccgaccggggagaaactacattacttcaagaggattgattttttttttagattggcagtttagaagctctcaggagaggctggaagaattagacatcttcaaagggctgagaagaaaccactgccaaacaaaaattctatatctaaccaagctgtaattcacctgaagctttgtacattaccaccttgaatgattaggaagatgttggagaggatggatactgggttgggagtttttactggcagcatctgttgtgactaaagctagtggaggaaagtagtggaaataaagacgatatctattttttttaagctggtatatattaatagcataaaataaggtggaggttactgaagtgttggcttctaatactggttgtcatgaacacagccagaagaatctgtctcatgaagggttctctgcagatgtctccagtgatgaaagtcgagatacttggctgactagcatacatttggcagtcttagagactgaagagcgggctttttgacacttttctcccttcctttcattcacccaaatgacttcagaaatgttttcctattccatttctggggataaattgtcactgaccttgtgatttttttttttagctgtaaaattctgcttttctaagttattgccctgccctgtgttatatttacctgtaattcaccacagtaatctaaaccagagcggcagcctcagggatgtttgggtaggaggtagtaactcttcattgtttctcacatatagaatggtagtatgttcagacagcatgatcatgatctcaacctaaatacaaggcagtggcgctgctaggccatggttctagatacttggcaaaagaagatcacaaatacggctttagaatagtttatcgaccccactctgaggctattgggatggacttatttagacattgatggtgggtaaggtaactatgaagtttgttgtgaattgaaaggtacagaaaaacgagatgtttttagaaatacacaggaggatagcatttaactatgtggttcaccaaaattttgcctcacatattttctgtatttctagagtttgggaagtttcttatacttgagaactaactgtatacagaaattatttaatagagaaaaaagctaaaaatccacttctcctaccttaaaaagcttgtataattaataggcagacaaaactgtatggcttatttttggagcccacgttctaccaatgtcaagagcattctccaaaagtttaagaaagcactaccagtatgggtacttcaaaggcaagctatagtaatttaaattaacttcatttttacagatataaactgaggtgtcaaaggtatcatttcttacataagtgtgtttatggtttaacctgcattaatgtccaagttttattaaagttgttttccttttagtaaacagcattttaagagacctgtatatgtgacccatgtataaaaacatttggcacttgaaatttagggtaaacgacaaaatagctgaattgtccattttctctcacttttgaaggcaaatatttatgcagagctgtttttatttcaggaagaaaaactaaaccaccacgaccagattccccagccactacgccaaatatatctgtgaagaagaaaaacaaagatggaaagggtactactgtgtaatacttataggtcaaataacactcagattgctttatagtgcctacctattataactagaaaccaccagctttcttgatatactgcagtggatcttattgctgccacatgcttattagatacatttgccaaattcttaaaactgatagtaaagtagaccaagaaactcgtttgagtgattttcacttacctgtcaaaataatctattcttttcatttaataaagagactcttggaagaatttaaccaggttagattttcagttcatagaccctttaatatgttgtcttgaaattcaagcatttgtataactgttgcccaaatttgaagaaaactgttatggccgacctgctggctctaatctaaagagaactactgttgagagagttcacaaagagacagaaaaaaattatctcaaagtactttctcctaaatcatcacaaatcttacgacaagattgctttgttcacatattttatatgggactcataaaaagatctttattagatgctaaaaattatgaccattatatcacccatactaactaaattatgtcaccaatactaactgaattatgtaatatttttgtataaatataaatggcacttctaagacttttagttgtcttttttgaggttcttttaaatgaaattttggtcatttagaaagaaattgtttttgtttcaggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtatgcgaagttttggtattttattgtgttaagaatatcattttctaaattgtaaaaaaaaatactaagcttaagttcagcaaagcaccaatagtggtaatgcaaatacataataagagggtacattttcagtcaggtgcggtggctcatgcctgtaatcccaacactttgggaggctgaggccggtggattgcttgagtccaggagtttaagaccagcctgggcaacatggcaaaaccctgtctctactaaaaatacaaaaaattagccaggcgtggtggtatgcacctgtggtcccagctactcggcaggctgaggtgggagaatcacctgagcccgggaggttgaggctgcagtgatccagattgtactactgaactccagcttgggcaactggagtgagaccctgtctcaaaaaaaaagagggtgcattctcaaacatgaattgcaagtatgatatgttagttattatagtagaataaatcagtgcttcaggagtactactagaaatcatgagaattttgaacaagagtaacattcttaagctcacttttagttcgtttttcggtgattctgtcatttatccttcaagatacgcatgtatttgagaaagatgtattggaaataagaacgatctgaatgacttttaggggatagacagatatagatataaaatttagcagtcttaaactaaaactctttaattacagtttttgggtttttttaacatacactttttaagttcttgattttgttaaaatagatgacaaaagttggatcactgctattgcatatggttaaattttatacacaaaagtcaatcaaatttactgaatcaaatttaaactgatacatttgccaatttaaatttattgaatcaaatttaaactgataaaatttgcctagtaggaacatttctagaaagccgtggaggagaaacaatttcttgaggcttttggtagttttgattatcctggcaagttggcagaggggggctgagtgtggtggctcgcttctataatcccagcattttgggagcctgagaaggaaggatcgtttcagcctgggagttccagatcagcctgggcaacatggcaaaacccagtctctgccaaaaaatgcaaaaattagccacgtgtggtagcatgcgcctgtggtcccagctactgaggaggctgacgtggaaagattgcttaaggccaggagttcaaggctgcagtgagctgtgatcatgccactgcactccagcctgggcaacagagcaagactctgtctccaaataaataagtaaataagttagcagaaagaggaagaaaagtgaaagaccagaggattccacatagtttatcaacagtcccccaatcagcattagttttagatttagttggtaataagaacttatctctatctgtgcataaatgtatgtttatctcatataaaataacagccctttatttagaaattcttttctcattagtttgattccaactttaaagttttgtttatgattagggaaatttgattttgttgaatattttaattgatgtttgattgattgatgaaattgtctgctttgaataggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggtgagaaaaccaaactactgatgcttatcacttcaatatgtttctgaccagagacattatttgttaagtgggtcaagattcagaaatgaaaataaaagtataaaggtttcaagctagaattcttggttaccagatttttcaggagcagttactattatgtcagtcctctgattatgccactggtccctttatttacattttgacattactggcattattctgtcaaatactacacctttgtataactggattgatacatataagaaattatctagatgggagaaaatccagggtttcaaatctttattcaggccaagtcagaagcttcaaaaattcaacataaattgacatattaggacattgagagtgcatagagttccaagcaataaatgttattccttggaagatcctatcttcgaacaattctaaagttcaaataggaagggaggccaagaatctaaggtcctcttttagagtggcagaagttgaaaaagtaggtttggttttttttttttttttttttttttttttttttcagttaaatcagatttgcctcagagccccaggatgagatgctaaacaacaaattgactgagaggatctgtctgccttagactgatcttcgcagaaatttgggactagtctcagctgacttagaatgggagtatgggaggaaggcagaaaattatatggatatttgtagcatttttctgtttatactgtcatgaatttctagaacatgaaccataataaaatctagcagccctttcaaagccaataaaaattattatttgattacttttattagcaaacttcagtcttacatttttatattccagaatataaatgtggaggttttgctcagttgatcttggagtaaggtaacattacctagaatcaaggcagacttagaagattcagtcttctttgtatagacaatttaaaatgtttgaccttgtgaaaatattctcttaaatcttcacttgatttgcaaggagtacaaagatgacctttacatttttaattggatgctacatcttttaactgttattaaaggagtatatcttgagtagcccttatccaaaatgcctgggaccagaaatattttggatttagaattgtttcggattttgaatcgttgcattatacttacccggcacagcatcccaaatccaaaaatctgagatccaaaatgctcccgtgagcatttcctttgagcatcttattggtgctcaaaaagtttcatattttagatttcagattttcggatttgggatgctcagtgggtgcttatttaactcttactgtccgtattctccccttaatgttttatatttccctaggccctgtgggttacaggtgatgactgggtgtctggttgggagtgtgtggttcctcccattggtttctaggctgtttgttgtttgtatttgtgttgataggagacctacagtggccacagctgattccatggaatttttttagcatctgtattcaaaatattctttttagactgtgagaataaaaccaaaacaaaaaactctagctttgaaagatactaaattgtagatattatagagtaggtttttgttttgttttgtttttttgagacaaagtctagctagctttgttgcctaggctggagtgtaatgacaccatcatagctcactgcatcctacttccaggactcaagcagtcctctcacctcagccttcctcatagctgggactacaggcatgtccagctaattttttaattttttgtagaaatggggttttactttgttggtcttgaaccaagaccaaccaagcaatcctaccaccttggcctcctgaagtgctgggattataagtgtgagccactgcatctggcctagaatggttttttattaggacaagttctggttttgttatttcttatattttttgtttgcatttttgtaattacccaaccttttactatggaaaatttcaaagtatggaaaaattcagctagtactatgaacacttatttactatccacctaaattcacaaattgatagcattttgcattatttgttttctctatttatttatacctttttttctctttgactatatctttcttgatttttgatgacttattaataaaatcagaggcttttaacttttttccctgtggttgagagaagatggaatgtatatgattatatatataattagataaattattaatataacaacaagagctgacacagagcactctttgtacttcatacactttacatatagtgaggcatagaatcctcatagctcaatgagaatagataatatccccgttttatagatgtggaaactgaagcaaggagagaccagggaacttggtcacatgtagcagatggtggagatagtattttaatgctagctgtttagctgcaagcattgaagttaatgacttgctacactgcctaccgatttacataaatcacaggaattgtcagttatttacagtaaaacagcaacatcttaattttgtccttcactcatttctttttatttcatgtgattgcatgtatctatgttgattcagttaagcttttcttaattggtgtacagtatatatgctcagtttttacaaatttacaaaaagaagccagtttgattctggcttcatggtagtcaaagaaacaacaacagaaataaactgctggtaaactattttctgaaaattgccccttggtaaacattggagaccattttacctagcataacttttatttatccaagcattaataatttttcttaggatcttttaaataaattatcctggccaggtgcagtgcctcacacctgtaattccaacactttgggaggccgaggcgggtggatcacctgaggtcgggagtttgaaaccagcctggccaatatggcaaaaccccgtctctactaaaaatacaaaaattagctgggtatggtggcaggcacctgtaatcctagctactcaggaggctgaggcaggagaataacttgaactcaggaggggcagaggttgcagtgagccaagattgcatcactgcactccagctggggctacagagtgagaccccgtctcaagtaaataaataaacaaacctgtgaaaatgtataatgtgtaggttatcctaaaagcatatagaagctgggcgcggtggctcatgcctgtaatcccagcactgtgggaggccgaggcgggtgaatcacgaggtcaggagttcgagaccagccttcccaacatggtgaaaacccgactctactaaaaatacaaaaaattagctaggcgtagtggcgggcgcctgtaatcccagctacttgggaggctgaggcagaagaatcgcttgaacctgggaggcagaggttgcagtgagctgagatggcgccactgcactccagcccaagtgacagggtgagactctgtctcaaaaaaaattttcagctcttcagccttgctaattattagatgtgaaattgaatcacgttaattattttgagtctgtttccttatctgtaaagcacagatgataatatttaaccttccacttggctgtgacaattaaatgacacctgacacctgagtagatcctcaacaaatgctaaatgttatatggtctgtgttagtttcagaaattttgataaattgtaaattagcaatatttttccagttgtttacaagcagcttaggagatttttaaaaagtagtcagctgtaatagaatctgtattacataatacaaccagacgcaactgacagtttaatcattaactaagaagaaagtaattctgtggttggcaaagacttaataatattttatttaatctctgaatttgtattattgaaaattgttttagaatttgttccaataagccaatatatttgcatcgtagatggtatagataagtgtatgcattttctgacagatggcagtcaggtgtctcaagaaaaggactttttttttgagactgagtctccctctgtagcccaggctggagtgcagtggcacgatctcactcacactgctcccttcacctcccagctcctggttcaagcagttctcctgcctcagcctcccgagttgctgggattataggcacgcgccaccatgcccagctaattttttttttcttttttttctttttttttttttttttgagacggagtcttgctctgtcaaccaggctggagtgcagtggcgcgatctcggctcactgcaagctccgcctcccaggttcacgccattctcctgcctcagcctccccagcagctgggactacaggcgcccgccaccacacccgactatgcccagctaatttttgtatttttaatagagatggggtttcaccatgttgaccaggccgtcttgaactctgtaccttgtgatccacccaccttggactcccaaagtgctaggattacaggcatgagccaccgtgcccggccaagaaaaggacatctttttctaatttaaacagaagcagcgaagtcctagtggtagccctgattagcaatatggaaaatttccaagtacattattgcttgtgtcataccttacagaaggaaagaagaatgagagaggcatatattagagagttgtaactgcctattgtttaaggatagaataataaatactcatctttagtatttactaaagatgaagttgctcaggacttaagtggcggcagtctgttgtaatggtaaggcggcacatcggctctgcagtcagatggcctctcttcttctctaactggtcaccttatgcaagctgttgcaacctgtttgtgcatcagtgttttcgtatgtaagatggggataatatttgtagggtggcaaggttatacatattataaggttatgcatattgatgtaatctgtgtgctaactatatgccaagtactattttatctatgtgtatgttatgtaaactcttgtcatgggaagcccttaggccttttttatttaaaaatggtatctgggctgggcacggtggctcacgtgatgccaatgatgtcaggagttcaagaacagcctggccaacgtggtgaaaccctgttcctactaaaaatacaaaaaaattagctgggcatggtggcgggtgcctataatcccagctactcgggaggctgaggcagagaattgcttgaacctggaaggtggaggttgcagtgagctgagatcacaccactgcactccagcctgggcaacagagcgagactccatctcaaaaaaaaaaaaaaaatggtatctggctatagcgtcaggtactgtacccaggctcccatctcaccccagatttccctgaatcaaatgggcaagagaacttgggtggccatctaagtttggtaatctgtatcctgcgtgaatgggcgggctctagtcatcctgtgtctttattcccacttcttttgaacgtgtcctgaattgctctgggtctttgtttcatctttccaccaagccaatttgtttttctcctccactattttatttctcatatgtgagaaacagactgcataactaactttcaaaatgtagctttaataatctagtggtaatatttaacgcttggtttatggagactagtctagctgtcagctgtttgaaatagcaagtatctttcattaaataactttacagaattcaaaggaaacagttgacatccagatactgagatttttcaacaccatttgttttatactatattaacaataaccttaactataaatttcagagctgtgaactttttaaattagattgactcataatatcatttatgtaactttctcttcaatgagtgggattaacaacctacataaactagattttgcattaaaggattttatgttaaactgtagctttatgaccaaaatttgtgaaaattatttgaacctggaaaactgctaaaacatgcttctatgtatttttccaaagcttagccatattttctctaccagtccaagagccctgacaggttaattataatcatggcttgtttcatctaaatatgacatgaaatgtgagctattaaaattctaagaattctgtcatatggttaagactgaggtaggttttttgtttaggttaattaagcacttctccctttatatgtaaaaacaggttgaatacaattatatgaattttggtaattattgtggatgagcatgttggtaacattatctctcaaatattaaaatagcaggccgggcacagtggctcatgcctataatcccagcactttgggaggccgaggcgggtggatcacctgaggtcaggactttgagaccagcctgaccaacatagaaaaccccatctcaattaaaactacaaaaattagccgggcgtggtggcacgtgactataatcccagctactcgggaggctgacaggagaatggcttgaacccaggaggcagaagctacagtgagccaagatcacgccactgtactccagcctgagcaacaagagtgaaactccatctaaaaaaaaaaaaaaaaaaaaaaaaagcaggaatgaatcaaacagatttgcttttaaattcctaattttaagaagctcatgcaaacttcttgctaagcattttaacatcctcctccttccccaacaaaattagctcctcatttgtgttaatgtggccctatgtacagacctttcttccatagcactcagcagatggtatcatagttaatggcctgagagttttgtgttaggcatctctgtatgtagtgtttaatacaaagtctggcatgatattggtcatgctctgttgaaaatatgggaagcagcattttgaaacacataactggtattttgtaaaatgacttgtcaagtgttaaagttttaaatgatgtagaatatgctaattgtctcactttaatttcatcatctcaataggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggactagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctattatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaattctcagtgtctgttttcaggcaaaagtttcttaaagaataagtgtgcagagaatattactagaacatcagcattacttaatgtttataaataaatttcattagtcagaattgcagaatatcatcctttcacttttcctttctagcaggccaaatggcaatttctaaacatcacacaatggattaccaagttgtaaaaattagacaacaataaaatattcccagcaataatattaaacacacttttgttttgttttgtttttgagacagagtcttagctctgtcacccaggctgcagtaaagtggcgtgaccttggctcactgcaacctccacctcccaggttcaagctattctcctgcctcagcctctcaagtagctgggattacaggtgcccaccaccacatccagctaattttttgtatttttagtagagacagggtttcaccatgttggccaggctggtcttgaactcctgatctctggtgatccactcgcttcggcctcccagagtgctgggattacaggcgtaagccaccatgccccacctaagcactcttttgaaaacaagttttctagttagaaactaggtcagttagtagttaaacttggaaaacatagaaaaattttcttatgaaaattaaaatctctgtaatccaataccccatatccagaagtaactttcacttactcattttttcatgtttgtgaatattcttccaaaatgtgattttaaaggctgtgtaatactatattagtataccaaaatctagttaaataaaacctttttaactagataagttagttttatggttttttcaccacatagatagtgaatatcagtgtcttagttcattttctttgttgctgctataacagaatacctgagactgggtaatttataatgaacagaaattgatttgcccacagttctggagtctgggaagtccgatatcaatgcaccagcaggtttgacggttctcattccaaacagtgcctgaacaccgtgtcctctggaggggaagaaggcttcatcttcaaatggcgaagacagaaaagcaaagacagcccacttccacttccaaaagactttttatttatttatttatttatttttttgagacagatttttgctcttgatgcccaggctggagtgcaatggcgtgatctcagctcacctcaacttccgtctcccaggttcaagtgattcttctacctcagcctcccaagtagctgggattacaggcatgtgccaccacgcccggctaattttctatttttagtaaaggtggggtttctccatgttggtcaagctggtctcgaactcccaacctcaggtgatccgtccgcctcagcctcccaaagtgctgggattacaggcatgagccactgcacccagccaagcctttttatgaaggcattaaacccatccatgaaggtggagccctcctggtctaatcactgcttaaaggcctcacctcccaatacctttactttggcaattaaatttcaacatgagttttggagggaacaaacattccagccatagcatacagtacataatggttttttaaaaattaaggatcttgcattatttttgagtcagttatccttataggagatatcagataaactctatttataatagtaacaccatttaaattgtgtatgggttttttttactttaagaagtatagtataagaatttttagagacactgttatttaaggttattggaatagtgtacaattaccatgaatactgaaattttaaagatgggaaaagaagtccgggtgcagtgtctgtcgcctgtcatctcagcactttgggaggccgaggtgggaggatcacttgagcccaggagtttaagaccagcctgggcaacatagtgagatgtcatctttacaaaaattcaaaaaattagccaggtgtagtgatgcattcctgtggtcccagctacttgggaggccaaggcaggaggatcacttgaggcagggagatggaggctg

SEQ ID NO: 15825 - DNA, 63860 bp, Human
  misc_feature (1)...(63860): n = A,T,C or G
agcactttgggcgtgctgagtaatgtcagtggactgttacacaaagcttaggtaacgcatctttcatgcacctggaatctgcaatctaacagatttctaaccaggctgagaggatgctctcagtcctgccagtttatggacttacagggatgtaaggaactcaagacagggaaatagcctctgtctccaaaaggatagcggagatgaggtcccttttttattttttaaaaaaacaatataatataattgatggattcagaccgttcacgagagactattacctccacgcccagctcaggcaccttctctagaatccctttcctaataatgtaagtgcccctgtcacctccatctatccatttttgttcttttaagcctattttatattatttgcttatatgccaaaccctaaacgatgagttcttgaaggttaaaattatgttttattcatcttttttcactagcccccgcatagtcgctggcatacataccgtggtgctcaataaatgcatgtggcattaactaaaagtttgctgtttctggaattcgtctgaaacctgaaacactgcaacaacatctcacttagaatgttgccttacccttttgccataattttagagtgaggaagtagaggtcactagattacgtgtcccttttatgaagaacctacagctcagggcagaaaggcacttgccggaatcaccctgccagggaactctgaaccccgctgcgccgccgctcctgatctctggggtttcaggcgcctcctctcttacaaccctctcctggggaagtaaaccccatcaagacaccaccacatccttccccagcgactcagcctggggtcacaaaggcctttacgtcccactgaaaaacggttttctttcatttgtgcccattcgttcttgcagccccttccccagatcgaagactagggtcttagtaaggagaggtaaggagggaggggaagaacctgcctggccccccgcggagctctgcagggggcgtcgcggctgcacgccagcgcccgcaccaccccaggcgggaagggagttatcacacagggggtcgcacgcagatctcggggaccgtgggtgccacgaggtcaaactggcagagggagacgctgcagctgctgtaacagcaaggaaagccgaagcccccttaggggatactttacaaaattattttaatcaccgtgcaaacctaataacttgacccaagcgcaatcacctgtattcacccagagtaaatattcctaaaatcccgttcagtgtgtctgtgtctctcccgcctctttccgtttcaggcaaatgtctaccccccctctccccccaccgttaacacctctctgcagcgtgggaaacagtgcccagcagctcagtcctccgcttcccgctctgctttttgcatcccattcggacttataggaagtagttattttttggtggtggtggaaactgggcaagaaagaagacgctaagcttggccggggccaggagaaatattgagaagggtcgttaccttccatccgatctaaaccaatcatctcaaacttggctactctttggaaccacctggggagctttaaaaattatggacgccctgatagcaccgcagaggttctgatctaattgatctgggatgcggcctgggtatcgcgatttttttaaaactcctcaggttattcccagcttgaaaactatggatataaatttctcattcctcttcccacccagaccaaaaaaaaaaaaaaaaatctaagcctaagttgatggcccagggaatctggcacctgctcccctgcaaccagccagtgctgcaaggtccccgaaaatcggcgcgagcggcgacgctaaacacgcggcggcggggcgagcgggccaggcgggcggtgccgcgcgtggccccgcccccgcacgcctatgggcgcgaggtgcgggccctgacgtcactcttgtcagggccgcggcacatgggnnnnnnnnnnnnnnnnnnnngggaggggggtggggtgggacggcgcaccgcctccggtgctggcactaggggctggggtcggcgcggtgtcttctgcccttctgcagccgtcgacatttttttttctttctttttttcaattttgaacattttgcaaaacgaggggttcgaggcaggtgagagcatcctgcacgtcgccggggagcccgcgggcacttggcgcgctctcctgggaccgtctgcactggaaacccgaaagtttttttttaatatatatttttatgcagatgtatttataaagatataagtaatttttttcttcccttttctccaccgccttgagagcgagtacttttggcaaaggacggaggaaaagctcagcaacattttagggggcggttgtttctttctttcttatttctttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacggtgagcgctgccgcggccccgctccgggaagggacgacgctccgggggtccccctccgcggccgggcacgcccgctggagcatcccccaaccccgctcccgccctgtcccgcggcgccccggccccgcgctgatgaaattgaggagctcacccagcacccttcctccccttcctcctcctccatgaaaggggagggacccctcctgagctacatttaaaagagcttcgggcacccggcctccctgggtcccgctcctgcggcgcgggtgggaggtgtaacttgacaggtcaggatcgttccctagaacgaggcacacccgcacgcagagcgagcccgcctgcggagggcagagcctcccgggctggggaggagaaaccctggggcctggttctgtgcggggcagggggcgggggtcggcttgagggagggggtttcactgcgtagcctgggttttggggttgtgttacagcttctgttactggttagtatttggaactcacgaggtgtgagagaagactcgttttcttctggtgaagggtagctgagaaagcggggtgggggctggggccggtggggggagtggtctctcggcgggaagccgtgcacgcctccagcgttgacactttcccggtgcactttttctggtgggaggggagagcggagcaggctcacgtgtaaccgcgcaggagcctcctctggcttgagccctttcttggtaagtcccaaaccttcccaagacaaccttggccttagcagtagaggaggggtacgtgtgatgaggccccaaacccggctaagtgatgccacggatttgggttgatgcgatttcatgccttcggtatcacagtagcaaatgcgaaccgtgcggctcacagtgtaaagttctgaaaggttatttggctacaaatagcttgggagtacttgcaccttcttttctaggagaggacaacctgttgcattgcaagagtttgcaatctgcagatgatagccagggacccctccctaactatcctttaaggaagagcatttgggaggaaggggctgcctgcaggcttttgcatctgtgggtgttttaagtcagattttcagatgagatggtagagggttagaatggatggcagtggaggctgtgtttctctgaagatgaaactcagaagcaaattccttaatcccagattccacccacgactgaatactagaattggcaagatccggaatgcttgttaaagacctaatgggcgagcagtacttccaggtagcaaatagctgcatacttccaacataaatgtatagaataactcaccttttccaatagctctgcttttgaaaggttttgtaaatgcatactctttgtaaattggatcatactcaaatgtttggagaagagaaggaagaaaacactttgtatttttttaaactccttttgtaaaaatcagtgtgccccagtggctttagaagcaaacacatgtgagctcagaaagttctcattctctgccaacatgaggcattggtcaagttccctcaagtctcagagcctccgagtctttgttgtaaatggaggtaattgttattttgcaagtttattgtgagatttttgagataatatatggaaagaaccaggtatccagtaggtactctaaacatgatgttaaagaagggtggaaggtccctgctttaccaaaattaagaccactaactcactggctttgtaagtctgaatgacctcctattgctgctgtgatgaattcctggaagataattcaagcctggttattggctgttgttttcttaaaaatgacagcagttgtatataatcacagatgttatattcctattttaggtttaagttattactcttctcaaataatgtgctgagactgttctctggtttttatcctagatcagcctgtagccctgccccaaggactagtgccttctttccaaagtaaataggaagatgttgaaaaacaggcagagatccacgtcctgcctgaacttttaactctagatctacaaaagacagcagccagagaaggaccctgccattcgtgagaaatagtcttataacaggccaggaaaagtgataaaagagcggtattgtttttcttttctttctttttttttaagtccagctttcccttcttctgcagcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtaagtgccctgaagattctcccttcagaaagggaggaggagggtgaatgggacaggcaaggtagagttagcataaacatcttaacactcaggttttagcaaagatcctaagagaggtaccttcttctgctccactcctggcagaggctctcccactttaatgagcatccatatcactcatctggagagtccggtaaatacagactctttgtatctacccctagaaattctgattttgcaagtctggaatgagggcccaggaatatgcattttaaccagctcccccatgggattctaatgcagctgatccaagggctgcagtttaagaaataacttacagttaatgatttggataatttaagcctccatcgcatcttgtatctcttttcctcattccctaaacacgtagataacaggtagactctcaatagggtttggtttacctatattcactcttgtctgtcctgaaggaaaaaaaatgtgagtagggatatggggcaggtatttttttttccatccttttcatcttgttttgtcattagctgagaagtagaatctaaaagcaggctctcatattgtgtttctgagccttcttcaggaccagactccatctctctcgttgctattcccataaacccaactgttcttatctttttttttttttcattttcatctgtctatcacactcagtccacctgtatcaaagcccacaaggctgcaaggtcagctgtaaatgatcttgaaatagtacacaaaaatatcacctgaaatgaccagtacttcaaaacccactgctaatgctcagatataaacacagattgaaggagctttgaattcatgcctttagcaccctgtagtaccaaatgaacaggaagaaagacgatttcatgtgcacaggtaaccaggaacaaagattcagccagataaatcatccggaaggtcacagagctgagggccttagctgtgggggaagacagaaagcaggacaatgcgaaacttgtgctagagattgttactgaactccgtgtcctcgactcttgtagaaatttctgtggcacatggagcaagatttaaatggaaggaaatgatgtaaaggaggaagagaatacccctgcctcgatatattcatattgaagttcctcctttcagacctctgtgtgctggccccttctccaaaattcactttgaattataactcaaggccactggctggaatggaattaattcttagcctccagccacccctggaggctgtgggagcttgggaaaacatgcctttatgtgatcctgatcccctgctacttagaatgtgcggtaccactatcttcaatttttttgtaggaacaagcaacaaaatgaataacccttcaaagtgggaaaacagccaggagagaagggaacagagccccagtgagagacacagttatgcctcggtcattgtgctctgtagactgagaatcaccactttgtagctgtgtgaccttagaaagcaacatcatttcttggagcctcagtttccttttttgtagaaggatacaatttctatttgattgagttattgtgaaaattagagataatacgtataaagggtcaactgattagcaatgagtcttctatttgtggaagcaattgtgatcattgttgtatgtgtcaacttttattacttatttcaatccctgtcttctgaaatatcttcgtaaggtaactaggtactgtatataacccttcctctggagagaaatgtcaggagattttgcccagtagttactggattggggtattttgaccaacacttgtaatcaactgacaagtatttcttagtcccctaccaaatttaggatgtgtaccatgttaggaatactatattttttcccaggagacctgcacatattgggtgttcacaccttggttcctactgagagtcaaaaattggggttttgggatttgaagcagcttgaaaactcatttgtcagagctcattagagtcagtattgatcagtgactctcagaaggcttggaatgcccaatcagagttgcaatgcatagcaaagaactcctgagtttcaggggatgtcattttgtaaggttctggtggaaagacactgggatcaaagggaacactgagggtctagaaataagttctccatttaaatgtcttattttaaataatggaaacacacttcaacatagtttccttcttggagttgaaaactcgatagtcctcatagaaaaggaaaaaagttaaacctcgtcttcaaataccaaactcaggtaaaataacactctgctgttcatagattgttgatcattataaagatgcaaaataaaattctaagagatgttggcctgatggatggatattgcaagcaaacctgaaaaaggagaaagttcttgattattctgtgtggctcacaggagtgaccagaatagaagtaccaagttaatcttgaggaaaataagtcctcagaagggaagagcacagatgtagccttggtcattctgggagctgtataatttcagtcttgattggtgtttctcaaccttggcactgttaatgttttgggtaaatctttttttttttttttttttttgagacggagtctcgctctgtcgcccaggctggagtgcagtggcgcgatctcagctcactgcaagctccgcctcccgggttcacgccattctcctgtctcagcctcccgtgtagcgccaccacgcccggctaatttttgtatttttagtagagacggggtttcaccgttttagccgggatggtctcgatcgcctgacctcgtgatccgcccgcctcggcctcccaaagtgctggaattacaggcgtgagccaccgcgcccggccttgggtaaatcttgtgtcttacgctttataggatgcttagcagcatcgcggcccctacctcctagttgcaagtaggacccccagtgccccagatgtgacaagtaaaaatgtcttcagtcactaccaaatgtcccctgggcataatacagtcactcccggtggagaaccactggtctagaacttcaatttggacagcaaaatctggacttactttaggaccctgtcacacgcatggataaactacctgcaatgctttatggcaaaacttttaagaaggtcaggggacattgggttgccaagaagaaatagaatattaataagagcataattatacactttagttaataaaactaagccatcaggctaatcaggagataattgcagagtagtttaccaaacaattgtttttggctattcactcagcatgcatcttttgagctatgctccgttgtggtgttagtgcttcttgtttggttgaagggcaatgaaaccatgagctgataaagtatgcatttctaggtctaccccaaggatgtcttggaatgacaaggtgagcattcttgtgaatatttatttatttatttacttatttgtttatttatttttgagatggagtctagctccatcacccaggctggagtgcagtgacacaatcttggctcgctgcaacctccacctccggggtccaagctattttcctgcttcagcctctctagtagctgggattacaggcattcaccaccatgcccggctaatttttgtatttttagtagagacggggtttcaccatgttggccaggctggtctcaaactcttgacctcaagtgatccgcaccccctcggcctcccaaagtgctgggattacaggcgtgagccaccacaacctggcccatttttgtgaattctcatactatttaccatgactgccccaacccctttcttatcttgagcaccccatccctattcctctaactgtctgatcaaagaatgaatcaaatatctgaagaaatccagttttctttcaagaaacaatccagggattcattaaaacctgttgtggctattgtgggatcaccaagctttctgggctgacatcttaatgaagggaagagtagtggttcttggaggccagagctaactgcaggggctcctcggtcatccaaggtgcagtgtcctgaatgttcctaggccagcagagatgacaggagtcattctgatgacttcaatgtttgcattttagatactgtcagaggtgggatgtgggggtgctctcctggagggacgaatatgtgctgggtactggaaaaagaagaatctgtttgccatgagaattgagcgattgctttaaggacagccatccctttagggaaagtcatctatagcagacaaaggcagagttatttttatattacatgcttgtaaagccagatttgaaattatttcctctggtggtttttctttgaatagctggggggtgtcctaccactgttaggcccatattccgctgagaattaagaaggctgtctttctagttctgagcacggagactgggttatgatgaaggctggttacagagtaaagtgaaaacccttccatgtggttgtgtgtgggaaaaggatggcataagtgggtggcacaaaaggagcgggggtgggggagaacccattgtacctttgcaatatggagtttgtattctgtttctgccgaccttccttgtgagaaggtttgggtatggaaggaaaacgctggcctgggaatctgagtaatgatggagggaagttctgtgcaggtgattctgggtttatggaaggtcagaggattctcttacttttcccaatattatgaggtgaagcttcgcttaagggcgtgcagttcgtgtatctttccagtccagcagactgataatgtctgcaggttgggagcgccatgactgatagtagctgtgcccggtgtctcaagcatcttggaagtgctgttcattcatcaggggctaggagatcctgaaggggagggagtctgcatggttctggagacaggtagacatttttctgtttcttgtagagtttatcttctccacggatccctgtagaggacaggcttgctgacattcacaggatagtagtcccaagcctgtggcaaaaggtatttttgggtatgtctggaaagcaaggcaacttggtggttaggattgtaggctctgggctcaggggcttgggtttacatcctggacccacccctggcttgccgtgtaactttgtgtcaatttcttaaccctttaagcctcagtttactcgtcaatacaatggaaattataaatggtccctctcccttggggttttggcagggttaaataagatcgcatgtgacaagtctggccagtgtgtattgcacgagtactgggtgcattcagctgttatggtgtcagtggcatgaggtacagaaaggaatgactggattcccaatccctgttttctatttagggatttatttatccagtccccttccctctgcaaaaataggacatgctttcatgcattttttttctttcccatcatgtccaacacttacagcctgacctttctcttccttctgggttgggacgaatcggttccctgatgttaaccccgcagcatggcttctgggttaccaactcctgttttgccaatgtggaaacagccactgtctgggtgcccagtcccccagctctcgtgtgagccctggcaaccctggctgcctgcctgcatgaccgtgtgctccaggcacgtggctgtgccctgtggagcttgcccaacgctgtgtggtgtgctggcttgcttttttttttttttttccctcctccccctcgcttcccttcccaggagaatgacagcaagtgccagcaagcaattgtaatcctgaccctggcatgagaaagctgagctctggagggcagttcagatgccagggaaacctgttctgtccaacattctagccagaccccaaacctggccctctctcctgcctgtctgcccagaggccctgtcttctctgcactgctgcggtgggcaggattcctggaggccagctcctgccaagggtcttggcagagtctttccagttcagcactgtgcctaccagactagaaaaatagcaatataaagacagaattaggtggaggagaaggaaagggggtgggggaggtgggaagaaaaaaacccttgataacatcctaatgtagaaagccagaggaggggaagacagccgtgatttattaggtttctcagaaacctctcttccaattagcactaatcacttttacccaggaatcattttttatgtctcagcaatgaaaatggaggtaagagggaaggtagtagagaaagtaataagatgaaaaaaagtagaaaataacatattagagaggtacagggcctgtgtttgattctgtaatgggtgtgggtgagaatattggtcacagctaatattgattatagtatttggccctcccccagcaaatgtcttgtcctaaagctactaaaccactgtttttctataaatttaaatttccctcagacttaggtgcctctgtctcaccatgcacaatgtctgtcagaatgtcctgtgtttgagacaccagtctatacgggcaatatagcagtaatgttttttagagcacagaattgaataaacaaaacagcctgagtgtgaatcctgactttgccactcattagctgctcacgatctcaggcaagtcatttaaatgctctgagctttcagtttctcatccggaactttggaataatcattggacctgcctcataggactgttgaaggtcatatgagccaatgcatgcagagtaattgtcacagtgcctcgcacacagcaagtgcttaataacagctgctgcaagcagcaccttcaccaccatctaatctcatttcccatgggaggaccaagcgtggggctcagaaagagtcttgatacttttcccttcctagctaattaagaacactggtcaagaaatttggatttctctcctgcttctctgccaagtcttgcttgcccttctcttagcctttgaattttaggtgaccttgagtagctaactgtaccctttactcattcttcctggctcatgggattaaataaacaaaatgcattttgaagaagtttttttgtttgtttgttttttgagacagggtcatgctctgtggcccaggctagagagcagtggcgcgatcatggttcaccacaacctcaacctcccaggctcaatagatcctcccacctcagcctcccaagtagctgggactacaggcatgcaccaccacacctggctaatttttgtattttctatagatacagggttttgttatgtttcccaggctggtcttgagctcctgagctcaagcaatccaccgaccttggcctcccaaagtgctgggattacaggtggaaaccactgtgccctgcccaaagaagttcttgattagatttcttccatgtcatatttgctaatagatcagtcagttactgctaccattgaatttttaacaatagacattaataattatatttaaaggcaatatagtgaccttgggggtaaggaaaccataaaggtatgttatggtgtttcagaaggagaaggttcagtttatcctccggcttgcaagcaagactttacataagcattccagaataataattcctcctctccccaaggggttctttaatgagtaaatccttaatctttctgaaccttgattgtctcttctgcaaagcaacatccttgttgggtttttgtgagctttctaaagctactgtgcaagaaagatccagcttggtgccctgtacatagtagccaagcctttaccataagtcagttcagttacttttctctaagaaatgataccatgattagaaaacaacagaggactttgggaggctgatgtgggaggattacttgaaaccaggagtttgagagcagcctgggcaacatagcaagacccatctctacaaaatatttttttaaaaatattagctggatatggtggcacgtgcctgtagtcttggctacttgggaggctgaggcaagaggatcgcctgagcccaggagttcgaggctgcagtgagccttgattgcatcattacactccagcctgggtaacagagtgcaaccctgtatctaaaattaaaaattaaagagaaagcaacagaggaggttttaggaggcgaagagcaaggtgtatggtcccagaaatagcatctgtttttgctctgtgctttggtgttttgatttgtgcaccctgaggaagagagacaagagtacaatttggctgctagtttcaagagacagtgatttagtagggaagataagacttttaggcaaagtgatgagtgacaggacaaactagcatgttctcagtgtcaaatgacgggtatatagaggcctccaatatctgctgaaaagaggaggttgaaagattaatcaagaaaatgaatataaataagggagcagtatagccaataagagctgccagacctcacaggaagaagcctttgctcaaggcaaaggtgcctggggcgaggcttcttggaagagttgtagcctgtgatgggcccggaaggaggggtgagagagccagattggagaggttaatgccccacaaagttatagaggcaggaatgcccacagggtgttttaggcaacagggtgtagatccaatttggctggtgcagaaaattcatatgaaggagtcagggagatgagtcagagaggttggtgccagtcaggctgacaacttcatgagtaccaggctgcagagcttgaactttatccagtaggcaatagggagccattgaaggtttttcagcaggaaagtgcatgtgaacatttccacttgagttcaaggttggatttgaaacatttttagaaacttgacaatagtttcctctggcaagccaggatttccttatttttattattttgaaaataaatactctcccttgaacatcaaacagcttttcaaaacacgatgttctaatgatctagagaaagtaattcaaaaacacagggtttaggtttcatttataaaacccataattttggtgattgggggaaacactctttggcaaggaaatagtttgagggatttgactggttcagaatttaaaagtccaaaagcaggcctggtctcataggagtagaaaaatagattttaataaacccaactcattaacgttcatcacttttaaatgcctctattttatacagcttactaggtttgcaaataagtatattgaaccagatgttgtgtgtgtgtgtgtgtgtgtgtgtgtgtgtgtgtgtgtgtgcgcgcgcgcatgtgtacgtgggcatgcgtgcatttgggtttgtgggtgggggtgggaaggttaatgtctcagtgatacaaatagtacctgattgtaaggattacctggggcagtaatatcaagctaaaaatacttagccaagtttctggctagcttaaataagttttactcctgggaaacaaaggagtcattattacagttttgcattcttgagtcctgaccttgtatttgtggctcccttcttccctgaaaacagaactgtacatcatgcttagatatgggatgtgtgtgtgtgtgtttcatattgggagtactagtaaaggaaagggacattgtgggaggggatcggattggggggggttggactgctgaatgtcaagtgcatgaaatgacttgctcaagcaccccctgaagtgtgctctgatatcaagccaagatttcagaaggctgaaagagttgccataacccaatctagttcacttaaatagaaaatagctgtcaaggtgggcaatttcacctccagctacatagagtagacaattacaggagtgttggcagaatcgagtgtctgctgggggagaaactatagtatttgtttctgttaaattggcttgtggtgggtacagactccatgaccgaatgtggaaattcctaaaatgttggttttccttcttttctgacttttacaaactaatgttactctcttaactcactacccatccaatctcattttctttcctgaaaaactacacagctcccctgtcacacagggttcgtaaaagtttcgtttttagaagtttaatctgggatttgtttccttaatgatctttggaagaatgctttggaatttgaggtcttataatgagacatggcttgtggctattaaaccctgttgcctctcaaattttgcctgggagaccctagattcctaaaaacaatgagtgcatgctacagaaagatgcttcagggagctacaacactaaatcatctgtgacaaaatgttctcttagaaagtggaattgcataaatggatcagcagaaataaatgctttggcagaaattccttgagtggggaagagcaatgctttcttttctaattagctctgggtaacagtctgctgtggtgtctttgctgtggaacccaggcatggacagtagagcaggaaagtctcatcactgctctctaagtgcttctgcacttaatggaaagagttaagcacgcctgtccatttgtacccaataaatgcctcttgaattgatttgagtgggaaaagcgaaggtttgtttgggggaaggatgccaccaggccctgaccaatgggaatcaatgcagcaaaccagatgaacaagatcatctagatatgcagtaatcagattacccagaacagaaatctcaataccccaagatatgaggggttattttaaggatagtggcaaacagttaaactcagcctgccctgaggattgagcagaagactgaattcaccttagtcattatgatgtgggctgagttagtaacactgaaggagaccatgcaggcttttactagagaactatgaaaacaggacagagatctcagatccaattagtactggatcaaaatagtattgtttttaaaaggccaaaggccattgaaagatttatagaggaaagagtaagtaatataaaatgtaaagatggaaataaagccttgaaagagttcctgaagacaagaagagagaaatttgcagaactgaccttgtaagaatttcataaaattcatttcattatgattgatttctttgtattagtacaccttcctggggaagtgagtatcttttttcctcataaaatctaaagcatgtttatttcaaatgggcagtgacaactaaatgatttaaaaataatatttatattcatgtcaaaaaagttatttttaacattataagtgaaatttacccaaacatagtaggccagataatgatatttagttattggcttcctggaagactgatgacaggaagattcagtattacacaaactaggtataaagaagcaatttaggtctacttattttatttctcctttgaacctctcacttgcctgacagtagcattgcattgattgagattttatgatcattttatcttgaattggttaaactaaaatttatatctttgtcttctttataaagaaagatattactagctgggcacagtggctcacacctgtaatcccagtgctttgggtggccaaggtgggaagatcacttgaggccaagagttcaagaccaacctgggtaaccgagtgagaccccatctctacattatatatatatatttttaatttaaaaagaaaaaatattaccaaacagattaattatgcaaacataattttgggacacagagttaacttgaggacaaaatagtttttaaagattttaactgtgtatatataaattaatatcctgaaccacaagtgcgtattagtgaatagcaaaagaatttttttcattctgacatttcagtaattcagattagcattcccaccaaattgttgccagttatctccatctgtccccttctccattcccccccaccactcaattttcatatctttaaaattaaattttcatataagtatatggaaccaaaatattattttcattcatttacctgccaccagagaggatgtcatcggccaacccgcaaaggtggtgggatctaccagccatataactcttctgcatttgttccctccattgtaagtgagggtgctgatacctgcttcagaggattcctggagaagtaaatgagatgatacatgtacagcacttagaacagtgctcagtatataaatggcagctttcagcagttttatttttattctacaattactattccttctcttcttccacctccatggctattttatggacacttaagtaggaacacatcttgtgttacagtaatgctatagcagtgatggcctggaaactgcttttgagttattgcagggaagaaaggatcaggaagagatacagcaggtgagcaccctgtgtttttacacctgtgagaagatacatcccacctcaaacaccatttgtggtcctatcaccctagcatgtcacagtgtaattgcctgctttcttggatagctctttgaatagatgtatgctctgtgagccctggctgtgtcttccatctccatatgccctgctgtgcctgcatatgtcttctggtgctatgcctggaagatcttgagtgggtaagggtgaaagggaatttagaatacatttcctttggtgctctagagcctttccaacatactgccagatttgtgttttaggtttcttctttttacccttggtgacacttctgggccataaagtagtgaactggctgtcctctagttgttgttgatgggctcttgagtgatgtggaggcaggataatgggttttcaatggtcacaaaactccctggccttctgctctccttagtgtgagtctctcaaatacataattcttaactctcctttctctgtaccagagggaaacgtggcagagaggggtccagataggaaagaatggactcttctgctgaagtgaaatggaaatacaaggaaattgtaaaaacaaaaatagattatttggaagaaatgtctaaaaacggtttttacacaaaggggacaactagaagttgatcgatttaagaattgagattaacctggtatgactttggtttccagctagattacagctgtggggttcttggcccttggcatgggtcacgcttgatacagtatgttgtgcactgtacatgtggatgtggcagggtaaggcttttaaaggtacagcagtcttgagggattacaaagtacatcagcatgaaactaggcaagattttagcctcttgtgagggatgttgaatttcagctaaagctccctcagcatatttttgtatcccatcaaatatctctgagtcgcggccaggcgcagtggctcatgcctgtaatcccagcattttgggaggctgaggagggtggatcacttgaggtcaggagctcgagaccagcctgaccaacatggtgaaaccccgtctctacaaaaaatacaaaattagccaggcgtggtagcaggtccctgtaatcccagatactcaggaggctgaggcaggagaatcgcttaaacccgggaggcggagattgcagtgagccaagatcgtgccattgcgctccagcctgggcaacaagagcaaaactccatctcaaacaaaacaaacaaaacaaaaaatatctctgagtctgtctccccttttataaaagagtgaacacaatgctcctaagtttaaatcagataaattcagtatgaaatcatagcaatagccattatgtgttaaaaccagcattgtcctaaacactgactgtaagtagttgtagcaaatcaactcatattagaaatgatattggtccctggaatttagtctgttcccaagaggactgaatgttgtgaatacattgccaaagtatgttttctttttttctccatcagcccttccattctgactacaggcagcttaaaaataaatttgggcatatctcagtggccaaaaaccatggagatcaggatgaaatcattttcaaggcagaaataacaggcgttgataaagatattcagagaaacacagtcctaatagcatcggcacgtgattgtggggccctttagtcaccaagctaaattgaatttggaatcaggggtctactgaaaagccaggaaacttttgagcaagtcacttgaattctgagcccccatttcctcatccagaacatgatggcctattttgcaggattgtcatgcaagttaaattacattaaacaagctatcagtaaaaaggatgtgggactgtgcctactcggattgtcacccagtgagttttaattcggagtccgaatctggtatttaaaggccacgttctaaaatgcacttgtagttaatatctttggagtcttgcttccaggtttttgagttgctggactgggtctttgtaagctccgtgatgctgctttgggaacacaagagatctaatctgtagtcctggctatgctattaattgcaagtataaccttaggtgttcagcttctctggcttttacttcttcatctgtaaaatgggaataatctacgtccttctaacttacaagtatgtcataatagaaaactgaccaaacagtttacatcaatgtccattattatttccattggcttttaggcggcaagagatggaaaacacatagcaacaatttcaaaggtaggccagttccaaagagcactgaacttggagtcagccaatctaggttctaaagccagtttgtcagcattagatgtctctggacaggacaggtcaccaaatctctcaaagcctaatttttcttgtctataaaatgtaggtgctgtttctagctctacgactctgtgttcaaagactactatgtgctggaagacgactaacattcacattttggtgaatgtctaaaaaaatttaaagcctcttgggggtaatggagctgctcccaagccaagtagtagatggattaagaatctgacattcttccactcataaaggatgacagagtttaaaaactaacgctgaaaagcaaaaaacatttgacaccttttggaataaaaaaatcaacaataatcaagctagttacttccttaaaaaatggtcttcatgccgaatggaaaccaccagattctctctggtgttcagcattccagaacaaccctgaaaataaattatctggctggaatcattgctccaacggttggatttcttagtggtcgtttactagccagacaaaataatttttttataaagaaaagaaaaaaaaaaggaaagcccacagaaggaaacaccccagggcccactgctggctcttttgatggcaacttttctaggaggacagtggccagagggggcctttggctgctcctctaggtggctggagtcaggtttgtaggacctgcctgtgatagtaggtttcatcttgcaactggctctgatggattagtaggtgcctgagaagtcattttgaaagggtctgaggctcggtctgggctcagtgaagagttctgtgattaattagtgatgtctgcccttggcttgggtggggcagtactggtgcctggtgtttgctgtcctgccagagcaggtttggaagatcctttagtagttgtccttctactgggcagcagatcaaggactcaggccggtgttgcttccgatgtcctggaaaagtgttttctgagcctccagcacataatgttttactctctgaaggaggcttattctgattagcttaacagagggtatggaagaaaggaagtctattgattcagctccttggtcacgagacaggaattgcaaggtggagggaagctgtaattccaacacgtaagtccatggatactccagtaaagcacaggcataggtgccactgatccagcagaggcagccacaaaccacaggccctggtaagctgcctgtggccagaggtcatggctgcagattccagggaaactgcgtcctcggtaggcagtcagccgtacactccatacttgcgattcttgatatttgaaatcaaaatcaaagtgcagccactttctttaaggaagctttggagaacttgccagtctgtttaggattgaaggtgattctcagttatccatgctaaaggaacagataatctgaagtttatttctcctcagctgtggaacgtgctttgcgtttttgtgctgttgatctgctttcctggtaaggtttgaactcttcagatttttctttctataaagaacggttgagggggagtgtagtgctttttgcagctcccccagtatgtttctaacatagccagccaaatgtctctgagcccttccagcctcctaactttaaatccatgaactgcaccagggaaataatcaaccagttgcaatttgttgagcacttactgtgtgctccctgggatccaggtaactgtgtgacaaggacttgatccaagagtgtgttgggcaatagggtgaagtgggctccaggttaaacattggctatagggatttacaaaagagttcactgagagtgggcctgacttcctctgctactgctgtttcctgttgtttccagtaactgcacttgagctctgcatacggttaactttcaattatcctgaggctgattaactggtttgcagattaaccaaggtgaaggctcacctgggcctgggagtcgctcatcaactcagctgctccataattagctggtgatggctgattgcctgccccatggttgggaagcctgggcactgggcgactgcaggggagggggaccaagggatgacttcttccaggaccttctactctctccaaccagaggtgccctctagccctgtaaacttctgcattctccagcacagttcctgagaggttcagaagttacctgggtcctggtgctctgctcctgctacctttcagctcctgcccccaacaccctgttcaaattgggaacaagttgaccacagggcacagtgaatttgaaagtccggagattaagtcatatgttgaaagagggcccagtgagcaggggccactaatcccctttcttcctcaacctaggaacctcctcccttcccaagatatagatatatatagattgagaccctgagcaatggatctcttttgaggccagtggagaccaagaccactgaagcaaggagtcagggactgcccacaacagcaaagctccccagagtccaggccaccccatggtgattgtttgggttccctgtgattgcctcccatggctgccctcgttcatagagagttgactgcatttgcctgggtccctgtggggtgagagtatggaagtatgtgtattagtcacaccttacaccagaccagaagatatacagtttaacctaggagtcaagctcctgctatatttggaatggtctcagttttgagacgtggtaccttggatcccaggtatatccaaagtcttgagagtgtccattgaggactttggtctgtagccaccaagaaagagtaaacatttgtgcaggatcatgtttgatgggattccatggattgttttcatttcttaagcagcattcccctgagcctttgacatgtctttccatctctggctgtgttctcacttgcatttgccaggcctgcaatgcctctgccttgatacaacacagtgtgccagcagctgcagtcccttttcagccagggccatgggtttccttgggtccttctctctggctcacgttttccagggctgttggtgtgtacagtctagagatcacattttattaacacaaagaaatctgcttgggctgcctggctcttgcagtcacgtggagagaaatgtgttcctttggtccttcagcctgcagcactctgtgcaaaatacagcagagagctgggcactgggccaagcttacatttcacttcggaacacactttcgcatcactccttggcagaacatccacggtggtgtctatttggggagtaagttagagaagtgttgtttgcctcttatgagtgtcgagagataggacctttagaaaatgttttacttttgcgcctgtcttcatcttcttcgcggtgcccaggtactgaggtgatccagctaaatgtggcagtgatgcctgagagaagccccttccttcctcgggccacccttttctcttgcaaaatcagtaaacagagccaggactgcctgggacagggaaacttaggccaaggtaataacatcaaaaccaaagtcctggaactcttgagtaagctagttaccctcccagataaaacaactttgttgtccaaatcttctttccaaagatctaagacctttctaatgttggtccaaggccagccatggaaggaaggaacttcagcaagccgcctggaatggcaaacactgttaaaataaacaaatggacctttgccatttggttttccctgacttgtctatttttatttcttttctccccccacccttgtactttacctctcgatagtacccccctttctccacccctactcccattctcatctcacttttctcaggggccaagctggctgttttgccttcagtaaaacaaatatctaatttcaaaaagaggaattaggagaaagaggtggtgtaattcatttcttggggtaatctcgcttctctcagctcctctattgtctgttcttgtaggtggccacctgaagcttgacttgcttttgaaaataaagttggttttggaattttaaaccttccttaggaaagacttgaatggttagaaaacaaagatttattggaataataatgacgtttcttttctcaatgaaatagacccctctcataacaaacggttgaaaataaactctttttccccatcacaccaagccataaattccataaggatttcccagcgccaagccttattcagagtcttatatttactgctttggaatgttacttttgccatcagtatcatccagccaagcaacaaccaatcaagacttacagaaacttttccagctagatgcatgtgccaggctgcttcttccttccatgatggaaggcctcccttgtcatagaggatgcccaaaatctcagggactgggatacagcctcctgccagtctgtgggtacagtctttgcttactctgcagaagggaggtgacagaaacccattccacctgtctcagaaacctgctggtaattaactttaaaaataatgccaagttctcacgtggctggtagatgcattagctcaatcaggggggaggcaggggagaagcatgctgcttcaaagagtaatactgttgcaatcacattagtcattccaggggaggttagataaggttattgaaaaggtgaagtcaccctgtacattgaaagaggtcttctgaaagtgttgagaaatagttgaagttcagaagttttatttggagctttgctcccccttccccttgtaaataagaccagtattttttaaaagccacattttctttgtttgatcgatgaacactctcatagttgatgattgagagtcatctacagccagtatcaagggtcagttctgcattactcatgtgtagattatctctttggtatactagccatggtcaatgtgtaagccctggccagttgccacccagcataacaacaccataaggcatctaccccctgcctgcacttgggaagtgttcagggaatgtaatttcattttataattaagtgaaacaatgcacagtgcatttccttggtggattctaacagcaggacagttattattcagaaaggactgtgtctggactactttgagaatcagtagtttaagttgttgcacctgtgtttggcctatcctcataccagtgtaaatacttcaatcctgcaagattttctcattttgcataaaacaggtgaaggtttgttgaagtccatcttccaaactcccaaagtactctggataccttggtaggtccttgtggactccctgttgttgacttgcaagtttcccagaggtggggactggcttttatctccagcacctaggcagctgctttgtaccagagttgatatacaggaaacatttgttgagtgaatgaagtaacaaagatactaatttcattagaaatggtttgaaatgagtgcttgtgttggcagaattttgtccaacatggttggtctttgcaaagggttatgatagtatgatgcacgcctttgggccagatgtgagtcaggatggtcttggaggaggcgaagtgcagatatacccctgctgataggctcctcataatacttcagtgagctgtttttctcgtgactgtttcactattttctttttttcttttttctttttcttttgagatggagtcttactctttcacccaggctggagtgcagtggcgcaatctcagctcatggtaacctctgcctcctgggcccaagtgattctcctgcctcagcctcccgagtagctgggattacaggcatgcaccaccatgcccagctaatttttgtatttttagtagagagggagtttcaccatggtggccagggtggtctctaactcctgacctcaagtgatccgccctccttggcttcccaaagtgctgggattgcaggtgtgagccaccacgcccggccagtttcactgttttctgattggtaaacattcaaggctggatgccatggctcacgcctataatcccggcactttgggaggccaaggcaggtggatcacttgagctcaggagtttgagaccagcctgggcaatgtaatgaaaccccatctctaccaaaaacagaaaaaaattagccaggtgtggtgtggtgtcccaactactagggaggctgaagtgggaggatcgcttgagcccaggaggcagaggttgcagtgagctgagattgcgccactgtactccagcctgggcaacagaaccacaccctgtctcaaaaaaaaaaaaagttaaattaaaaaaaatattcaagaatgaagagtgttttcagagaagaggatttagatgcttacaaataaaagtggatattgaccccccaattttccaccctttaatcacagagacatgattggaagtcagcagctccagcctgcatgttcccagatcacctgtaagagttcttaaaactcatcccacaggttcttaattgggatttttaactgggtaagtagagaagctccatgttgggtgtggggaagggaggatgcagatggatataaatttttttaaaaaaacatcaacttatgtttctttggttaatagatgcaggagaatgcctcttctctccatgtggcatgtcagggtatagcttctttgagcacaggatttggtttacagaatggcatgtctccccatgccagccagtgataaggggcactaaaacagacttggccttgctaaaggcttccaagcaccaggccatgagcagttgaccccaccacagaggtatgtacagctggcaggaagctgcccttctggttcactgactcaagagttggagcagattgatccctggatttgcagtgccctcaatatcgctgcacagaattcattctatgtaccccaggccctatgtgcccacagcaggaaatatagtgtgagcctctggcaatatccagagttgcttgagcctcctcacatttgcttctcctattcagtttagtgtgcctcagtttactaatatgctggggaaaataacacccctcttgccaaggtgagatagcagagttctctgcataaaatagtgcataaaattattcctatgacaaggcatttgaaaaattactttgagaatgacttaaaatacagaacaatttttttaaatgtggcaaacatccttattcttatcacccagaattaacaattcagtacagttgccatatattcatatataaatttacctatatattcatatgtgaatctagacattgcagattcacttgggggtctcagggaactttttataaaaagaaatgcatttagttcgtaaggcctgattgagataattccaagtctgttttctcagctcttaatccttcctagcactttgcattcattgtattaataaataagcctgttttcagcctagttagaaaaaaaaaggccagcctcattcattagaattctgcgttccctttggttattctttgttggagagaagggggctcactggtacagaattccaagatatttcgctttggaatgtgaaaggagtctctcttgacaacccaaggagaacctgcctcagaatgatctttcttcctcagtgctgaaaaagaaaaccagacaaataagcacaaccaacattaacagaaggccttggtacagcctcaagaattaaagtgctgtactctatggaaaacagtgtggaggttcctcagaaaactagaaatagatctaccatatgacccagcagtgccactgctgggtgtacagctgtacttcgttttatcggacttcaccatattacactttgccgatagtgtgtttattaaaaattgaaggtttgtggtaaccctgcattgcacaagccttttggcactatttttccaacagtatgtgttcacttggtgtctctgtcatattgtggtggttctagcaatatttcaagtttttcattattattatatgtgctatgttgatctatgatcagtgatctttgatgttactattgttattgtttgggggcaccatgagccacacccatataagatggtgaacttcataaatgttacgtatgttcttctgactgcttcaccaactggccgttctcccatttctctccctctccttgggattcctgttccctgagacacaacaatattgaaagtaggccaattaataaccctataatggcctctaagcactcaagtgaacagaagagtcgcaggtctctcactttaagtcaaaagctagaaatgagtaagcttaattttgaaggtaggtcgaaagccaagacaggccaaaagctaggcttcttgagccaaacagttagctgcattgtgaatgcaaaggaaaagttcttgaaggaaattcaaagcactactccagtgaacacacaaatgattagaaagtgaaacagccgtattgctgatatgaagaaagtttgagtgtcctggatagaagattaaaccatccacaacattcccttaagccaaagcctaatccagagccagggcctaactctcttcaattctgtgaaggctgagagaggtaaggaagctacagaagaaaggtttgagctagcagaggttggttcatgaggtttaaggaaagaagccatctctataacaaaaaggtgcaaggtgaagcaccaagaaatgatgtagacactgcagcaaattttccaaaagatctagctaagatcattgatgaaggtggctatactaaacaacagagtttcaatatagactacacagccttatattggaagaagacaccatgtaaaagttatagctggagataaatccatgcctggcatcgaaggacaggctgacttttgttagtgggcaatgtagtgggtgactttaagttgaagccagtgctcattcactgttccaaaaatcctagggtctttgagaattatactaaatctactcttcctgtgctctgtaaatggaacagcaaagcctggataacagcacatctgtttacagcatggtttgctgaatattttgagcccactgttaagacctactgctcaggaaaaaaaatcctttcaaaatattactgcttattggcagtgtacctgttatccaaaaactctgatggagatgtacaagaagattaatgttattttcatgcctgctaacacatttattcttcagcctatggatcaaggaataattttgactgtcaaatctcattacttaagaaatttactttttaagacaatagctgccattgatagtgattcctttgatagatctaggcaaagtaaatcaaaagccttctgaaaggattcaccactctagaagccgttaaaaacattcatgattcatgggaagggacattaattaactccaacataaactgaagttagtaggagttgattgcaacccttatagtggatgactttgaggacttcaaggtttcagtggaggaaataactttagatgtggcggaaatagcaagagatctagaattagaagtagaacttgaagatgtgactgaattgctgcaatctcatgataaaacttgaatggatgaggaattgtttcttgcagatgaacaaaggaagtgctttcctgagatggaatctactcctagtgatgatgctgtgaacattgttgaaatgccagcaaaggatttagaatattacataaacttagttggtatagcagtggcagggtttgagaggatcgactccaattttgaaagaggttctactgtgagtaaaatgctatcaaataacaccgcgtgctacagaaaaatgtttcctgaaaggaagagtcaattgatgcagcaaacttcattgtcgtgttattttaagaaactgccacaaccaccccaaccttcagcaaacaccaccctgatcgattagtagccaccaacattaaggcaagacccatcataagtaaaaatggcccactaaaggctcaggtgatctttaccattgtttagcaatatagtattcttaaggcatgtacattgtttttagtcataatggtattacacacttaatagattacagtatagcataaacataaattttatatgcactgggaaaccaaaaaaaaaatgatgtgacttgctttattggattcttagctttattgcagtggtctagaaccggtcctgcaatatctgtgaggtatgcctttatatccaaaggaatagaaatcagtctttcaaagagataccggcattccatgtttattgcagcactattcacagtagccaaggaatggaatcaacctaagtgtccatcagtgggtgaatggacaaagaaaatatggcatacatacacaatggaatactattccaccataaaaaagaatgaaattctatcacttgcagcaacatagatggaattggaggtcatttatgttaagtgaaataagccattcacaggaagacaaatattgtatgttcttattcaaattgggagctaaaaaggttgatctcatggaggtagacagtagaatgatggttaccagaggctgggaaggttagcgggggctgggatgtgggatttagagaggttagttaagaggtacaaaaacacagacgaaataagttcaagtgttcaatagctacagtagggtgactatagttaacaaggatttattgtatatttcagaatacatagaagatttgaaatggtcccttcacaaagaaatgatcaatgatcccagttactctgatttgatcattacacattatatgcatgtatcaaaatatcccatgtactatattaatatatacatttttttaattaagatttgaggtgctatatgtgcctgaggagttataggggatgccggtggaacgaccattacatgtggcagctggactgggcaacggccgatcgccactgtgctctgaggagagaaggcagagcttccccctttatctgctggctggtgaagtcctgagaaccgggcagtcagctaagcaccaagttttctctgactacagagctcctatcaaacggatgggtagaaaaggaatgttgtcataatagctaacccttctttagtgcttcttatagtctgggcactggactgaggtttatatgtgttatatcattaaaactcaatctctgggaatgactgttagtacttggtaggtatactattattattgtcgttttacagatgagaaaactgaggcccagagaaagtgagcaaaatggtgctgggggcgattaataggtggcagggctggaacatgaagccacagtctggcaccaaagcccattcatggagccccaactcaatgggctgcttctcagtagaaggctttgccttgtggaaggtagtagaatgtctaaaatcatcagaacacctgtgtggatggtacaacacggtgacagatatgtaccagggacctagatgtggagggagtgaggaggaaaggagcaacatatgcacctctggggaggccctaaggtctcctcagccaattcctagggaatttaattttaaaggacacagagagggtagtttttaacacaggttttacttttaagtcatgagggatgactttctaagccacagttccttctgatacggtcttaaaagagaagcaccatgaagtgataaacacatcagtccaggaagatttagagacagcctagtagaggaggattggaaacagtgtggctgtgtccctgagggtgctggtgctaaacccacggcacagtccatatcagtcaaagcttcattctccttgtgcccacactatgctgatctgccccagtgcaacagggagacgcatatggtcaagagaatgtgtctttcacgaatagattttctccttcgaccatggtgagaagtccttgtaaagaagcatacatgaatatatggatgtgttgggcatcagctgtgcgtgtggccctcagccaggtgagtggaggaagttggaggcattcagtgttcacctccatgtgcttttcagagacatacctggtgagctgtctgcagatacacagcgtagtgggagagatacgcacgtgaaagcagcacagggcatgtagctagcacttggtaaatattagtttccttcccctttctgtgtgtaaggcaagttgtacgagcaaagcatccgcagctcagaatgcaaaaatagatctccatgtggggatgtggcctcttttccccaagtgtggaccagatgtcaggccgccttgtgagtactcaaggaatgttacggcttccttcttcaggacttcactgcttctctccatatggagaaggctccctttccatgcacttcctggatctgaaaaacaagaacaagaaagaggatggctctaaagtctcaggaaatggacctttctatatcctcccttttaaaaagcatttgtatgtaggttttttaggtcttgctgtcaagtcggatacacagctgtcatctgttatatcggtgatttaataacataataaaaatttatagagaaccacaagctcatggatgtttgttttggagtgcatttattcatcattagtatgggtatttttaatcatttactgagggcctagcaaggtgctggtaattcagagataaggaagatgtcatcctttaaacttgagaagcttatgaatggcgaagagatataattaattgtgaatggagtgtggtagatagcatcaggttgtatatgaggtagaatcaggaaagcaagaatggccagctctgaatagagtgaggagggaagatcggagatgatccttgagttgtgtcttgaagaatgagcaaaaattatattcatggaaagaaaggatacaatataagtgacttgttgagtttttcttggctgatactaagaatgaattttcattaaatatgcaccagtaattcacaggaaatgatcaggtcagaatgttatgggacattggtctgaaatataatgagaggggaaaaaaacagaaaatttaaaacgtttatttatgatggctaatattcagaggggctaactccctcctgcccagataaggagaactttgccgcctggcaagggacctgcggctctgcactgccagggcaacagaaccacacgtctcaaacgtggtgtttaaagaagatgttggaaggttagaggcggtgtaatggatgggatttgacagttgctgtggcaacacacccacttccagaacattagtgttagtgggagggcaggcaaactcgtggtacttgccctgggctgccctatgtcccgtaccacctgttctatgccaaaggtatgaacaaattcaaaaggacaaatgcctcacatggctgatggctgcctgcctttgtagaactgaccctggaataagataagaagatgagtaaatcagagaaaagacaacagggaaatagcgtggaggaggagggggaggccagagcaagcagtgttaactcctttcaggtcaacatttcccagggttatattagaatgtattgactaactggtagatttttatggggaaaaaatgcatatggcatctgtgtgtctaaaatgcccttgatagaagcagtagtgtagaatgctttggggcataaatagtccttagagtagcaaaaagacaggttaatgcaaaattggttggacaggttttggttggaggcctgagtgattgcctccggagcaccaccttctggggagtcatgggtatgacatggtgtgaatattcctgaggtgtgggtggttggtttccttacaaggtagggtttgcaagctccttacatccacaggggctgtttcctctggaccagtcgttctcaatcttggcctcacatgagaattaccagtgatttttttaaaagaaatttaaacattttattacaaaattaatatacgattgttgtaaaataggactgtataaagagtaacttgagttcccatattccatttccagatttaactgtccacagtttctgcgtactcttccagacgttccctttgtgtttataagcatttatatacatatatatgggggtgggtgtgtatatattgtgtgtatggaaatatggaaatatatgtatatgcatacaatacatagtgttatgcatcttgcctttttcattcaatattttttggagatttttccatattaatacatatagatctgccggctgcatagaacctatgatctggatatgctataatttacttaacaatgcctctagggatttagattgttttcatcgttggattccattctttgtacacttgtgtggtatatctaaagttttcattcctagatgtggaattgctggatcaaagtgtgtaggctccaaaagaattgaactagttcacactcccactaaaagtgtgtgagaaagctgtttcctcttccattcaaaaaaatttttttttttttttacagagcccaggccccattttcagatcttctgggtgaggttggaggggagctaagtatctgtacttttacagagctccacaggtgaggctgatctgtaaccagggttgagaacttacatatgttcttatctatggccttagatagagggtgtaaaattaggagacgcagctcccactgatgatgcctgggtcatgtcctttcagatccaaattgcaagatctcctttaatgtggttaattgggagaaattgaatgacccatttcttctgaaatttctgttaaactggaggtctttatttagacaaatgtaaacattaatccatctttattaagataatgtatgattaaagcaacaaggtaccatctaggttctgtttgatacttttcttgttattccgtagttatttgttcataaaccattttttcttcttataggctttcaaggaagaattatctaattccttttggtgtggcctcagatttcattagcagtaggtagagtttgtagttattgaaagtctttctcttatttcagtttgaaatgttcccaggttggcacatagctttgggaactggaagtgtctcttttcccttgcttaggtagcctcaatagattgaaagaaaatggacatctcttcttcagaaaacctgttctaagaattatccatcttaggaaattagggtggttattgctcttctttactgcctgcctgaaaaaaatttcccagccctcatttctttcatcctttcctttgaggccatgacttgtcaccctctgctgtgttcctctgtcccctgagcagctgtaaggggtgagagtcacctaccctcaccccttacactcccaccaacctgaggaccacgtgtcttcatctaacagcatttctttttttttttttttttttttttttgagatggagtctcgctctgtcacccaaccaagctggagtgcaatggcgcgacctcagctcactgcaacctctgcctcccgggttcaagcagttctcctgtctcaacctcccaagtagttaagattacaggtgcccaccaccatgcccagctaatctttgtatttttagtagagacggagtttcgccatgttggttgggctggtctcgaactcctgacctcaggttatgtgcctgcctcggcctcccagagtgctgggattacaggtatgagccaccgcgcccagccagcatttctttcttttcctgtttgaagaaactgagtcctgtctactcccacccagcatttgcctggcatatcttcacagttggtctccttatcaaccaactgactcccatgattaggtcagattagatcccctgttcaggggatttatgtggggaactacacactgattgggacaggattttgtcaatgtactcaaatgacaaaggacttcagagatgttggaatattcttggtctacccaaaggttgcagaccacggtggcatttccttcttatataggtcctggtgggcatgggcttgagaagctgaaagaagacgcatggaactcagaatctgatcttttgatgatgacttcatatatatggtctgtttacccacgaggcacacaaaccttaccttatgcctgtgaaatataaaggcagatttttgtcccatgaaggtttctccatagactacattaagcaggagacagatgggtttagcttggctaatcttagtgcaagctggaaaatttcagtttttctgaaacaacatatttctaagaaattgtctggtctagaatgttattctagtgtatgttagggatctgtatgactgtaaagcaaggctgaattactgcaggcctataaatatgtgtgaaaatttacctacttctccctaccaacatggaggtggaaagaagtaggtttaataaaccccatttttattacgtgtgtaaatcagtggctgtttggccatttttctcctatgtaggacttgaatttatatgagaaaacttgagtgtatgccttttcccaagtcttggcttgcatctgaatgtaaaaatcagatgcatgctcaatgaatgttaattcagattatagatagctataaactatataggctgctctgtggtctttcctttccctctgcctgcatgactgaagaccaaactgtcacttccttataatctagttcttcccatgatacctcatcacaaaggtatatatcagttggtcaataacaggacttgtgcagtgaatacttacatgaagcagacactgaagtgcccagcaagaactgcaaaggctggcagtattaggagattgctcaccgtaccccaaatgagatgccagaggcataaagtccattttgtttaggtaccagatgactctgtggaattaacttgatttgtccccagtaatccatattctttagcatacacttccaggcaacacttattgcttagcaacacttacttagtaacctttcagaatgatcattaactaatagggagacagcctgtggtgccgatcgtaggctgttgaggctatctctacgggcattttcacctatcctgcctacttccgtaacctatgccccacaaaacatacactctccagacatgaaatttaaaaataatgaaagatgatgcaggaacttcagacactagatgcaatagacagcaaaaggaagcacctatgttagccttggttctcaacataccaagatgctcttatgaacacttctaacaaaatgttcccaaggagaacacaaagcaggcacctaacatccaagaagcatgtcatcacctcagcatgcctgccacacgtctagcgcactgcagccttcaactcctggtctcaagcgatcttcccaccttagcctcccaagtagctaggactacaagcacgtgccaccatgcctcgctaattttttgaaaaatattttttagagatgagttcttgctacgttgcccaggctggttttgaactcccagtcatattgttcctcatttgctttttttccttcttctttgttaagagacagggtcttgtcctgttgcctaggctggagtgcagtgccaccatctagctgactgcagccttgaactcctgggctcaagcgatcctcccacctcagtctcccaagtagctaggactacggacacatgccaccaccaggcccagctaatttttgaaaaatatgttttagagataagatcttgctacattgcccagactggtcttgaagtccaagcctcaggttatcctccctcctcagcctcccaaagtgctggaactacaggtgtgagtgcttggccttcctcatttgtttaacagatatagtaatgcagccacttgattaggaggcacagtgaccgctcttgagggatcaacagtgtaaccagggaaacatctctttggtcagtcccgtttcactagcctgttcaagaactggtttacctcctacctttctggcttttcctaagtaccttttacagagtcctcctcttcagctgtgcctaaactgtcagtgttccccaggactttttctttggttttcttgttctgtgtgctctcctggggagataatcagattataacatctgcatctccagtttacattgcccttctatagcctacattggtatatgaagctgagatccacatgctctaggcttcttcatctgggcatctgaaactcaatggatccacaatgagacattttattttcccttaaatgtgctcactccacaatattccctatttcagtgaatgtcaacacctcctttgcaggtgtccaggccagaaacctaaaagtgaatcttgctctctcctcctctttccccatgttcagttggcaacaattcatgttgcccccatctcattaataactcttgaatccacctagtcctctgctgttgatgtaggtgagctcttaccattcctggttcccctgtaagccaagctctgcctggttgccacaacaatctttctgaaacgagtcatctgatcaagtgagtcctttgctctaattgcatcgatagttccccgttctcttgaggatagaacctgaacatctaagacccttctgtgtctgtctcaatgcttaccactcttcttacccgccgtgagctccagttacaccagctactctcagttccccgactggcccatgaattctctcatatcttcatgccttcacatattttgttccctctgccttggttaccctttatcccatttacttttctggccaatttcaagacttggccaggatggcaactccctctgagggacatttcctgttgtccctgcactccctccaaagatagggatttgtgatcaacctttcaactccaacctgtgactccctgggcaaagcccttttatagcacatattattctgcaatctaataacctttttacttacctgtctgcacctccagactgcatgcttttaaagtttgggttttatttatatattctcagagcctggctcatagtaggggctcaataaaagtgtttaagcaaatgaatgtcttaatcaacaaagacatagtttatcattttctgtgtaaggcagtggcatggcctttgcctggaaagatttgcaatctcgttgattaaaaattatagagttacttaatctgataaaaaaattatcagtatagacattgtgagagaagttaggaggaattgtcgccaacattggtatagtcaggagtcggagggcttgaattagaccttgatatggatgttaggacaaatagaagtggcgaagacgcaaagcaagattgtctagaaacaaagcagaccattggcttaagcagagagcatgagataggaacaatatgcctccctgtggaggtctctccccagtagacaaagatttcagaccaggaggcaatgggaagccattggcttcctttgatcatggtggcgatactctaggaagagtaatctggtggctgtgttggcagatgggattgcaggtggcagagaccagttaggaagatcttgcagttgtccaagttcctcatgactgcacctgtcttgtgacagggatctgaaacacaaaggaaagcctccactgcactccaagaataatttattgctagatctggaaggagcctttgctatcatcccaaacatctcatcctattatttaacagtggtgggcaaactgaggactaatctcaaggttcccataactgatggggtctttggattccaatccttgtctcattttcccaacctgcctgggaagtgggtggttaaagtttaaagcctggaagaatgggggaaatagttcacaggcatgaggtgacctgcaggagaggctgatggtctataggagattggaggatgagtttggcttaaacatgttgatttagaaatgacagagggattggaggcaatgaccagcagtccacagatcagtttaggactctgtgaacgttagtggaagagattacagagaacactggctaggagccaaggcaagaaggctttggaaaggcatgtttgcctttgagtgcttaacttagagactcatgcgggaaagaatctgtggatctctttgagaagctgcagaacagcagatacacctgaatcctattcatgttcatccagaaacgcagactttaaaacaaccttgttattcttcctttgttttgtttcgtttggttttagggggttggaggggagggaagggtgtcaccgggggagcatatgggtcatttgtttgcagttcacaggggttcttagtgaacatcagcgaatattgtcgctgatttcgtctcctgcttcactctcttttctaaaaacaaaatatttaatgtagcccaaaggagaatagtcagtttaataactagccatggcagctctttgaaaactgcaggtttcaaataactaggcctgcacattttcaccaactcagacaattaaaaagactccagggacctaggtggtgctgattcaagtggcgcatattgtcatttaaaatggaaagtctatttctgaaaatagactccaggtatgggagaacttgtttctctgctggagaaggtagcccatcctagggggaccgaggtaaattgcttagtggctcaacatctacatagttaaaatgggcccatttggccctacctacttcgcagagttgttaggagggcagaatgaggctatagataggcagcatgtcattggactaggtccgccagatgcagaatgttgacaaaagcagaagtcccctcccctcagactcctctggggaaagctggcagccttgaccaccatcaccgctctgcacaccatagcagggatatgagaaggggctgaggtgagcattggactggaggctcctccagctgtctcttgttgcctgtcctctagtgtgtagagttgcagtgtggcttgaaatggtcatcacacccaccatcaccatggcagccctgggaggagggactggctgctactctctcaagaagggataactgttgcacaaaacactgcagactttgagctggccagcagttgaccagctgacctaacctcccgttttccaggtcttaacctaccatccattccctgcaagtacagaggaaactagaaagctacccttctcccaccatagttctgtaactttgggatggagtgagaagcatggcattgttaccaggtgatagggctcattgtccagtgcactagaagccagtattatggcactgggtctttaagaaaagaaaagcttttatttcatgtcagccaacaaggagacaggatccagctcaaatctgtctccctgtgcttgctggctttcaggcagcatttgtattagaaaaggtttaaggggtggattttgggattagcaggtgattggtggcaggaagggtgaggtctggaaagtccttgggcatgcacggttatctctctctgcatcctcatggatggtttgtgcaaattcagcgaggggggtgaatgtgaaacgtgtggcggaagttctggctgtgacgtcagtaagctcgttctgcacagactccagttggccatattggtcccaaacaattttagccagccttatctttccagtagagggagttttagtgtttccacaagcttttatttaattttttttttcttatctgccatcctgtaagctcaagaatttctgttagtcactggtttaagtctttggggcatggtttcaatatgagtgtgggaaaggggaagccattgcctcttgtttcccattcgtgaccatccctacccacttcagtgggcccagtgttgccagacctgaaatatacctcatgtgggtgtttgtctctggtactctgggttcatttctggtcaccctatgatatttccttgccctaaggtactggcacagctatcgggtaggaggaggccaaggtagaaggcacagagccattcttgcctcaccttctgccacacggtgaccccacatgtctggggagaggctcccggcccagggaggaggaggtggaaggtgcactgtcataaccatcacagggggcaatggcgagaaggctcatgggccacgtgcctcggccattagttgtcatgtctgttgtaccccaacttaactgacttctaacaggctgtggttatgagttccgctggtctcacctttcagtgggttcaagggggcagattttgctgacaccataggcaaggaagcatgatggtaaacaccactggaatgagaggccttgttaatccagcccaagctcctgccaagttagaagctgaggagtctagtctgggccactttgagtactgatgcatgatcccagggcgatgtgctgttctgggcacagggtcacactgggtgacatctaacaggctttgcttgggctgtagctagagggaaatgggagctggggagtgtgacaggagggaagtgtggactctccacctaccaaggggccttcccacatactgtccatcccattcagcgccctgaggtgggcgtcatttctcccacttgacagataagggaatcagaccatgaggcagagtaactggccccaggccacacacaactacgtagtgtcagagtcatgatgaatcctgtttgtctacaccttctgatgaactgagctacctcgtgcaggacaggcccaaggaaaggggctcaggccagagtgggagcattgaaacagggttcaaaatgtctgtctgcccaaaccaaacgttaatttgcatactaatagtttaagggcatagatataatacagacctcccccaagaagtgacctttgaagccaacttcttcttcatgtgacggaatacatcagacaccctgtctgccgggaatccttacccttctcctagtgagccgtggtctctggcctatccagaagctccttaaaaatactagtgcatgagatgtagcattgacaggagccctggcctgtgggtcaacagttgctttgtcaaatgcaatcttgcccttggcacagctcgccattcaggaggatggaggaagtggacgagagagagggaggtaaaagaagggagggaaaggaagcaggatgcctggctgcctggagcttccttgggctcttgtccatgagaggaagccatacctacctctctggggtttgccaactcttgtccaggaacctactgggctagagtggaggggaactgcagagtctccccttcctttctcttctgcccccatgaggaggaagtgaagtggagcagaaagagcgtgggctatggttgagcccactggagtctgcactccacccagcctccccctggctttctagctgtatgactttaagcaggtggtttcaccccctctccctctccactttttcctctttaaaatgtgggatacagtgcccgcctcgcagaggctgatggttctgtggagtgttgtgcacaaggctccagcccaggtcctgatgcaggactctcattctggaaggctgggtgcctggctctccttggggcacaattaggcttcctggctgcattcctggggcattcgcatgaaaaagaacatgggctttagagtgagaaggatggggagatgagtctctgtttttccatctgcgtgggcaaattatttagcatatctgagcttgtcttaagctttctgttttctattcctttatttccacatatggaaaatgggtatatgaactattctgccttcatatagctattgtgacaattaaatgaagtaatctctgaagaaccttactatcagtattactgatattaccagagaggtggctcatgtttgtaatcccagcattttgggaggccaaggtgggagcattgtttgagcccaggagttcaaggtttcagtgaactatgatcacgccactacactgcagcctggagacagagcaagatcctgtttaaaaaaaaaattgctgatattgattattcagtaggccagggaagcccgtctaccagcctacaggacgtcattgcattcaccttctcagtaaatggcaacagactcttttcctaatgtttacacgtaatggattgaactggcttagcatcatgctttacccatatttctgttgacagcctgttactgtgtggagagaattgctggataagagccactgagatcaaagggatctttacaatgggcctttcagtatatttgttctgtaatcatggactgaaaacttactgagcacttgccatctgaatgaggcaaaaaggaagtgtgtgtgtgtgtgtgtgtgtgtgtgtgtgtgtgtgtatgcatgtgtatgtgtatgcatgatttgtttttgccttaaaattagtacatcaaccgtgtaatgtgcaggacatttaaaatatgtcagagctatgacaggttcccagctactgggatccaggacaccttccaatttcatctttggctaagactttctatctcttttttcttcttctttctttctccccctcccttttgatgcctttctttccttccataatacctttctttattctttctttatttcttctttgattcattcttgtatttcttcttggtttcttaattcctctttctttctcttcctttcctccctgctgcccaatacacttctgacctcagggcatagatgcattgaagggcatctgctgctgtggccttttggatgggaaccctgtagatctcagctaggttggtttatcagctataatgtattccttgatttggtaaaacagccagcagcagagcaacatgcttttacctcctctttttttttttcctcatcccatttcctccctctctttggtttcttcttcctttcaagggggttgaatggtctcctctcagcggccttttttttttttttttttttttttgagacggagtctggttctgtcacccaggctggagtgcagtggcgcaatcttggctcactgtagcctccacctcacaggttcaggtgattctcctgcctcagcctcccaagtagctggaattacaagcgtgcgccaccatgcccagctaattatttattattattattattattttttaatagagacagggattcaccgtgttacccagggtggtctcgaactcctggcctcaagtgatctgcctgccttggcctcccaaagtgctggcattacaagcatgagccaccatgcccagccttctctcagtagcatttaacacagactcctggaacatacatgcacaaagtgaaaaaaataacatttttaatttctgattttgaaagtgaagatcctcattatagacaatttgcaaaatattgaaaataagaattaaaatttgcccctgttcctcccaaaagtccctgttaggatctggggggtgttatgtccagctgctcagtagctcgtgctgtcccctccatgcaggttccatctagaatctggggcagcagcaggtaaggccaggtcactgttctgtggggcttacatgggagtggagggaagagatcagcaatatcaaacaaataaaaaagatcgtttgggatggagataaatattgtaaaaaaaaaaaaaaaaacatcaaacagagttgtttgatgggtattgagcaggggtagaggaaagtcagagggttcgaggaattggcatttatgctaatgtctacataacgtaggaggactaggtaggcagagagcagaggaagaatgctttaggtagagaggaaactaaatacaaaggcctgggtgggatcacattcaggggacgcaaggagcagaaggaaggccagtgtggccaagtgtgtgagtgaggtagagccgtggatctgatcatatgtggcaatgggaagccttgggagggtttgatatggggatgtgacccacacgggtctgcatgtttagaattatcacagtgtaccgctgtggagacgtgggagatagaaaagggataatggttaaaagttgcagtagttcagaggacagacagtgctggcttagacaaggggaatagtctgtttatttgatttactttcaagtatctctgaactattatctgtattttgtatatgtgtttatatagagaccatttattgcacactttccgggtactacagattgtgctaagcactttgtatgtattatctagttcatttttcacatagaatcaggcatagtaatctccttttacacataagggaattgaaactcaggtaggttaagaaaagaagggggaaaaagtcaacgatagtccctttccccaatacagaccttattaggatttagaggggcattttttgggggtcatttatttacaaaggcccaagtttataacatacaggtgacagaatcagcattcagacccaggtctgactcacttcacagcgtaaaacgactgtcctgtacaaatttaaatcctgctataatgttattgtgggtgtaaacactctccccctatgcaataactcagcttataggtcagtctccattgcaatgagaatgtttaccagacaatcacagaaactcaccgtacacaaataaaggcttattgttcactcatctgtaattgctatgggttgctcaggtggctctgctgatcttggccggactcacatatctagagttcaggtgatttaagctgacctaggctggcctcttctttcattttccagcaggctagactgggcatgtttatggtaatgacagaagtgctacagaaaaggggcagaaacatgcaaagcctctttaggcccagcctcagaactaacactatcatttctgccacattctgttggccagtgcaagtcagagaccagcccagatgcaagaggtagggaaataggctctgcctggaagtgcaggtcccatggaataggacatgaatgggttaggaatgagcctttggccatcaggacgttagtgttaagcttttgcagaaaggacttgttggacaaataacagattcctgctgcgggaatggagaccagctaatatggcctgagtcccgaaagcccatatccttaggctgtatttgtgaggttttaatttaatctttgtatatatcgtgagcactcttcgttgaccttatagtgttgctatcatctcctaagttgattggctccctgaatgtaaaaggattttcagaggcaggcatggtttgtagcaaagtcagctgtaatccctgatgatggtatcatcatcaagggatgccaagagggtaaaagcactatttcagattatggctacgtgggatccaggaagtcatgacaagtgaacagaccctaaactggtgatgaggaggagggcagaggtgagcaggagggaaagattcggcaccaaactttgaatcactaggagtttcactcatcagctctaaaggaaaccctttggccaaaataaaaattgtcttctctttcctcagccttaattgatagaggataatgttatcagctggctaatgctcatcagtgatcaacattagactactgtgttttgacgttactgctgcaaatctcctgctttattaactgcctgaatgaggagcacatcagaaagattggaggtgttgcaattagcctttaggatgaaataataagtaacactataatttgtgactttgatgcagacatcaatttaaaacataaaccactgactagagaagagataaagacagagtgctgctgttccccttcattgatggctgcttgctaatgagctaattgaacacaagctgctaaattcttgctaaaatacgaaagaatatgaaatatcctgtttccagttatactatttggaggtttagccttgcctaatctgtgacaaaagtagaggccaactttgggtttgaaggtaacttctattctttttccagatttctttaagccctttgttccaccctttcctccagaaaccctccttggttcttctggaagtgactttcagcaagaagcttttagaaagaaaaacaaaaaaaacgaaaaacaatgttccagtaactgcagaggctacatgatggggttgatcttgtccactatggatcttttaaataaagctttggaaataccaagctcagacttaacaaatacaggagaaaaaatggcatgattatctcaataaataaatatcaaaaggcatttaagagaacttaatacattatttctggttttaaaaattattagtaaaacaaggttggaagaattggaactgccttactttgtcaagttgtatctactaagatactagaacaagcctttatattgaaggatctgaagaattaaaagcatattcctttaaagtctgggacaagcagtgatcattagtctcagtctctctttcttctcattgtcttgcagaaaccggctaatgcagtgagactgaaaattattaaaaagaaagtaggaattataaacatagaaaggatgccacctctgtctatagaggcagaagatgagattgttcacctaaaaactaagagatgttagaactgttagaactattagaactaataagaaagtaaagtggctggatataaaccagtaacttttaaaaccagtagcttcctatatagcagcagtaaccgcttaggaaatataatagggtaatataccctagtaacaactcttataatacatttaaggaataaactgaaatgtgaaaggctaaaataaagaaaactataaaactaaactgatacatgtttttaaaaaagcccacaaaaaataaaaatggagagcatactgtgggtgtattcaatattttaaagatagttgtcctcaaatttacctgtgaaattgtaattcaaaaatgccaaatattattatatttaaaacggtaactttaaatataacttaactaatgtattctgaagtttacctagaagagtatatgtataaaagtaccttagaaaattttctaaaaagaacaaataaccaataaacatgcaagatgttcagtgtcaccagtaacaagggaaatggaaattataacaatagtaagaccagcctggccaacatggtgaaaccctctactaagagtagtctctactaaaaaatacaaaacaattttagtctctacttaaaatacaaaaaaaaattagccgggcgtggtggcgggcgcctgtagacccagctactcgggaggctgaggcaggagaatggcttgaatccagggggtgggaggttgcagtgagccaagatcacgccactgcactccagcctgggtgacagagcgagagtctgtctcaaagaaaaaaaaacaaaaacaaaacaatagtaatagttgtgcatatcagattgccaacatttaaaaaatcatattgtgtgacacgtgcactcttacaaatgggtggtgcaagtgtaaatagctatgacatttttnnnnnnnnnnnnnnnnnnnnaagtgtaaatagctatgacattttttggagcacagtttggcagtaggtttttaaaatttattattatttttaattttagattcagtgggtacatgtgcaggtttgttacatgaatatactacgtgatgctgagatttggcctttgattgaacccttcatgcagagagtgaacataggtacctaatagatccttttcacaccttgccccactcacttcctccacctttttagagccctcagtgtctactgttcccagcattatgtctgtgtgtacccaatgtttagttcctacttagaagtgaaaacatgcagtatttggttttctgtgttaattcatttaggatgatggccgccagctgcatctgtgttgctgcaaggggcattatttgattctttttaatggatacatagtattccgtggtgtagatgtatcacattttctttatccaacccactagagatggcacctaggttgattccgtgtctttgctattgtgaatagcgctgcgatgaacatgcgagtgcaggtgtctttttgattgaaggatttatgttcctttgggtataaatccagtaatgcgttgctaggccaagtggtaattctatttttagttctttgagaactctccaaactgctttccacaggggctgaactaatttatattcccaccaacagtatatgaatgttcccttttctctgcaacctcaccaacatctgttatttcttgactttttaatagccattctggcagtatgtttaaaaatataaaatgtacatgcctcttgcgtgagcagtctcacttctagaaatcacttctataaaaacatatacctaaaaatccatcagttgaggaattatacatcgttatatatccaaactatgggatcctcttgaccctttaaaaagaaaaagtagttttatttgtactaacattggaaattgcatatggtatattgatagattaaaaaagtaacttgagatatgtgggtagtataataccatttgggttaaatcacttatgtgtaaaaaccaagatataagaggttcacgtcaagatgttaagggtgatcacctctggaaagacagtgagtgagactgggggaagaggagaatagcaagaaccaggactttcactctctttacacattcctgtatttgttaacatttcgcagcgaacatctttgatcatttaaaaaattaatgatgcattcttatattgacaattcttatactaaaattttgaaaatccacaggagataggaaaaaataccccttacttttgatactattgacattttgaaatgaaaggaaaaaatgagtttagtagagttaattcagcagaaaatataaatatataagatggcactaaggtatctttggggagaaacgggacctggttttgtttcgcaggtcctttgccatttgctgtttgatactggggaagccacgtaccttgtctgtggtccagttaggtttctccactctgcaggtagggctgacctacttccattggaggaaaaacctagagagaaagaatgtcaagaaaggttccacctgaatgggaagtgttattgttagaatgtccatgaatgaatgtcagagtccagcatctcagaggccatcattaaatgaggagcagtctttgtagaagctgaactctgaagtatgcatcatggtgaggagtcaggtggggataaatgaataaaacataaaagaccatgtggtatggtagaggaggaggtgtgtgcgtgtgtgtgtgtgtgtgtgtgtgtgtgtgtacagcttaagaacataaagcaataaaggagaacattttgatacagcataataaacaatattggagtactaaggaggagcttggagcaattcgatttgggaagtattaagaggtgttacatgatgataggagatgggtgcacatgcctgtgtaagaatggggaggtggggacattgtagtgatggggcattggcattgggtagctttgttattaagttcaaagagtttctaaagggaaaataaaatccccatttgaatcacaggtggttcattttctgaggcaatctcaagaggcacaagatcaaatctagcttgacaccatccagtacagaactcagcagtctctagaagctggagctgagctacagcttggctaatgagaactctccatcctctgccagcacctcagggcccatctcttcctctttggcaagcaggatacaaagagagcgcaaagcagagtgggacctagaaggtcacccagagcattcattttgcaaactccccaccaggcctttccagaagacagatgatcacggtttcacagttttgctagaatccgagccagtggcttcatgcttcgacctggggtaggttttaatgaaacctaaagaatacttcacacattgacctaccattggcagtgaggaagagggggagatgggccaaacacagctgaacgacatcctctcatttattcatggggcgtgagaggagtgattgtaaaattcagatgaaaactagaagttaaaattcagagctcccagtataaacatttgggtctggtatgaagttcactttcaccagtaagacacattgagaaacacaagaaacccattgttctctggatgtttgtgcatttcagtggttttgcctgtaggaccctcaagtggaagttagattgtctctattatgttctttctaatttgttaaatatttcttgaactaatctccttctcactatctccattgctaccgttaatgtgtacactgtttatcacaacagccttgcatctcatcagtctgcagccgtggctcatgcaatccgttcatcatgctgcctgattcttctttccaaacatcagctctttgtcacttcactgctcagcatctctcactgacatttggattgttcaaaatcatatccccactgcccaccttcttggccacatctcttgtgcttgcacctctccccactctgttttcttctgattcaatgtgacagctacccaagactatacgtggttctgcaaaaatgcaaacctctgtcttgtcttggcacctagaataccctttttttgctaattactctttgtctcaagatgcggctgtaccaagagtcatctctaggaaatgctccctaacctcctttgtgttacgtaccatttcctcacactgtggaagcacatgagaattacttccatcccaacatctgtactctcccctaactggctagtttttggtctgtctccctgactcacctggaaaccaccctcaaggtgaaaattacgtagttctgttcattgcatcttgcagagtgcctggcacatcgctgtgtgataggaaagaatgaatgtgtatttttaaattgggcttctccttctctagtttttgaacatgtgtatgtgggtttctgttttgcctgatgtgacgtgagtcaagtcatactcaacctgctgtgttctcagaaatgcagtgcggatgagtaagataaatcatgttagcatcatatataagtgagctgaagactcttaccactcatctcagagcaccattaagtagctgcctactgggtctctctagggtgttcatgaattaaaactcctgtgttgttccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggtaaattggaactggtaatcagtctttgggcaaatggagagtgggatccacagacagattaaaagggtgaccccaggatgatcccagaagctagtgcatgaaggatttctgatttctgatcctgtttcttggcatgtgacttctaggccagttgtttcctctctgggtattttttgaaatgcacttttatgtcttgatgctgaacagaaacaaggagaagcagtaaaatgttggagtgattttaaacccatgaaggaaacaaacctgctcctatctgcatggaaacccacaaaagtctaataaaattaaaccccacatctttcaaggttgagaagagaaagaaaatcatttgagaagggcatctgaacctcattgccctcgaagggttaccttccttttagaaaatttttgataatttgctgctgccatttccctgtaggctgcgaggaataacagccagagataggaccttcctccatattgccaaccttggatgaccagggtgggattttgtgaaggaaactggtagttccctgacaccatttatatgtatcttaagtaacgatcacttgaatatctcaccgctagattaattctaagtaggttttctctgcagtgttgaagggacaccttatttataaagggaaatagatttaccttggaagtcaaatacagcttaaaacaaaattaaccagacacaataatgacatcttaggatgaaaattctttccaaaattatgccatgtctgctaatgccaaaatagaaccatttcttattaaccattgcttagaactttcatgcttctttccaatcatgtgggtactagagatatgattattatgtagtcaaggccttggaaccaggcataattagcccttttctactgtctgccccccatctctcaaacctaactattgttcctatgtagagacactcctaggctgggaaataggaatttgagacaacgtctgaactggcttagaccagttgttcctgctttacatagctagaaaaaatgctggaagcagaagtacctggcaaatttaaatcactgctgtcatccacattcctgagattaccttaattgatgcagaataggaaaacatcagggctgaaggggaccttagagattcatttgtccaaaattaccacttgcagttgaggaaatgcagaaaatggaaagctgaagtcagcggatcactacctgttagagaaaggcttagcctggctcccaggttgtcttgcttcccaaaaggtcacagcagcatgttggccctgacaagggctataacgggggcccatgggtgacaaatcaatggctgtcaccctgagaatcaaaaaaggaaatcacatggtaaaaacaccagaaaatctaaactagtcaggacattgatggttagactgagatggggtaaaaaaggggcaccatgggctcaggtcttgggcaattaggtaccttatttcaatgagatgcctttcctagtcttgtcttcttagtgatccaattttttatggtgttttttttttttttttttttgagatggagtcgcactctgttgcccaggctggagtgcagtggcacgatctcagctcactgcaagctccgcctccccggttcaagccatcctcatgccttagcctcctgagtaactgagactacaggcgcacgccaccacgcccggctaattttttgtatttttagtagagacgggatttcaccgtgttcgccaggatggtctcgatctcctgaccttgtgatctgcccacctcggtcttccaaagtgctgggattacaggtgtaagccaccgcgcccggccttttttgtgtattttaaagcctcgtatcttaaactaaagccagggatcctgttcaacctggattttctcttgaatggagggtagtttgaaaggatgctgctatgagtgatagacagaacttccagccagactttcacaaagtctccagatttatcaaagagcaagattagttaataacccaggtaaccttggcaacaaagaggccagacaaaaaccgtctgtgctggaattacacatattgctgctgtcatggtcaggcctgacctttccacatagcaggtggggaatgggcaggaacattgtcctgccaggtgtccttggatattttttagttgtggacgaagtctcaaactaaagaccatgagctaatataaagcaggaagcagagctgtaacatgtttctccttctggcagaaaggtctgagctaagggtagatggaggagaaggtgtttctggcccccagcattggacaagtaaaccagttcaatgaaatggccccactaaaaatgatcttccctgtagctgcctgaacttcctctcttgagccaatcattagggttagcatgcatgcgctggagaaagaagggagaattgaggttgacatgctggggtacctagctgaaaatccatttaattaccttgattttttaaatgcttttaatggtccattcattcacttgatgaattttttcaaatgctagtgtgtgccaaccctctaaccctgtatcaggggctgggaataccgaggtgagccaatactgatactgttcctgccttcatggaacttgtagtctggtgagaaacagggagtgttgatctgttgggtggggcggggctaagtgggtcccttgttgcatggaggtaactgggtagccagatggcatcagcaactgggagagggaaagggggcagaggatggagtgccaagtttatcagccccgctcaaaatcccgcttcccccctgcccgcaacccttctgcgataacaaagggaggcgagcaggcttttctagtccaggacactcctttcgtcattcctgccttctgtatcctcttctggacccggttcccagctcccctccctcccacctgaaaggtttgttttgcattccacaccttggctggctcatctgcatgtgtggacaggtgaggctgggaaatgagagcactttagaagtgagaagagctctaataagttagagagaagttggttgttaccctgaagtcagctggtgactccctggtcattaagacctggtcagaattgtcttacaccacatcaagcctgtggcctatggtgggaccccccattcctcccccatcacatacatgcagtttctacagtgttccaggggcttgttcttatgtaccccttcgcctcctgggctcctgttcccccgtgtgcagactctgatacatcctaaatcaagtcctcttttgagtgctcttggaaaccgcactcccaggcacattgttgggtatagatttactgatactgtgaagggattggaacccaggcttctatcaaaacacaaataacttccatcagaactggaggcttcaccactgttgttaactggaggcttcaccactttgggccccctcaccaccatgacgtcattgactcgcctgactcctcccagcctctcccctgcctccagctcccctgctcgctttcagaagcacagacaacaaattcggccaacaaccattgcacacctgccctagcttgctcacccaggtattcttcaaagagcagcctcctccctcctacccagaagaattctggtaacatctattttgaaaatcgtttttttaccctgttgcatattgttatgaaatgtataaaaagctgggggtgctttatttaagatgatagtactagtttgtggatggcagataggaggtatctacacagtttctatcccacactttctgtatttgtgcagggcaaatgcctgttgagggtaatgggcagttttgggggtggaccgctgaccttagactttccttgcagctttggccccaacccatgtgacctccttcaatgccaactgccccttggaattctgaggggtgcaagcactggcctgacccatttattctgggtggcatgtaactgcaggtagtagcattgctaggactgagggatttgctgttgcaaattgttgaaaaaggggagttgcaaaattcaccaggtgccaccatcagtgaattgggaagatctaaaagaagatccctgtttcttagtcttcttaagaagtttttcctttctgtcagggaggcagcagtgggggtggagggcagggaaggagggattgtttttacactgaccacagtaaaatattactcaggctaattaaggcctagagaatggttaaacaagaaattagagtaaattatgtaaattctggccaccaatatgagtacattgattagcggcaggttgaagatttttttttttaatttctatttttaattaccaaagtgtatgtatctattatatgatattgtaatagttcagaataatataaaaggtagaaagtcttacatctttgcctctgccaatcccccttctagaggctccacctttatagattagtataaatctttttgcgcctctttctatgaatatatgatttttaatcaaactgggatgagaccatacatatttgtgtgtaaactgtcattgtttccacccacatagtggcatatcatatgaacatctttctggtgcaggtgggtcattatttttaacagctgccaagtatccctttgtatgactgtatcataacgtggttgttaaatctcctatgcatagtttttcctcattttttctactgcacataatgctgcagtgaacagtttatgcttgtgtgtacatgcacatgtatggagattgctacaggacaaaatcctggaagtggagtgctagatgaatagtatatccatttaaatagttgatagatattgccaaattgccttctaaaatttttgtaccaactcatacccaaaaaagcatatgagtgcccttgaaggaaaagggttcttaaaatgttgagcagggagagtaaagaaagttgaaatgtaatttaagggtgaggtgagccacctgctttcatccagcctctgatctctgcttcactgagcacgcctctgctgggcaaagagtaggagcctgttgggacagatcggtgggtccttgctccaagaaggaagtgtggctcatgggccacactctcagacatgcagaaactgtaaaggaaggagacacaagctaagaaacccgggctggcacctctgcacaatcctggagcctgcccgtgccctggctggcactgggctttgctgaaatctaatatcttgtttctttttcccttctgtaactaatgagcaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaactctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaataaaatgtattctcttgtgtgccaggagaggtttcagaaacctacctcgtcttacaaatttaaacactttggagtctgtacaggtgccttatatgtaggtcattgtcacgatacacacacacgaacactccctctggactggctgcctctccatccagggcagttaactagcaaacaaggcagatctgcttcatggagcgggaggccatggcttgactctgagtgatttgggtcaaccggagtcagacgcatgtctgcacgctgcagctattatgagagtccctttgtcatttttcaccttttcatcctaagcatctttcagagattaattatttggccattaacaatgaatccaaatcatatcatactgacatcatctagacatgatttggaaggaacagcttaggacctcctgatgaggtcacattgttgtttcttttaactagacttggcaaagaaaggcaaaaattgaccagcctatctttctgctggtgctgccttaaggaggtagtttgttgaggggagggctgtagatcattacttctttctcttcaggaagtggccactttgaaccattcaaataccacattaggcaagactgtgataggccttttgtcttcaaatacaacaggcctccactgacccatccctcaaagcagaaggaccctttgaggagagtacagatgggattccacagtggggtgggtggaatggaaacctgtactagaccacccagaggttccttctaacccactggtttggtggggaactcacagtaattccaaatgtacaatcagatgtctagggtctgttttcggaagaagcaagaattatcagtggcaccctccccactgcccccagtgtaaaacaatagacattctgtgaaatgcaaagctattctttggtttttctagtagtttatctcattttaccctattcttcctttaaggaaaactcaatctttatcacagtcaattagagcgatcccaaggcatgggaccaggcctgcttgcctatgtgtgatggcaattggagatctggatttagcactggggtctcagcaccctgcaggtgtctgagactaagtgatctgccctccaggtggcgatcaccttctgctcctaggtacccccactggcaaggccaaggtctcctccacgttttttctgcaattaataatgtcatttaaaaaatgagcaaagccttatccgaatcggatatagcaactaaagtcaatacattttgcaggaggctaagtgtaagagtgtgtgtgtgtgtgtgtgcgtgcatgtgtgtgtgtgtgtatgtgtgtgaataagtcgacataaagtctttaattttgagcaccttaccaaacataacaataatccattatccttttggcaacaccacaaagatcgcatctgttaaacaggtacaagttgacatgaggttagtttaattgtacaccatgatattggtggtatttatgctgttaagtccaaacctttatctgtctgttattcttaatgttgaataaactttgaattttttcctttctttcatgtatttttattaacagttggctagcaatggtattctgttcccacctcggtagcaaagagaccatttgtagagattattacctagataataaaatgataatactatataattagtaataaattaacatttattgggtagttatgtgccagacactgtgctaaacacttagatggaatattttattccatattagctctatgaggtagggacaattattatccccatttacagaagacaaaatggaaagttaggagagtcacgtagcttacctaatgttacagaggtaaaagtggctgagatgaattctgatccctggagtgggcattatttagaggggtggttcccaaaagccagtccacagactgtcttgttctctaatatataaagaataattcagcaacatctaggagtataaatccagagattctgaatcagtagttcttggatggggcccagaaatctgaatttttaaactgatcccagccaacttccatctgcagccaagtaattggtgtcaaggatttatagacttggctcttaattcaagttcatgacccttgggggatccacgcagaggcttcagagatgccataattatctgaaattgtatgcaactttttatgtataaacatttattttgctgtagagaagacttgtagctttttttttttttttttttttttttacttccctaaaggaacctgtgatgcaaggcggaataaaacccctgattcatgtaagaaggctgatgtagagcagtggttctcagcccagggagcccagtagattcacctggggagctcaaaaccggctgtgtggggctgcagcccaggccaagaaactcagcatctccggcatagtgagaagggggctctgtgttgaggagtacaattctggattcaaatctgtcacctagtgggtatgtgaccttgagcagcttctaaaccgttttgaacataatctcatctgtgacatgaaggtatactcacttctgagggttgtggggggaactaatgacaacaaatgaattgtctctggcacatccgaggccttcaacagataactacatggggcccacgagagtagaatggatgccttgagcatttttccaattcaatatttcagactattcgttccttcagagaggacggaaaagaattcccctgctcatatgccagagcaggatggctgatggtatgggaatgggtggtagagacgttgtttcatagtgtgacttcaccaacagttcatagactagcgccagctttgtgcacaaggtcgatgggcatctcttacttggtgacaacctctagttaaaattgggtggttacaagttagggttcagctctattttcatccatcaaacacctttcacctttttgttgttgttgttgttgaggtggagtctcactctgttaccaggctggagcgcagtggtgcgatctcagctcactgcaacctcagcctcctgggttcaagcgactcctgcctcagcctcccaagtagctgggactacaggcacgtgccaccatgcccagctaagttttgtatttttagtagaggcagggtttcaccgtgttggccaggatggtctcgatctcttgacctcgtgatccacccacctcgacctcctaaagtgctgggattacaggcgtgagccactgcacccaacccacctttcacctttctcagaggaataagaatagtgaccttagcttaagaatagtgaccttagcctaagattcttctggggcatcttcaaatctcttggaggaaatgacttc

SEQ ID NO: 15826 - DNA, 16641 bp, Human
  misc_feature (1)...(16641): n = A,T,C or G
gctctttatagcttccctcaacacacacacacacacacacacacacacacacgtgtctcattaaatgaggatttgggtccctggctcatagccttctccttcatcttattccttttcttactcatagaagactttgactttgtgtggacaacccaactataaatccagcctcaccagggactattgctactctaaaatgttaaaccccaatatccaatctgactaaaacttatttcctgctatattgaattcagatttcctttaatcctggttccttaacttctctcttttgactcaattaattaccagctatctagcatggatcccataatttatcatttcaatcattctcttgccagtaccacctacaacattcttgaccctttgttcttcttcctcatgtaccctataaatccctaatatctgtcttttccagtccaaaatccaagcttctgggtgttgctggagacagaccctaattggggctattcccagatatgatctccagtttcagctttttactctacttgacatattgcttttgagtttctttttttgttgttgttgttgttgttgttttagagacagagtcttgctctgttgcccaggctggagtgcagtgatatgcgatcttggctcactacatcctccatctcctgggttcaagagattctcctacctcagcctcccgagtagagtagctgggattacaggcacccacgaccaagcccaactaatttttttatttttagtagagatggggtttcacgatgttgaccagggtggtcttgaactcctgacttcaagtgatctgcccacctcagcctcccagagtgctgggattgcaggtgtgcaccaccgcttcccacctgtttttttctaataggcttccttattcatttctcacaatggcttttccaaaccttctcctcaaggatccaaacccatccttgcttcctcaaagatccaaaaccacccttcctatttacgaaggtggtctcctgtcttaggtgacaagaaaatgtaccttcttgccctcgtatctacatgctcacctataccctcacccgacttttccctcctcctcaccccatcaaaggcaataatgcacctgtttttattcatctgggcctttggtcttccccttcatatttcccgagacctcgctttcttctttctcttgtattttttatttttctatctcttatgtgtccttctctaaaagttataaacatgcacaaaatctttccatctcaaaatataataccctttacctggtgtcccctgcaggccatcttctttatttatttacttttgcgccagcgtcttcctctgaagcccaggctgggtgcgtagcgcgatcatggctcactgcagcctcggactcccgggctcaagcgatcctcctgcttggaggatcagattttttatccttgcagaagtgataatatggcttcttcctcatctcctaaacaccagtcatctgacatacactgcagatctaaaatgggcctacgtgttctgcccttccttgcctacctgttgagcttgcaccgcttctgtgagtctccccccacccacaagagatccttcttccttcgcgctccactaacccgacataaatgtttatcatataaagttttccgttgcactcttgtgtttatgtctcctggcttcttcaccaagctgtgtgacagctgggccctgtcgcctccttcctcgtatatgcagcgactatcgcagagccgcttaatctttgttgaaggcagctgcggttcagccctgagggccacgggacggacgccactcattcagccctaccgggggcgctgtggcagccggcattggttgccgtgccctccgcttgtctcgctcagctctcgagccacacgccctgggctccgcccactccctgacaacatccctcctgcccattgggcgagcatggacggggctgtccaatggagcgaggcgttggtgcgaggaggcgccgccatcttggggctgctgggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggtaaatcgctggcggggccgctgctttgggccccagcccaggatgtcttcccgccatccactcggcccctggagcttccccagcgctcccaggaggtgctgggaatgaacacaaatggaccctgccaagttaatgttctgctctctcgtccccttcttccctgatctagcggcccagtgaggccctgaagctggcaacagccaggttcatctcagccctaaacatttctgcaatcgatcttcccgccccagtccctcagcttcctttatggcttcggttgttttacgagtccctgaagccagggctcctccccctgcagcttcctgtcctttgtcttggttcacttttcctgtaccgcctaggcggtaagggtacctcatgtatataaaactgatgatgttttttctactaccgctcagacattcttgaaagattccaatttggaagcatctgtaccccccagaatattggttcttagtattttgggagtcacaggctttgggaccataagaataatatttgcacctttcctcagaaaaatggtataagtaaatgtataagtaaatgtttgcaaacaattttaagggattcatggacctctgaaatacattcttagcccccacaaaaattataatggaggtggatgtcagaggttagctcattattaaaaagcaaaggagtccaagtgatgggagtttagcattcgggtcttacttttcgtctcttgaggttttggttattttattgtcatgtctaagaattatttgaagcatcttcgtgttaattaaaagttctgcttctttttagaactcagcatattgaagggattttatactgaaaacctcagacctggttatgtatgatgcttcttttgttttgtgtttgttgtaactcagttatctcttttatgctgcattcatttcccactctcgtgttactgaccccaagttaaattaggttctgtgggagacacaaaggtgaatgagattccgttcaacccttaaggagctggtattattggagggtattatagatccagtgtattgtgactgtatccctcggagaagaaagaaaattaaaagcagataaaatctcggaaaaccggggctcaggatctttttttttttttttcaatagttttattttttttgagacgaaatctcgcactgtcgcccggactggagtgcaatggctcaatctcagctcgctgcaacctccacttcctgggttcaaacggttctcctgcctcagcttcccgagtagctaggtttacaggcgcctgccaccacacctggctaattttttgtatttttaatagaggcggggtttcaccatcttggccaggctggtctggaactcctgacctcgtgatccacccgcgttggcctcccaaagtgttgggattacaggtgtgagccactgcgcccagcccagggctcaggatttactgtgtgaaactattgatgatcattaagtaatatgaattatgttttaagtgtatgcagtgagctggtaacctgtaactccaatgccacatacagtttatagtgcatataagtttaaagtgtgcagcaagaaatgttgataattatgattaaaaatagtattagacccacagaaagacctagctaagtaacaagctgtaaaacatacttctattttttacaataaaatgatacaataataaatgatggaaattgtattttttaaattgagtaatttgtttataacactggtgacttctggttgcttcatttggttagcttcccttgttggcagggtcatttgtttcttcattcagacaatgctactctgagaccacacaggacttttatccagaagtacccacagtataaactaaaaatacttgagacaacagtaaagaatatataaattcacatcaagagtaactgtactgtaagaatgtgatggcagtggtagggaaaatgaaaataattagagcatcactgtgagcaaagcatgtctagaatagacaagaaagagaatatttcacctcttacccagtcagaaaattgcagttggcacaggctggagtgcagtggcacaaatcacagttcgctgcaccattgaactgggctcgagtgatcctcccacctcagcctcctgagtagctgagactacagacatgccaccatgcctgcctaattttttttttttttttttttttttttaaagacggggctcttgctttgttgcccaggttggtcttaaatccttgcctcaggtgattctcctgcctcagcttcccaagtagctgggattacagacacaagccatggcgcctggcttgactgatatgttgagaggggagaggatgagtgtagaggaagagcttaacagttttttttgtttgtttgttttccaagatggagttttgttcttgttgcccaggctggagggcagtggcgccatcttggctcactgcaacctccgcctctacgtgacaggcattttacatatgtttatatgttacaggcatttaatatatatttatgtgtgtttacatagatttatacataatatatgaacaattacagcaacccatcaaagtatataaatgaatgattttatatctgttaagtgatatacctagtttcttgagagattaagatgaaatttggacccagatctttgaaccccaagtccattctctttctgctagggctaaagaacaaattttgtcaggtctctggaatctgttttccaaaattctctgtcttctctccgcaacacatttaacctgttgattatacccagtatctttttaccactctgtcttgtattgctgtaattgaagatggcattaccactggattatgtaataacctctttgttggtctgtcagcctttttagttccttaacactcttgccacaactgtctaaaaaacaaaagttgaattcttcatctcctgcttaaaaactggctctttgataactggatatagtcccaactcccagtcacagtctgacccatctccagtctttctggctttgtctcaccattttcatgatcttcagctctagtctcatgaagctaccggattgtatccttgttcagaatgatttttagcctttcttctgccttcttctataaggttaaaacaaaaaaagcatttcaaagccacctccttttttagactttcctttttcccagtctaagttacttgttttctctctttagcattttatctgtatatccctttataggacttaattcattctgtccttgtgttttggttatttttggtaaagaaccttgatttttctttctttatggcatctgacatggtgacttggcaccctctaaattaccaaatggacccttttataaacacgattggccttttttcttttctttttctttttttttttttttttttttgagacagagttttgcttttgttgtccaggctggagtgcagtggtgcaatctcagctcactgcaacctccgcctcccgagttcaagcgattctcctgcctcagcctcccgagtagctgggattacagacacccaccaccatgcccagctaatttttgtatttttagtagagacggggtttcaccatgttggccagactggtctcgaactcctgacctcgtgagtgaactcctgccctcccaaagtgctgggattataggcatgagccactgcacccagccatgattggccttttaactctcatttctcctaaatgaaaccagtgagtgttcctttaactgagagttaaaacttcacatagttgtcatgcttagtatatttttaagtgtttcgtttctagagaactgaatttttaaaatgtgtaaaactgaatttactagatcaataaatagaatcaggtattctaaagataattaacctagttactactatttatacctgcttaaatgcttgatgagttccctttcctccttcactcagacaaatcgcatatagtgatgtaacttttttttttcagtctcaggaatgcaaagaccgtaatggggaaagctgtaggttgcagttccattagccctttttatttagtttccagaattgtcttgaggcctctggtgctagattgtaaccattttaaaattatgtttctgttctggcttgtagataagtagcagtttttattttattttattttatttatttattttttttgaaatggagtctcgctctgtccccaggctggagtgcaatggtgcgatctcggctcactgcaagctccacctccctggttcacaccattctcttgcctcagcctcccgattagctgggactgcaggcactcatcaccacgcccggctaattttttgtattttttagtagagacggggtttcaccgtgttagccaggatggtctcaatctcctgactttatgatccacccgccttggcctcccaaagtgctgagattacaggcgtgagccaccgcgcctggccgatacttagcagtttttaaaacagctagctaaacaagagttactgatactggttagggaaaaactgcgatacactgtgcttgaatccatcactgaaaaaaaataatgttcgtggaagtgttcttgggagatgtcttataggaatatgctaatatctaaatgccttggcaatctgtagaatattgaacataaagtattgtgtaacatggaacttcagtataggagttattctggtttttggaaaagttgttggtggagacttcaaggcagaattctgcttttatgtaataatgcgttatgttctaccttcgtgataaagacctgattttgctgaatattttagtctgaatctgcttgctaagatttgtggaaaaatggaaagtgtgagttgcactgacctgcagcactgtttgctaatgaatggatttggactttttaactagccatttctgctaaatgttttcctccctttcctgtcattcctctgtggctaggtgtgttggtgtatattcttattggcaagaaatgccaccttataagtctcacagacattccctgaatgtggatgtgttttgagaatgttcagtacatctcttcaaactggctgcaaataaaatatccaactttttaaaagtcttaaataaatggtagcaaaggaatgaactaaaatagctgattttttttttaacttcatttcggtttagtttatagtaaaaatgcctttagatgtttgggggtatttattctaaaaggatccttttcagcctacctgaagactaaattatttataagaaatgtcatttgtcttcactgtttctaaatatgtatttttgtttcaggcacgtgtggttctcaaatataggcattctgatgggaacttgtgtgttaaagtaacagatgatttagttgtaagtatacatttttatttgttacatactttcagatttgtttgagttaattatttgtttgaaattatttacttagagtttatggagattacccattaggatgcttattttgcatttcatttaaagatgaagaacctcattctagcagctacttttatagaccctcaggaaattatttaacctgctttcttaatgcattatgtcaagtgtctttaataagtgctgtcttcagaccttaagcaacagaaatgtagagaccaaattggatgtaagggagtaaaagtttcctttaaatgacagtgtttgaacacaacttacaggctttattgtatttcctgtctttgatatgctcattcttgttacttcctcatatcccattcattccttaaccctctgccatttgttttctgcatatggtactccagcgaaactgctctttgtgagagcacatcagcagctcctttcttttcaaacccagtggtcttattattcatatgttatttgacctccttgctgcttttgatacagaagcccactctttcatagaaataattattttggcacttgtggttctgttttatcttggccttactattctgtgtttctgttgtttcattcttctttgctgattgttttttttttgatgtgccccatatatatgtgcttctctaggattctgtccttgattgtcttttcataacagcttctggagcagttcatttaactgagtctaatactgcatctgtctatgtctacttgcaaatgtgtgtttagttcatattcttctgactttctgactagcatctgtatctcacataccctcaaaattcacttatctacagtggagtttatcacctgttctttttttttttttttttttttttttttttgagacggagtcttgctctgtcgcccaggctggagtgcagtggtgtgatctcggctcactgcaagctctgcctcccgggttcatgccattcttctgcctcagcctcccgagtagctgggactacaggcacccaccaccacgcccagctaatttttttttgtatttttagtagagacagggtttcaccatgttggccaggatgatctggatctcctgacctcgtgatccacccgtctcggcctccgaaaatgctgggattacaggcatgaaccaccccacccggcctatcatctgttcttaaactagctctttctcatgcctgtaatcccagcattttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggattttttttaattaaaaaaatttttttagagacaggatatcgctatgttgcccaggctggtcttgaactcctggcttcaagcagtcctcccactcagcctcccaagttgctgggattacacacatgggccacagtgcacagcccagagtgatttctatttagacggagtctcgctctgttgcaaggctggagtgcagtgggcgatctctgctcactgcagcctccacctcctgggttcaagtgattctcctgcctcagcctcctgagtagctgggactacagccgtgcaccaccacgcccaactaattttttttttttttttttttagtagagacggggttttcaccatgttgaccaggatggtctccatctctttacctcatgatccacccaccttggcctctgaaagtgctgagattacaggggtgagccactgcgcctggccttttctttttatttgtttgtttgtttgatggagtctcgctctgtcgcccaggctggagtgcagtggcgcaatctcggctcactgcaaactgcctcctgggttcacgccattctcctgcctcagcctcctgagtagctgggactacaggcgcccgccaccacgcctggctaattttgtgtatttttagtagagacggggtttcaccctgttagccaggatggtctcgaactcctgacctcgtgatctgcccgccttggcctcccaaagtgttgggattataggcgtgagccactgtgcctggacttttttttttttttttttttaaagaaggagtctggctctattacccagactggagtgcaatggttcattcttggctcactgcaacctctgccttccgggttcaagcaattctcctgcctcggcctcccaagtaggtgggattacaggtgggcaccaccacacccagctaatttttgtatttttagtagagatgagatttcaccatgtcgcccaggcggctggagttgaactcctgacctcaagcgatccacccacctcggcctcccaaagtgctgggattacaggtgtgatccaccacgcccagccccagagtgatttctgaaaggctaatttgattgttactcccttgcttagaaacctttaaactccacccttgcatcctctctaatctctgtcatttctgtattatgtaagagctcctttaatgtgctgtgatgtgttaggcctcagtgctttcaaacattctgtttcctcctttgcaatattgaatcccacctccacccctaatgtggccagactgctgcttatctttcaaaacccaacttgaggattacttcatttcttgcttttcattttggctttttgtgctgtatcacaattcttttatcacatttgtctttttaatagactgcccttcaagacaatagagatagatcagtaatattcttacatgtcttatttccattgcctactatgatgtcttgacccagagagcactcagtaaacattttttaaatagttagttcttttgaaaattttatagagtgattttaaaaatcactttttgtctttggtcatatattgtatttgtgttcagggttccattatgatgagactgcatgaagttagaccttttagtgattaccatgtcttctaagaaccaattgaatgtagtgagtagctaaacatgtggaaaaggaagagtgaatcgagatgtagtatactagacatagattgaagagatgtgaatcctagcttagtcatttactagcattttggccttggaaaagtttaggccaaaaatttagccttctggtctcaatttcctcatctgtaaagtatcatagtgatagtaaaaaaatatatgaaagtatctaacatgagtgcttacccttggtagattgagtacatgtattcttttgtttgttggttggttggttgattgcttttttttttttttagagacagtgtcttgctctattgctcaggctgcagtgcagtggcatgatcatagctcactgcatcctcgacctcctgggctcaagcggtcctcttgcttcagcctcctgaatagcagagactacaggtgtgcaccaccacactcagctaatttttaaatttttttgtcaagacagggtctcattatattgcccaggttgatctggaactcctggactcaagccatctttctgccttagcctcccaaaccactgggattatgggtgtgaaccactaagtacttcttaaatcttgacattccacacagaaaaattttaattgtgattgtcacagagtggttaggtatacttgctgaagaaaaacccctatgtcctgtcttaaaaataggggaataggccgggcgcggtggctcgtgctggtaatcccagcattttgggaggctgaggtgggcggatcatgaggtcaggagttcgagaccagcctgaccaacacagtgaaaccccgtctctactaaaaatacaaatattagcatggtggtgggtgcctgtaatctcagctactcgggaggctgaggcaggagaatcgcttgaacctgggactgggaggcagaggttgcaatgagccaagattgtgccactgcactctagcctgggtgacagaactagactcggtctcaaaaaaaataaaataagggaataaatgcagaacgaattttaatacaaaaggccttatctccaattgatggctctttttgccctgttaatgattgaatataattaaggatccatgttaacttcgacttttttataatcccatgtatccatcatttttctaatcccataattgatttagaatactgtcttctatggacctaaaatctttttctgtcagaaatttcagtgagaaggtatgtacattctctcataggacatgtgctaaaattttgatgatgaagattaatatggcctttttacaagattgccgcacaaatttgtacaatgcgtggataaaaatttttttaagtgagttgtttaaaaggctcacttaaaaaaatcagttgggcatgatgaggttgaacttcaagttatttaagttgttgacttttattataggatcattagttcctgttgtttaaaactcatgtgaacctttaagatgggctgaagaaaagtggatctgtactacaaaatgaggaaagggctgccagcttaaagttgctgtttttgaagattctacaacagatggctttatgaccaaccataagcagatcttaagtatctagtgaagaatttaactgctaacaaggaagaatttggtttgatttaaaagtaatatcttcaagcctgggcaacatggagaaaccccgtctctactaaaaatagaaaaattagctaggtgtggttgtgtgtgcctgtagtcccagctactcaggaagctgaggatcgcttgagcccaggacgcaggttgcagtgagctgagattgcaccactacacccccaacctgggccacagagtgagacactgtctcaaaaatacataccttcagcaaatcaagattttttttttttttttttttgagacggaatctcactctgtcgcccaggctggagtgcagtggcatgatcttggctcactgcagccctcactcctgggttcaagcgattctcctgcctcagcctcctaagtagctgggattacaggcacacgccaccacgcccagctaatttttgtatttttagtagagacggggtttcaccatattggccaggctggtttcgaactgctgacctggtggtccgcctgcctcggcctcccagagtgctgggattacaggcgtaagccaccacgcctggccaagaaaatcaagatttacctggtttatgtgttgaccagctatacacagagaattctagatttttttctaaaaattattatcaaacccccaatttcaccagtagaaaaagagatcttaagatttctgtgtttttttttccagcataactcagttacttatggctgggagaaaatatgtagggagataatctaatacctaattcgaaggaagaaaatatctaattctaagtcttgagttcttctcatcagaccatagcaggatttaacatttaacatttttcagaagcttctaatagacttcattcagttttttgtccacagcagtggcatttaaattactgtactttaagacatggaattgctggaggcttggaaacttgagtgcaatttccctagtacgacctccaaggagaatagagcaaaacagtggtaggaaaaactctcaaaattttacccaattgtatgttttctacattgtcagtatctagttttatatagttaatatgtacttctaaaatttctgacagtgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaatatatattgtttgtgttgaagtttttaacttttcagaaattgttgatttctgagctgggatatactatattcatttagtccaaaatgagcctagtaatgctgaaagcaaattttttgtttctcagtactttatattatatgactttctctgcactatatgttaatagcaagtttgttttcttgaattagaaaagtaacatcaaatagtataggattattttggctttttgttttttttttcccccagaattaatgggatcaccatcaggggaggggagaggcttgacctttttcccccttatttaacactacagagatgacctgaaaaggagagactggcatttgggttctttgagtcctggtagcgtgtaacagagtggttaagaacagacattccaagtcagactgcctggctttaaatcctggctccactatttcctaactctgtggtcttagactagatacttttctaagccttcattttcatctctggaaatggggccaacaatagtactttgcttgtaagactgttaagattaaacatcatgatccaaggctgggcacagtggctcatgcctgtaatcccagcactttgcgaggctgaggtgggcggttcatttgaggccaggagtttgaaaccagcctggccaacaaggtgaaaccccatctctgctacaaatacaaaaatgagctggacacagtggcacactgttggggtgatcaggcccaacaccaggccatgggggctacaaagtccagcagggtcaaaggaatgagaaaagacgagtgcataaagtgggccaggcacggtagctcacgcccgtaatcccagcgctttgggaggccgaggcgggcggatcacaaggtcaggaggttgagaccatcctaacaccgtgaaaccccgtctctactaaaaatacgaaaaaaattagttgggtgtggtggcgggcgcctgtagacccagctacttgggaggctgaggcaggagaatggtgtgaacccgggaggcagagcttgcagtgagcagagatcgcaccactgcactccagcctgggtgacagagtaagactgggcctcaaaaaaaaaaaagtgcataaagtgggtccagagggccagtgccagattggaggctgtgaaggccccaagctctgggagcccacactatttattggtgatcaaacaaagaagcaggtggtaaggacgtgagggtaaacaggtgagggcgtgaggatgtggggtagaaaggtagtggtacataagcgtagctgtgatggtttagcatttcgtttgatgtatatagaatatgctctgctgcttgagttaatggaggacatgtttacaagtaagaagcaaggaaccaagtctgtgcacattccagaggctacaaggggtcttaggccctgagccctgggttccatccaagccacaaggggttctatgccctgggcttagattgtggtgcggcagggcagccttccaccctttggcacagagcttggtgttccaaaggccacgaggggttttagaacctggaccccggacatctttcaagacttacattatgacagacaagccagtcctgcctcagctcttctaccaacatgtctccctttccttgtttgcaaaaccgccatagttatcattgcttgttcttggcggtggctttctctccagaggcagcttccacatctgcaggctgtataaagacaaacaacacagattaaaagcacaatcattattgaaatcacagagcctccaagtgtcttgatcgattttagcaggttaatagctgctaatccatctgcagctccttcaagcacttcacttcctggcattagtgtcagatgtgcctgagaggcttgaaatacttgttccttcagttttgcaatatccaaagataaatttccagtatgacctttttgtttgtttgtttgttttttgaggcggagtctcgctctgtcgcccaggctggagtgcagtggcgcgatctcggctca

SEQ ID NO: 15827 - DNA, 30508 bp, Human
gcttcattttgttatgatgagactttataaacctgatctttaaaataaggttcttaaaatttttaaaaatttattttatttattttttgagacagagtttcgctcttcttgcccaggctgagtggcagtggcatgatctcagctcattgcaaccttcacctcccaggttcaagcgattcttctgcttcagcctcccgagtagctgggactacaggtgctcgccaccgtgcccagctaatttttgtatttttttagtagagatggggtttcaccatgttggccaagttggtctcgaactcctgctcaggtgatccaaccgcctcggcttcccaaagtgctgggattataggcgtgagccacggcgcctggccaggtgtttttttttttttttttgaaacgaatcttcttctatttcacaagtggaaatcatccaggaaatgtgcacctcaagggaaatccagtgaaatcttgattctgggtagaacatatgagaaaagaatagtgtagcactcactgcttggctatttgggataggatctgtcttaggtccccataagcgcttttatttctgtgtaatttactgcaaaactctatgaggtaggactaatattatcttatgtcaagggttaagacaattgagacttgggggtttgtcaaaaataaaagattttctgactttggagtgcgatgtgcatttctgttgcacagatctccaccaagggcaaattcgatggcaatgacaatttgatgtcagaacttctcaggaaaggctctgatgaactcattcacactgcatgtgaatgactgagaaaactcgatgtattttcacttttttttttttaagaagtaaacctgggtgttttgtagttctatgagaaaatgaaagctgaagctaggctatagatgaaaagttctattcattattacaatttaataatgcttccaaaatagcaattcacttaaatatacctagttagggtgttaagaaatactttgattaaaaccacactgcaaaatagggaacttcaatggactgctttaaactctcgacctcaaaggaaggaaatcaactaaccgataatgaaaactagcagaaaaaaaaaagcttaggatccgtaacagattcggagtcaacaatgacatgactcagcattttggggttcaattaaaaccaggcttgtaggttgcaggtcaagttgtgtttcggtgtgtaacgcataaaacttcttgttccacgctccgcggtgttggggattttctactgcatctcgacagcatctcgggtaacaaccgagcccctcctcgcagcgtaagtcgtaggagccctcggccattcttccccctccctcccgccgccggtcccagcatcggtccgggttcgcttctacgcaggttcagcggccgcggacacaaaagcgcccctgctcgccttcgatgccgctgcttggtccaggggcttctgtgggattttaacacgctaaggagggcactcatagtgttttaccgagaaacgctttcgagctcggatctttggtgatcacttcaagaatgtattagttttctttgtagcttaaaaaaaaatctcgttcgccaagccacctggcaccccaaacactgctgcgagcgctgggagggaaagggcgggagcgcgcgggctccgtgtgctgcgagggcgcctgggcggctgagataaggcggtggcaaacgtcgcgctccgggccgccccgccagactcggtttcccccgctcaccggcctccccgcccccaggcagggtggggcggggcggacgcgccacggcgcgcgaccaatcgacagcgccggggatgattcaaaaggtcgaggagccaatgggagccccgggcggcctcgccggtggggaggggaggcgaggggaggggagaagcgccgcgaggcggggccggggaggcgcgcgcccggcttgcgggactgcggggcgcgagagcgcggccgggtagcgtcgcgcgcgtggatctgccgccgggttgctgtgcgactattctccgggagccgtccgtgtcaccgccggaacctggcgcaggtgagtgcttccacccccgccctgctcccagctccccgcggcgcgttcttcgaggggccgctgggggaggaagcccgaggccggcgcaggggccgggccggggaccctgggcgcggggcctggcgcggcggccttcccctcctctcctcgcctcctcgtctcctcccctcctcgccttttctggcccagtcgggtggtcggggcggcggcgggcgaggctggagctcgcccgagccgggcccgctgcggaaatggagctgggggttttaaactgcggacgtttccctccatgttggcggcgcggcgcggctgtggagcggcggcggcagggagggttcgtgggcgcctttgtcctgccccaccgcagcctggctcccggcccctccgagcgcccgtctgacagatgagcaggcggccccgcggtcctgcagtaggaggctgacagggcgcggcggcctggcgggacggggaagggtctgcggccgaggtgggcttagattcgcgctgcttgtcactggctttgagggtcgtggtcgtcgcggtttggtgattctccaggcacactgcatggctgctcgctcctatgcgttgaattccttcgcccggacagtctcaaaaatcgggtatttaggcgggtgtgcgtgttcctgctaaagcacggtcctgctttttcacctttttgagggttcagaaaaatgttctaatgacagccagcctcgcactgccagtagcctcaaggggcacttagtaaagcacttgctttcggagggctttgttgaaggcgctttcccagagtgattacggggcccggtcgggtgttcacacgagggcgcggtagataccgtggtccgcgcgtggacacctgcagcgcgaggcgcggcgcctgggcagtgccagggtgaacaggcccccggggaccttgcacgtaaacacgtgtagatctgtagttacgcattgtagtaactggtgtgtgggagaagatggagctacggagaagagcagagggatcctaatttagattaggcaacaagtccagtttaagttttgtttctcaggctgcctgggaagagggagaagaacgagcaggaggggaatgatgagctgcccaaggatgtttatggggaagaaggcgcttctgcctttacagccaggaaggtggcctttctgttgcttcatgaagcaaagggcgcggagcaaggcccggggttcctgtttgcattttgcctagtggggctaccggggctcaggtgtgaaaaggaagctgtccaacgtcattcgagcgtcttgctctatgccacgtttagatgaatttggagaagtgaaggaaagatggctggagacccctgtaatgttaatgagcagagaattgttgtgttcacaaacagtaacataccggagctggaatgtgtgaggattgcagtgccagttgactctgaagttagcgggcatctggcttaatagagaaaaacctgagggtctccgtgtttttcctgtttatggcgaatgaggacattgggtgcagtgaacaaaatttttctttacaaacacacttgcctaaaacatctcttgtaagaaaatcctgtgtgtatcttgactcctgtaggtgagtgcatagtgagtgacacgaacaaatgtggggcttttgtgtgccatcctggctatttcactcctgtgggggagtatattaggatgtgattgcactgtatcctcacgtttgacaattgtgtgtggatcttgtgtaaagtgggggtgcacatcatgttgttggcttcatcttttggaacatttgtgtataagataatggtcttctaagaagaatgccggttcattttgtttgtttttcaagcaaatcttaattcttcttttaaaaagtaagctttagagacctaacaggtatccaccatatgtgttaacttgttcaacccagaataattgataagaatctttttggcactggcctgcgtttatattacacagatactgtgtatgtggtgtgtaagtgcaatggaaagatgccagtaaataagtttttaagaacacgcagaaactgttcaagggtcttttaaaacctcaagtagcccctgcgtcctgaagggcttgtgtttcaaaagtttataaagagttttttgcaacttgagcatcttcctgtaggaagacataattgccttcttttaactctggctgaccagtgtaggagagctagtactagtaagagtggtttgattttggggggcctagggaggaggagggggctcaagagaagagagaaggagggtacatttccttcctctttctttgtacttggaggctctgagctaaatgttgaaataggcaaagctggatgttgtcaccttccgtttttatgcccctgctcatgcagaggtgttcactgcccccctgctccctaagtgcccctcgggtgactcagccaggcctgacttcatcccgaaaacttgtgggctcctccccactactccaagcccaaacccattcattaccccagtgatgcccaatctcaggtaggtgtagggaagaaagctgcctctcttacctaatgtgttaattgactgacatcctctaatcaccagataagtacttgtgttttctttcatctaccaacctagctgccatctctgtaaactagtagagcttgttaagttttttcacagacgattaacagtgaaaaaatgtggtggttaagaaaggcctccctcaccccgcctccccccccactctcccactactcccttggggtaggtaattcaactttctccttaattccagagtcttcaaaggttcctaaatgttgcttttattgtatcatcagctcttaacaggagccagtgaggaatgtacattgataggcttggacaatacatcaagaagtgcttagttggtgaaatgaaggtgatttgggggacagctcatatctgtcctactggctgccccttggacgtggccccagctagttcatgtggtactggggaaggtcggcagccctggttttgttgtgtggaaatgtgattccgctggtcagccgatggagcggcattactgtctggcagctggaagtacccagctatcaattgatatttcaaaaagggtggcagacaggcctcacgtaagtggcagttcttgcagattgcttgtggattcctagagtattgtggggcttgtgggccatgttttgaatcagaggaaaagaatgttataattgggggttgatggctgctgtaggcttgagagaagtgagcttggatgaaggcaaccaccctggcttaggtgggtggttggcagagttacttggtatgcatttgtactttagctgtaagagttgaaagctaaataacccccaaatttattcattacagacttggaattatttttcttcctattgttgggttatagtcatgttaattgtacatccttgattttcccagtctggtttatagtttgctgtttttaataaaggcaatttgttaaaaatacaattaaatgcatttttaaagccattgtaaattgatacgcaaatttacaaatgagaaaatgtgttctttgtgagattgtgcctcattttttgattagcgagaactgtgatcacggtaggtgggtaacattttacatagtgtgaacttatggcgcctatatacattgttataattaatctttagtgtcacatagataacgcagtggctaaatcatcctctcaaatgattccaaatgagattgaatgtagcctttctggccctaaaatcctgaccagtcaattctggaaagttgtattttagtgatcagcctgtggaaaaagacaaatacataaatgtgtatgtattgactcaaatttttttctttaaaactattcaggttaattatagaaaatgccaagtaggaaatttgccgatggtgaagtggtaagaggtcgatggcctgggagttcactttattatgaagtagaaattctgagccacgacagcacctcccagctttacactgtaaagtataaagatggaacagagcttgaattgaaagagaatgatattaaggtaagagctcctttggtttatcagagtgtgtttacagtaagtgggaaataactctaagtatggtttctaagctcaggatagtcagttcagctcggtttgaaggcagaggattgagctcttgctttgggtcacatactgtttttggctctgggaatgtatgaatgaggcatagtccttgttcccaagaagctcacacttactgggaaagacagccatttgcatctgttggtcccctgggtttactacgttctgtgtctggagtttgctgtgggtggtgttgagtgtatcaagggtagagaagagccctgggcttcaggggaggctttcagaggcagtgacacctagccaagtgctgagaacaaacaggaaaaacagcagttgatggggctgtttctgcagagagggcagtatgccaaagtcaggggtctgggggacacagtcagccaagtgctggaagggggtggtaggggagggctaagcaggagccaggctgggggggcttttatattccatgcccaagggtttgggcttcatcctgaacaccaaggatttaatcaggagagtgacattaattagattcgagtctagcccagggcttttcaacctgtctggtgagggcctgggttttaagatatctgatccgtagtatacaaacatttatataaaatgccataaaaatgagttactagaaaaataaagacatacacaatagacgactcacagttttactatcagattcgatagatatgagattactttgtcaaaatgctataaacatttccatacacctatttctcaattttggtacttgcacagattagtaacgagcatttctaggacccatggctgaggatgacactttgagtgctctagaccaggaataaagcacagaaagtaaatattttagactttatgggagcggctccaggcagtatggaagggagcagacatggcagtgttccagtacaactttatggacagtgaaatttgaattttggataattttcacacttcaggaaatactgttcttttgattttgtttgtaatcatttaagaatgtaaaagccattcttagtaggaaggccacacaaaaattggggtgagggacttggcctggggcataatttgtctacatccctagaagcaacataaggagattcggagtaggtggggacacagtgaaacagttcccagtcatccaagctcatgttttattttcaagatctgcttatgtgttttgttcagagtgaaactgtggtactgtttttttttttttggtctgtgtgcttatttattttgtcctgtcgtctcagttttaatccatgttaattattacccttcttgcatatggtgttggaaataagtacagctaattggtttagatacattcgtttcatggaaataccttcaaagaacaggaatggaaaggctgcatttgtctcatgaaagatggatcattatgaaagcattttccattggcttcatctgatccattctcagatcctaacatttcccgtgctgattttagagttaatggtagcagttcctgcctttgttatcctcttctagtgtgggtctgtctgtatgtgttatgatttgtggtaaagctctttgccttcttccccctttctagcctttaacttcctttaggcaaaggaaaggtggctcaacttccagttccccttccagacgccgagggagtcgatcaaggtcacgctcccgatcccccggtcgaccacctaaaagtgcccgccgatctgcttctgcttcccaccaggccgacattaaggaagcaaggagggaagtggaagttaaattgactccgctgattctggtacttgtgtttatccttatacagccttttgtcttccgctttatgtatatatttactcaagttacttgcagttaataatattaaaatgtcactgaaacatcaaatctaagttgatgactttgggagttttcatataaaacaaatgtttggaatagaaagttttaaatatcaatggaaaagaatgtccttcagttaccagaaatgctatttaatattttagtttttaaaaaagcagcgttcaaatttgaaatagatgtagcttgtagattgaactgcgtaaggtttttacagtgtataaaagttcatatcatgtatgaaatggtaagacaaacctgtattacggaaacattcttactcttagcatcattatactttatcactttacctattcaaagatgattttagtggaattactttcaagatgtaagctttgaaatatcagggtgcatggagcctgtagatcttgtacaaatagtattttagatagtagaccaaagacaaagtatgttaagtaaaaagaataaaagtaatcttctattcacttaatgttaacctcttttctggatagaaggcacacagactttgagacagagtcttgctctgtcacccaggctggagcgcagtggcgcaatctcagctcactgcaagctccgcctcctgggttcacgccattctcctgcctcagcctaccgagtagctgggactacaggcgcccaccaccatgcctggctgattttttgtatttttagtagagacagggtttcaccgtgttagccaggatggtctcgatttcctgacctcgtgatccactcgcctcggcctcccaaagtgctgggattacaggcgtgagccactgcgcccggcaacagacttttaataaactttaaaaactggattatatacatactgctcagtagtcagctttaagacattttaaaatattgggataacctttcagagtgtatttttctacatcatttttgttgttgtattctatagtatggatatatggtaaattgtatacatgtaacttaatcgttaaagtcagctctgtcaatgatagacatttagtgtttttccttccatattttcactattacaaacaagtatttttatgtaacatctgattatttccttaggatggattcttacaagtggaactgctaggtcagctgtatggtgcagatttgaggcttttaatacatattgccagattgcatcaagaaagtttatagtagtatcagtgtatgaatgctcagtttctcattctgagtattataatttttttttttttttttggagaatgtggctgtcagacattttcaacttactgttctaacttacattttgaattagaacattttaactattagtggctctctttaccaccccgggactccaggaacagatgctgtgtgatactttgttatcctttcatttttaatatttagtgactgctatatttttacagtgtaatcttacagtcctggtgtcacaagaaccacagaagctttgcctcttacctggtagtgccttgggcctactgtgtgttgcataagtacccactatttcttagttttccattatgggctattttggagcagtgaatgtctttttgaatgtcttttgttttttatccagttaatgaactaatttaccaatttttactttctctgcctttcatagtaaatacccctaaaatctatcaatgaaattatgacattcagtctgattacgtgaaagatcaaagttgtttttttttttttttgaggcggagtttcattcttgttgcccaggctggagtgcaatggcgcggtcttggctcaatgcaacctccgtctccgggttcaagagattttcctgcctcagcttccgaagtagctggaattacaggtgcccgctaccgtgcgtggctaatttttttgtatttttagtagagacagggtttcaccatgttggccaggctggtcttgaactcctgacctcaggtgatccacccgccttggcctcccaaagtgctgggattacaggtgtgagccaccgtgcctggccagatgaaagattttatgtagaaatctatccaatatttcagagactgggaaattctagtcagttttattccttttcatttttaacaaaatgagggttaaattcgtcagaattaaggctgtgaaaaatctgttttattgcttgattccaaaacagtaagtttttaccatcatgtttctttttaataagttacagttcttttgattaaatgtttatattcttcaatttagaagccatttggaaatagcatcagcagatataatggggagcctgagcatattgagagaaatgacgcacctcataaaaatacacaggtgggaaagtgttccctttcatcttggttgtttttttttttcttttttttggttaaaagtgactctcccttgagaagcacattgaaaattgtaatattttataacctgttctaaaattctgtccttaaattaagactgaatataatttcacaaatttattcttactagtgtatagctgtattgagatgctgaaatagttaatgcagtagcattaatggtaattgttcactgcagatatttaatttttaaatttttcatttaggaaaaattcaatttgtcacaagaaagcagttacatagcaacacagtatagccttcgtccaagaagagaagaagtcaaattaaaagaaatagattctaaggaagaaaaatacgttgcaaaagaactggcagtgagaacctttgaagtgacccccatccgggcaaaggacttggagtttggaggagtacctggtaggcctcagagctgggcccagagagggcaggtggggtgagctaggggtggttgccacaaggtgaactggaaaggcctctctgaagacatctgaggcaggcaaggtaatgagcctggtgggaacctgtggaagagccttccagagaaggaacagtgggtgcaaaggcttgaggtgggagcattttgagggattatggagtagaaaggatgccattgtagctgtgtttaaaacttttagcagtctgttcagaggttttgagcacagaagtacaaagaagtgataaaggaaggttgatctgggagtttgtatagcatagatggttacttatcagggacagagagctctgctaatagtcagacctgaggcggcaggggccagcagtgggcctcagctgcctgcataaaatgggatcccggaggctgccctacctgctaggcgggttgattgtgagggtcaaagatctgaagtgtgcagagttttggagttactaagtgggtggaactgatgaaattttatgagctagtaaaagaaaagacttcttgtctaaatggctcaaaatcctgcatggcttaattgctttgtattttgttataacctttggctagctggcctgttacagatgctgtccagcatcacttaaaatctgcacacattacatgaacgtgacactattttaattgttagaaactgaggaatataaagttttttgttaagattaggctgataatttttagatgttctgatcttcagtttgctggagtttcaacacattcgctccttagtggttggaggtcaaatgttttagagcttggtttctgaggtgggtgtagctattcaatgttggacctctttctttttttttttatttttatttatttattttttttactactttgatgcccatggttgccaggccaccagaggtgacaggtagagatgggagtttttgatggtacattagaaattggtttcagacagttagccagataacgagttctgatcttaacaaatctaacatgattcttaaataaataaaccagattgaaatttgagcctcgaatgttcatgaattgtttgcaggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttttgattcaagtcctgttctacctactgccaattggaaaggtacgtttatggtaattctgttttgttttaataagatgaggtctcactatattgtccaggcgggtctccaatttctgggatcaagtgatcctcttgccgcagcctcctgagtcgctgggaccacaggcctgtgccatgctgcccagccttagagtagtttaaaggttaaaggctgttgttggtcataattcccaaaacttagttcatgaagccatttctcttgtgctgtctgtataacacttgcttattaggaggaacttaaaaaaaaatctgattgagatttcttgtgtaacttttcaaaccaaatagaaaagaataggctattttgcaaagtagccgactctcagtggaggttgctatggaaaaaaaattcactcttagtatgtgtcatttcagatgcagcattttaaatgattaattgataggctactgggctcgatggactttagtctacatcttttactttaaaaaagtatgaaaagtttctaattttcatctctttcagaagcttgttgtcaagaacattttacgttgttttcagattcctgcaatatctttaaaatttgtctctccattgctaagtgtagttttttcttctttcagtagaatcctttacttggatatatttaaagaaacatgagattccctaagtaataaataatttatttaaagatcttattcttagggctttgcaagtttgccaactgtctgtaaaccaaaggatcggttttactggtgaatgccagtgataggagggtagagctgcaggcttaatactgtggagtgagaccataactttagtggctctagcaagaatttttgtgataaagaccttcagtcatttctacagtaagcctctacagttaaattcagattcatttagggtaaggtgatttcagagtatcaaggaaagcagttttggtgtttaaagtcatatatgtatatactcatagactaaagtgactaaaagcatatatattaaaatatatattaatattatgcagtcatcccttgatatccttggggagtggttccaggacctcctgtacataccaaaatctgaggatgctgaaggccctgataagaaatagtatagtatttgcatataacctgtgtgcatcttccttgtatactttgttgcctttaggttgcttataatacctaatacaacgtaagtgccatgtaaatagttatcatactgtattagggaataaggacaagaaaaagaagtctgtacatattcagctcagatgcaattttttccgaaatattttggatctggttggttgaatccatggatgtggatcccgtcgatacggagggctgactgtatatttggatctatatattcacagattaaagcctaacacagcatttactagactcctttaatagataaggatcatctgaaattagcatgtggcattttactaatcctgtgatctcaaacagcttttacgtttctcttgggagaggaggaatgctagctaatgaaatctgtagctaatgataagataaagtagtttagcccagagcaaatgatactatatttatattttacagtttgaaatgaattgctacatttctgaatagttattttgtggggtaaaacgtggctgcattgagcaagtggactttttactgagccagttctattgggtaccatgcctgtgggtatctctgtgctgaatgctgtgagtgatgccgaatgaagagaggagatggttctgatgcatgatgcgtgctcacagtctctctctctctctctctctttttttttttttcttgagacagggtcttgctctgttgcccaggctggagtgcagtggtgcaatctgcaacctcctcctgggctgaagtcatcttcccacttcagcctcccgagtagctgggaccacaggcgcgtgccaccaggcttggctagtttttgtattttgtatttttgtagagaggggatttcaccatgttgcccaggctggtctccaactcctggactcaagtgatcctcccaccttgacctctcaaagtgctgggattacaggcatgagtcaccacacctggtttctcacagtctcttattgcagataaaagaatcacatgaaatggttaaataactggatgggcaatatatatataatatatagcagagcaagtaagcatatgagtatgcgtcatcaaatagcacttgggtcatagtagagtggataaacagggtagagcccaattgaaaaggaccccacaaatggaagacaatggaatcatactgttactttgtaagagtatggtagccattggtagatgtttgagctagggatccactagatataaaggtatttaagcacatttagtcttgaggtggtggtacacaggagtgtggcagggagcgtggctgttgcagttgcttggtcctacactaggaagtcattactgaatttgtatttaagataaattcctgaaggtggaattgcgtcattaaagggcttgccactagggtttttgaaacatattactaaatttccatgttacaagatatcttccttcttgggcgtgttgaaaattaagtgatactagaatatatatatatgtgtgtgtatatatgtatatatgatggtgatgtgcttagtaaatttgtaaattttttttcttttaaggttgtagaaggaacgcctcttattgatggaagaagactcaagtatagattaaatggtgattttctttttttaagactcaaattgatgatttgatagcttaaacttctaagtgttaaactctttgttaaagctgattagaccagagtagtaagtgataaattatttcttagtagttggaagagcaactgtttatacctgtagccaacttgtataaattatgccattaaagtaacatagcctcttagtcactcttgtccactctccagttttattttcttaatagtgctcatcactgttagaaatcattgcacttgtctaggattttatcacctgaggtgttacacggatgtgggcatccaggccactcctgctgcgtgagctgctcttgtccttgctcatgtcctctgggttgtcccttgaatattcgtcacacacacttcctgggcctttgcctggagaacttacccccaaacgtctgacacctgcatcttcacctccatctgtcttctgctgagagaagccttcaggtccctttctctcccctgctctgttttgtttttctgtctgacatttgtgcctccacacatcagtgtatttgtctcttcattagggtctctccactagaatgtggcttcatgggctaggacttggctatgttcattgtgacactcttggtgctaggaagatgggcatgtagtgggtgctcattcatatgtgagtgctggatggatgagttgtgagcttgctgggcagctcaataaatggatagaccttgttccctgtgggtccggcatctcgcactgtaagagcatgtgctgagtgcttcagtccagctttgtcatttgaagactttggcaaagtacagatctattttgtagtcatccttgaatgattttccatttgacaagacggagtagagtgttttccttttcttgagaattacattatgtattgtaatggttgaactttttatcctttcaattcttcattttttaactttggatactttgtttagagacttacgcagcatctactctgtctgcagtcactccactgggttctaaaggggaagccaaagatagtttagacaccttctgccttttagtgccagtcatgtgataaaacgtctcccccagctccagagtctgacccctggtgggtgcttaatacttatcattggtattgttagactttttgttgcttttaccaaattctttgctgatggagcaagttttagaacctttggcaccctccctccctctggtggttcacttaccacaccagggaaggtgagtctggggtgaggtgggttgttgactttgccgccaggtcctttgatttcagtgttttgtgtgtttctctgtaggtaccaattcttttctaagtaatcttgtgttatattttcacttccctctgaggggtgtggtacattcagagactgagcacagcacttggacatggagctcttggagccagtgggggagtggctggccaagttgcttgatcctttttaaaaatttcctcatctaattactctggttcaagtattgagatttcttttcgagattttacgattattaactaaggaggttcctaagacattttggatgattatttttaatccacataggctagagagcaaaagactgctttatctaaccattcttttttaaaattacattttatgaaaggtaaatgaatattttcaaaagtcagaatttagaagttattgtttggagtatttgtggaaaatgtggattcagataatttgagacaactattttactttacaaaaggtttggttttagaattctcatataaataacagctacctcttttttgcttttgaccgtttatccaaatggatttgatgactttttaggatcacagctctttgaggcactcagctcctttgaaagcaaaactatttctttagccaaaagaaaaaaattggatcttccagtgagcctttctgtgtggctgcaggactagcccggaacgagagttctgtggagcgtcacagggcgggtgctttttaacttggcattgcacgtgaatgtccccgcctgctgtccctaccccccaggtactcgcagtcccctgcctagcctcgggcatttgtgttgtggcatcttttctgcgggtggcatgttaagatctctgttctggatgatagagttttactagaatcttttgaaaccattattggcaacttggttaagtataaatatttataattttgtaactaccaacctggctcggtgcctgacccctggtaggtgcataataccctccccttaggtaatggcattagactttaaaatatgtgtttggcccagctctgttaataattagccatttgactttgtgcctgagagtttggattgtgggaattttcaggttgcacttcttgtctgttttcccttaattaaaagcaaataatgaccatttgaactgaaaaagaatcaatatgttaaactatttggaaagttctacaagagataatggtatgtatattgaaaattatacctcagacattgcttatttgcatatttgtgtgtatttagtctgaataatgaaattaagactttaaaaatgaacattgcattgtttcatagtggcgtaagtttcatgtgagccttgggttaatattaattttccacttccttttttttttttttttaaaggattctatgcttttatcctgacatctgcagtcatcggaacatctctcttccagggcgtagagtttcattacgtgtacagtcattttcttcagtttgcacttgcggccactgttttttgtgtggtcttgagtgtgtatctctacatgcgctctttgaaagcgccccggaatgacctgtcgcctgccagctctggtgagcagtgatgaattgcatgttggatgaatgcgtcccagagccctccagcagccatttccagatttgaatagattgctttttttctaacttcatttttgggaaatgaagagaagtaagaaaaaatgaaaagatgaagaaaaacgttaaagagatatgaatttaaaggaagaaaatatttttgttttaccttcatactttcttactcatttcttttttttgcagttgcttggtgacagtaagacgtttagtaaacttacaggcattttgacttatgacaaatattatttctttgtccaaaatagtaaacactctttaaaaaacaaaaaacaacagaggttactggccgggtgaggtggctcatgcctgtaatcccagcacttcgggaggccaaggcgggtggatcacctgaggtcaggagtttgagaccagcctggccaatatggtgaaaccccatctctactaaaaatacaaaaatcagctgggcgtggtggtgcacacctataatcccatctactcgggaggctgaggcaagagaatcgcttgagcgtgggaggcggaggttgcagtgagccgagactgtgccactgcactgtagcctgggccacagagcgaggctccatctcaaaacaaaacaaacaaaaaacaagagaaacgagaggttacaaattggttgatgctgacctgaagtatttcaatataaaaaaatgtcgcctatctaaaaaaaatggagtgtaaagtcctttgggggggcccccatgattttggttaacttttttaagaaacctgggcccccggctcccccaaaggctggagcaactgccttttcagtcgggcaggcatctcctggttccgctcgtctgtgccgtcctgtctgcctctcaccaccagagccctgctcagggtcttgcaggcagtggaattgtgagcctggatagtgggcggcagtgccgttgtaaagcctcctgactgggtttggaatgctgtttgggtaaacacttttcctttctcaggaaatgctgtctatgatttcttcattggccgtgaattaaaccctcgaattggtacttttgatctcaaatacttttgtgaattgcgccccggattgattggatgggtatgtctggttttttttcttctaaatttcaattcaataggtctaattaactgctagaaagaaatgtagaccattcaaaaataagcagtgggtggtatatttttagggataattatggctttccataaatctatcaaaatactttcttgtaagtattttccagaggtttaagatgccctgttacaggttatgacaaattaaataacttttctttgctttatttttattatatcagtttatatttatgtaggaaagtgatagtgtggatgaattaatgtaagaaaaaatgcattttcctcctttttaaattttacctagttttaggcttggagttgcagatagagagcaaagagttcccttccacccttcattctgtttctcacaacattaaccttggaggaaaccgtagtgtagtgatgaagaacagcagattaacatagtgacagcattggttaccaagtccacaggcctcagtcgagttcaccagtttttccgctgttgtcctttttctgttccaggaacctcgacaggactccacaatacatttagttgttattccttcttagtcttctctagtctaatagttgtttaggctttccttgtctctcatgaccttgatactttttggaaggtactggttggttattttgtaagtgtccctcagtttgggtcattccagtgttctctttgattgcggtaaagttacccactgtgacaggaacacagaaaggatagctgtgtccttctcagtgcattgggtccaggggcccatggtgctgagatgtcttattcctggtggcgggtaggagttacggtggcgtctgccaggtgtctcagctgtgaagctcactcatgcctttgtagtgctaaggtctctggggaggtgctttgaggctatatactttccccttttgtttcaggtggttattaacttggtgatgcttttggctgaaatgaaaatacaggaccgcgctgttccatccttggccatgattttagttaatagtttccagcttctctatgtggtggatgctctctggaatgaggtaattaattttaagagccgaggccttggagtcagatggctttgagtgggtgagtgacctgtcagagcctcggcttcttgcacacaaagtgaggggagcatggcctgcctccaaggctgcttgagaggaggacgaggccatccatgtgaagctgacgagggagcactgacaggtgggaagtttctaggcatttgggagtgcttcagtgtttatcagctgttcttgtgtttaaaagtaatattctaaatatttaagattggtggatcttggttttgtttttgtgggtggtggtaattatggtatcacatgaaaatggatggattattactaaattagaatggtgtttcttggactgtcaagagtcacctagtttttaaataatgggggagatgttttattgttaatgttttaaaatacaaagactagctctaattagatgaatgtaaaatcagaaatcaagatgcattgaggaaaccagttgaaataaggctaagtttccatcttgtgtcttttttcatacattgattagtctttctactagttgaagactggtaaatgttttgtttgttttctctgtctcagccagcatattccttttaaaaattttgtcttcctcaggcttattttacaagtattttatcgtatttactgttatctttgtaattatctccaaattccaactctagttttctttccatattaaaaacaaatctggcagctgtacatcataatgttccaaaacaagttttagtgacagtctgttgagacaatctgctgacattttgagagaagaccttttctctttgagcctggaacattaaaaaaaattatattatttggtcatcaatactatgtatctcccccacccctgctggctggtctttaattttggccttctatgcaaaattgcagagaacatttagtcagaacaacttcgcaagtttgatattggtgtttcgatgatctccttgttatttaggaagattagggccactttgaggtaaacctcaattacaagcggtgggattagtgctatccgctaattacgggttcctgttgcgctcctaccacttcacagaccctggctcagagcttgggaagctgtgaaggtggtgataacacttcaaatattgactttaaaaattccacgtcgacccaaaattaaacatgtttttgaaattaaaaaacaactgttttgtaaatgcacttactgttaccagtgtagctttgtttgctgttatagaatgaatcgccaaaagagcatataggttacagtttgcaaatcaaatgatatttcacagttgtgctcacctcagaggcttctttaaaccttcctttctagtagctttccactgatcagtgattatttcttctggtttcttctattactagctttctgccatgttgtggttgtcactttttaattggcttagaagttgatattttctatagatttagccaaacattgacttgtgttaaaagaaaattttttgcatcttaaggcaaaacgcttaatgcaatattaacatagccccaggggtagagaactagagttaggaaattgttttctgtctgttctcagtatctcagccagatgataataagcttcttgaggaaagattgtattttatgatttcttcagcattctggcatgccactgggcaattagcagatgcttaataacttctgtcaggtcacttgatagaaatccctctgtattcaagaatgtgctataccttaagaaaactgagactacctgtttaaatatgcatgacccttcctctgagccgtcctgtgaaagccttggggctcaggagctggtggggctaaagtcctccccctacccggcattgggtgcttaccctttgccctctcactgccactcaccacacctgcttttatctgctcccaccaatttgtcacctttatcctcttttggaccaggaatcagatcacaggccttgagagagaagaataagacactcttggggacagaaagttaaaacaccgtgtgtcctcacttatatgtgggcgctaaaaaagttgatgtcatagaagtataaagtagaacagaggatatgggaaggtgggaagggtagggggaagggaaggatagggagaggtttgttaaaggatacaaaattaccactcgataggaggagtaagttctaagttctagtattctataccactgtaggatgactatagttaacagtgatacatagtttcaaatagctagaaggatattgaatattcctaacacaaagaaagaatgtgtttgagatgatggatatgctaattaccctgattggattactatatattacatgtattgcaacatcactgtgtaccccataaatatgtacgattattacatgtcaatttttttttttaaagagaataaagtactctggttaactaaagagtataagcctaaggagctagattttgtgagattggtttttctgtttcatgtgacatctgtttttctgttccatggcctatttgctttcttttctggaaaaaaatgctatttagaggtaccactctttttctttaacctagaactttgattctccaacagagcttatactggctaatatttctacatcagtggtctgtactgaggttctgggtagtttagagattcccttaggccagaccttcagagtgttgaccttggtggtggttccgtattctagagtctggcctgcccgtatcctgggccagaggcgatctggctcatgctaaccaaatcaccagggagtaatgcacttttattaatttacatgagaagcgaagctgtcagttcaccatgttgccaggcagcttaatttcttctgtggaaaatgcacatgaaatgccagattatgaacagaaattagattggtccatgtggaattgaaacaaaaagagttggtgatcttattccttcagcaagcatattttgaacacttctctccatggcgggcactgtgctaggtactggggtggcaaaggtgaaaacacacagcctctgtcttttagaggcttttagtgtagtgaagagtgactagacaagtacagtaacccaattactgcagcctactggtgggtggtgatatctgagaagtgcccaggtctgagcagcaggtcaggagggcagcagagggtgtagggcctatgtggaggttggaggaggggttgtcagcagaggggagggcctgggcatgggggcatgggagatgctttagagatctgttatctccagagcatgagcgagaggctggcgtgacgggagaatgtgacagcagaaagacctagcaggccaggggaaccagatctctctcccctttaacaaaaaaatgttgattgtggacccgcccatagcactttttacatttgcctgtaaactagtactttatttgaatactttaaacacagaagctccttctccctttccccgtctgtatccttataggaagcgttgttgacgaccatggacatcatccacgatggatttggattcatgctggcttttggagacttggtgtgggttccctttatttacagcttccaagccttttatttagtcagtcatccaaatgaagtgtcttggccaatggcttctctaattattgttctgaaacgtgagtattaattttagtctcagtttaatttattaaatattatgtactgaggcttttatgccctgctgtctacatacttgaaacatgccattttgaatggccagcattagctcagtttgaagccatttatcatgagtaataaaaaatctgcattttgcaaagagaatggatggttcgtacttgggttctcagtagtacttgaaacagattattttaaaccatcttgcttttaaatttaataaatttaagttgttttaattcgttttggtaaccatacgtcttttctcttgagtgcctgctttttctggtaggcatcttataaagtaagaagatttgtcttgccttcatagagctcacattctaacaggagaaataagacattcctgccttgctgtgaggtgtgtgagtgagcactaagaggggcttagatgacgggtgttaaagatagagagaacttctctctggggagcgttagtgtgaacttatcggaggatatggtgttcgattggagttttagaggggaaaatgggatggggagatcgaaaagtcaggcactgggaacagctcagcaagggtgtgtggtggggaagtgtgagatgaggttgggaaagactgagaagtccagtttggctgcagctgcggtccaccagggtcagtcatggattttacttcaggatgaattttcattgttcttacactgttcactaaacacttatactagaggttgggcagggaaaattagcagtgaactgcaaatacagatagttttgctacacaagttagtatctgtggtagaagaagttcaaaccattggttaaaattaagatttagtttcaccagtggtttggatgtccatgtcatccattttattattcaagacagtgtattttatagttcagctaaaaatggggaatgtcttagtttgttttgtgctgctcgaacagaatagctgagactaggtaatttgtcatgaaatttatttggctcatggttctggaggccaggaagtcaaagagcatggtgctggaatctggcaagaccccttctgctgcagcatcccagggtggaaggtggaaggacaagagagagtgagggagggcaagagagagtgaggaagagcaagaggggctgaacatacttttataacaaacccactcgagatactgagcccactcctgtgatagccacattaatctgtccatgagggcagaaccctcatgacctaatcatctcttaaaggtgctacctctccacactgttgcattgaggattacgtttccaacacgtgaactttggagaacacattcaaaccaaagcaggaagtaaagttattctcttactagtttattgaggatcgactatataatagttaaatgtcagtgatagattgatttttgacattctgaaatttggataaaattaggaacttatagacttaaagtgggattcagcatgtatttaaagtgcaggatgttttggtgctgattctaagctagtgtttgataataaaatgtttgtgccatggccagtaggtataactaacagatgatatagcttgtaattttgattatactgaactctagtattgattttattgtaatgtaggctatcttagattttatctctttcatggatgtaactatatttgttttgccttcagagcgtttcctaggtggatgattaaagtagtgtgatagatttcggacgggttaccatctttttacatagtgggatttagaggttttgagttgttcttaagaatcaggccaggtgcggtggctcatgcctgtaatcccagcactttgggaggctgaagcaggaggatctcttgagcctaggagtctgctttggaaatttcctcagagcatagaaatcatttttaagagaaattacagatgctattaagcattagagtataactaagttattaacataggaaaatattttaaaattgcagtttgtggttatgtaatcttccgaggtgcaaattctcagaaaaatgcattccggaaaaatcccagtgatccaaagcttgcacgtaagtattgatttatgtttatattatatatattacatgaaggttttatttttctttttgtctcgacatcattaaaaatgtacttttatttttatatagatttaaaaaccattcatacttcaacgggaaaaaatcttctagtttctggatggtggggctttgttcgccaccccaattacttgggtgatctcatcatggccttggcgtggtccctcccatgtggtaagcatttcagaagagtgctagtttgacccttttagccgccagaaagatgtgtgtgtgtgtcctttgtgtgggacagtgtggccaaggtgggtgtgagtctttttgtcgcccttttctactgtgaggttggcctctgtagaagctcctctggcttctgaggggaattgggaattcacagagcctgaagttttactttaagcctaaaagcactattttaagttttcagctgtgcctgatagcttttttctaagtagaatatatagaaattaattcagcttcttaattcatgattcagtgtacatagattgggaaaaactttggtttttaagaagagaaagagattctgtttttctttttgtgtgtctggcctcgtggggagctgggaaagcaggggagcagggagagctgtgggagctggaggtgcttggggagctggggtgtcagggggagctggaggtactggtggagccaggggagctgggggaactgggggagcagggggatcttgggaagctgggggagctgggggaactgggggagcagggggatccaggggagctggtggaggtggaggagctggcccgtgcctgctgcctgtttggtggcccagcctgtggtggaagacagcagtttttcttctttgctgggggaagaagggcgagaaatggagagatgtgtattaactatgaggacagatgttttgattgtgatggattgttagaatggattcatcagtctttgagtagcttctaatttagatacgaccttctgccactttccagtgggattttacagacttgtttaattattctcatcattattagagaaaatgaagtaccttgtggttccatttttagagaatttgggggaaagcaggaaaaaatacattgtagtgataataaaaatatctaatactgtgtactattattatccacaggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgtaataaacatagtgtgtatgtttgggttttaattacacattttatatatgagccatttagatatgcagtgttaattctatactgcatttgaagtgtatgtaacttagcttatgttaatgcagtcatgaagttggtttgctccagcatccggtagtctttaaacattcttttagtgaaattgtcattgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttttaagtttgtttttgacatgtttatttggcaaattttataatgaagttttaagttgaaaataaaatgtagcaacattttgatcactttggagccttttttttttccctttcttgcttgaaactgagatttttgggaccaagacaggagcccttagattcccacccctgcccagcctcctgttttcctaggatcatctgtttgggacccctggccaactgctgtttaaaactctcagaatgttggaactcaaaggggttagttgggaatcctaactcccagaaaatggtcatgtgtttagtatttgctgtttgagaaaatacagaaatgctaaaactattgtagatccagtcatactttcaaatgcatttgtatgaatcacagaagcatctgtgcatttgaaagacagtacgtgtgtgagagacacacgagacacacacatgtactgtgcctgctgaccgtgctttagtgcttgtttggatttccagttgactctaagcctgaattgtgagatgagatcagacagcttcacctctcaattcttcctgctgcgacgttacattgtgacattacattgcaaaatgtgggtgtgtcagaatatgcaccaataccaagtatacgatttatattttggtgtttagttttgcactgtttggagcaaatgatgaaatataggattttaacaaaagatacaaggtggagtgtttctaggtgcaatttacttaaatatagatggtacagtttcctagacaattacatacatgttttgttcatggctgttaaaagagtctagtgctgggtacaagtcccaccttttctaccccccttactatggagagaggggactgttgggatcttcatttgtgtacacgtgggttatgctttctgcccatggaccattgccatgataaagagacagtgagatgtggcttcaaatgctagctgtgctccctcttagcaatgtgtgtgtgggcaattaatctctttgagcactggtttcctcatgtataaaatctggctgatacgtccacagagtatagaggggcctgaggatgatataggaattattagtgttcaacatagtgctcagttatgttagccattattagtagaataacattcttcctataggaacattgaatttaccaaattctcaggatttggcttttagtggtcagagaggtctagtgaagtcagaaccatattgcactttttttttttttttttttttttaaagagatggggtcttgctttgttgcccaggctggggtgcagtggcgtgatcatagctcaatgcagcctcaacctcctgggctcaagccatcctcctacctcagactctgagtagctgggactaaaggtgcctcatcatgcctggctaattttttaaacaattttttgtaaagacagggtctcattatgttgtcaaggctggtcttgaattcctggcctcaagtgatcctcttgccttggcctccccaagtgccgggattacagacatgagccactgtacccagccagaccgcaattttttttcaagacagagtcttgctctgtcacctaggctagagtgcagtggcacagtctcagctgacagcaacctctgcctcccaggctcaagtgattctcatgcctcagcctcctgagctgggattacagacctgcgccaccacgcccagccaatttgtgtatttttagtagagatgggtttcgtcgtgttgtctaggctggtttcgaagtcctgacctcaggtgatccgcccgccttggcctcccaaagtgctaggattacaggtgtgagccaccacgcccggcccagactgcacttctttaaagaggaaggcccttctcttttgtttcagaagtctgcagctaggtcagcagtgtagtattctgtgtttacttagagaagccaggggaagtattccaaagatctattctacatgtgtatatttagtttattgtatataattttataaaccacttttaccaaaaagttcataaaggcatgccctgatatcctgccaggtgctgtggtttttactgttaggagagtcaaatttgctgtattccgggttg

SEQ ID NO: 15828 - DNA, 7997 bp, Human
aatgaggtttgagagccttcactgaccatgtgtcatatccatttattttgggatccctttcaccccatttttaacttcctcccagttgcccaatgtcctctggagttttccatccaagacccccatctttttttttccctttcccccctttttagcttcctcccagttgcccaatgtcctctggagttttccatccaagaactccagcttctttttttgggggtgggggaggacggggtttcactcttgttgctcaggctggagtgcaatggcgcgatctcggctcactgcaacctccgcttcccgggttcaagcgatcctcctgcctcagcctcccgagtagccgggattacaggcgcgtgtcgggatcacacgtgtgagccaccacgcccagtccccccatcttcttaaaggggttaatttcttggctcttgcattttgacttttccatcattccaattgccatcctgtgtcctgctctttcccaagggttgcattcttactctgctgaatgctatattattggatttatgaacaattgttaatgtattataattgtctgatactttgatttaccagaatgaacacttctataagtaggactggatcgaacttgttcacaattggaatcttggtgcaaatcctagttctaagggatacaaagcacaaaatatttgcgaaatagaacaagctttcagacttcatactggcatgtatctttgccttatgccaaagatgtgacgatgtgactaaatacggaagttttgttttgctattgagccaaggtcttgctctgtcattcaggctggagcgcagtggtgcaatcatagctcagtgtaacctccaactcccgggctcaagcgatcctcccagctcagcctccctaatagctgggattacaggcaggcaccaccgcacccaattaatttttaatttgtgtgtgtgtgtgtgtgtgtagagacagggtttcagtagttgcctcccaaagttctgggattacaggcatgagctaccatgcaggacctgttttgttttaatacttagtaattgggtgtaaagtccttcaaaaaacaggtggggcaggtgggaaactccctttgtgtgaccctctagcaccagggataaaatttcaacttcatcttaaagcgacaacatacttttccaagaccaagtgcgaaatagtaaagggaagagctagctccgtagccgtccgccacagaatgccacaagctttcaattatgggacaaaattggaacacatggaaaccctgtgcagactcccgtgacatcttccctcctctccaagtcccttcccacagaccttgcgccccacacgattattccccaggggccgagcaggacgacttgggtcccactatccggactcagcggtgcccccacaaaagcgtcccaaaaactccagctggggcagccctggggcagatgctgaaaagttgtcagaggccctcgggcagtcccgagatctaccccaggccagagggcctgaccctccctaaatgcgacgttctcctaccttggttgatactcacgttcccagaaaagggtggaacctaggctggacgaggcgcagggccaaagtttaattcctctaagctccacccagctcccagcacctctccaggcggccccgtggggtagggcggagccgggtccaacgtactccgcttcccccgctccacccacccagggctagggagcgccccgagagttggcctcctcccacgctgcgcgcgcacctccccgcccccacccctacccgctggcgtgcccagtggaacggagccttgtgtctccgcctcaagtccccggatgctcacctccccgactcgcccccgctgtggccccgcccccgcgcggctcttcgtgccacgtcaccgcctgcgtcgcttccggaggcgcagcgggcgatgacgtcaagggacgtgccctctatatgaggttggggagcggctgagtcggccttttccgcccgctcccccctccccccgagcgccgctccggctgcaccgcgctcgctccgagtttcaggctcgtgctaagctagcgccgtcgtcgtctcccttcagtcgccatcatgattatctaccgggacctcatcagccgtgagtcctcactgcactatccttactgccgcacacgggggtctggggtgcgggtgggggcggggaaggcgcagccgtcgcgggcctaggggacgccggcggtcttagccgagcgcggaggggtcggtgcccggggctcgcgcccagctctggtgtgctacggaggggcagatcccgcgtgcggccgccggcgcgggaaatgcgggaaatggcggcgccgggcgcacggtgatgggcggctctgtgtatccggcagacgatgagatgttctccgacatctacaagatccgggagatcgcggacgggttgtgcctggaggtggaggggaaggtgagtcggtcgggcctgcgcgtgggggagtccgggccgagcgggctcgggtttcctccgctcccccgcctgaggttgtgcaatcctccccgccgcctcctggcggaggagacgctctttccgggcttgggtttttctagaaaactggaggcggagctgatcctggaaataggcccgccgcctcggcgcccatcctcctcccggggttgtccgggacatgatgcttccggcttaggagcctggagtcctttcgtgtttgtcctgtccccacttaccaaccggaggcatcacatgcccgcaactggaaacaactttttaatgaccccattttttgttccggccaacagacaactcttttaagttaggtcgttttgagaaatccacgggtcacaactttattcccaaaatggtgctttttttattttcagcaagaactaagaatacttcttatccgtgaactattggcgtggaaggtgctttggatgcgtttgtgtcttttgcaattatactgctttttcttaatgcagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcgtaagtgatactggcagtacctagctgatgtctagaatcttacaggatttaaagattggctaacttttgaggttctttcgcagtgggtatacttttgtgaaagtccttgcttttttattaatgagttcacggaaaagagtggttgcttttctataatatgagcatactgaagcctgcagtctgtttccgtttagaattagaatagtattttgaaaatagtcaacaagaaatgtaaacattcttgaaagataccttctgtgaactagtaatttcttaacagctggttgcctttttcagtgttttctttttttaagcttggatattttttactttaaaaattgattttactgaaaattcaatacttcaacctgttaatgaaatgttgttttagaatcaaagggaaacttgaagaacagagaccagaaagagtaaaaccttttatgacaggggctgcagaacaaatcaagcacatccttgctaatttcaaaaactaccaggtaaataccttaagtatctggatcaaaggattgtacaattttaactgcaagagcaaaaattaagttgattaatcttcaattctatactagtattccaggtgtagaaagtggctttcccagctcgcaggtgtttccaaatcttgtcttctgattgaaaatttgcttcccagatgacatttctcagtttttctttttgtgaattgcttaaccacctaagtgttctttcagttttttgcttacaattttaatgtgtctcattgctactggtcctccttctaatgtatctgagcttgttaattctacttttggaaaatgtcagtggctttccctttcctctaattttccagcttcatgcatcccctggccataagatacttccagactgtatgatatattctatcactgtcagccttatgttccctgtggttgactatataagcacgctttagggtttgggattgtatttaggattgagagtaaaggtttcctgaaagcctagtgttcctggattgctctgtacgttatttttctatttaggtcactattaaggtgccttaatccagtgaacagatgtctatgataagtgagcatcagagcttttgggtactgaagttttgatttttgtggtggtctaaaccttcccttgtactgtagtttgttttgaatggcatgtatttgtatgtaatagtctaattctaggtattttgtttgcttcccaagttctttattggtgaaaacatgaatccagatggcatggttgctctattggactaccgtgaggatggtgtgaccccatatatgattttctttaaggatggtttagaaatggaaaaatgtgtaagtacaaggaagtgggttaaaataaataatgtaaaaaagacattttagatgtgatttgcaattgttttgtgacactgagaatgagttttacagcgttctgaaacatggttttagttttctctttggggatcaagagaattgtgtttcatatgtaaaagattcttagggtataaaaaggcttagaatcttatttgtggaaaacgttgagtgcagatggggcataataaagtacagtttaggctgggtgtggtggctcacacctgtaatttcagcacttgggacgccgaggtgggtgcatcacctgaggttgggagttcgagaccagcctggccaacatggcgaaaccctatctctgctaaaaatacaaaaattagccaggcatggcagcgggcacctgtaatcccagctaatcgagagcctgaggcaggaaaatcacttaaacctgggaggggggttgcagtgagcagagatcccaccactgcactctatcctgggtgacagagtgaggtgctgtctcaaaaaaatacagtagagtttaaatgctgaaggagatcagagaacaccattgatcttcctctagatatggcctcactttcacttcataatcatattttgctgtatacgtatggatcagtatcagtggttttcactttggtttactgataatgggcagctgatcattgaaaagcctagtgcagtactagcttagtaaatagagctgactgctgaactggtatgcaaattgttttactaataataaataacttggtgtcttctatggaaggaactgctggaagctgtacagaaacaaaggcattcattatcctagttttcataggcttctgtataaggaagaagagaaacataaagctatactgaacaagattagagtcaacagtagacagaaattacttagaacagtataagatgacttaccaaaggggttattcagacagtatctgaggtttttgttggtagagcagggtgtgggtggtacatgccacagccttctgaaaaatgagctaccgctgatttggtaagggtgttctgcatccactgatagaccttgaacaatttactgttgttcttttggtttgcactaggatgcaaaagaaagaaatccctgcgctttctgtctgtctttgtggcggcccagattgaattggggaatacatctttagcctggaaatgtaggctgcatgttaatggtaatgtaacttttgcagtgtaatgtttgaaaaatattaatgtagtttttgcttttacagtaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaagaccatgctcatagcagtgccaacatctgaagtgtggagccttacccatttcatcacctacaacggaagtagttaactggaagagattaccaagagaataaaaagagactcattcagtggaagcaactttgtctcagcttatttcacataaagagagcgaagtcttttgggatgaatgttaattaaactccctggtaactagaacagggactggcaaactagcctatctgaccacctgttttgtacactttaaggtggttggttgcctttttaaatggttgaggggaaaagaataccttgtgggatatggaatttaagttcgagtccagttttattggaacgtggctatgcttattcatttatggattgactgtggctgttgtcagtgcatgagcagagttgtgtctaacagactagagcctgcaagtttgccagcccctgatttaaaagatgaaggtacacagaatgtgggctggctggtgggcaaaggggtaaaaatgttctctatattgtatctgaaaagatggggtgtctgaataagaaaatgcatctatttgacagacctggagcagttgctatctgctgctatggtttccaccacagatgcaagaagaacatgtccttgcgctttccgtctgtctaattgtggcagctgagattgaatagaggaatacaggaggaaaaaaagcgggaagagtttttgaggcaggtcggtcacccaggcttgtagtgcagtggcacaagcaactcactgcattctctgcatcctgtgctcaagccattttcccacctcagtctcactagttgctgggactgcaggcatgcacccctatgcccagctaatttttgtagagaccgagtatcgcttagttgcccagggtggtctcaactcctgggctcaaggagatctgcccacctcagcctcccaaagtgcaggcctagcctgggaggggaattttcaaaacgtgagttttgggaaatagtctaccagccttacctggttgattacacttgtaaaagaaagattaaaagcaggccagtgactctggtctgcttgaacatgtgaatgtagtggtttgagcaatctggagtttgccctagtgtcaaattccagactgtccatagtgtccaaaacctgaggcagacactaatgttaacccccagcaccccgtgattggaaacaaacctaaatacgtattgggaacttaatagcaattttaagcattctgatagattttttgtagggatggggtcatgccatgtggcccaggctggtctgaaaactctggcctcaagtgatctcaagctttggccttctaaagtgttgggattacaggtgtgaggcattgcacctggcttagcgttctgatttgacattgtaatgaaaagtgtgagtctcatctacagggccttttgtcctctgaaatgatagcaggaagggaattttcaggcagtggtcaaagctggggaaaccaggatagtgaagaaggccttgaggtgagagatggaagctaattggtgaactagccttggaagcctgaaacagacaagtagcaattcagagactttgtgggctccactgctccaacttgttttgaagattttcagttctgcagaagaggtatttccccagttgtcctttcagtgctcttagctgttttcccaacatccagatccaatcaaggctgggacatagcattttatcatgtctatttaagtcagaagtgatgaaccccagctgtttacctcatggtaaacctttgaagattccaggtagaatcttctcaggctttgaagactgtctcattttatatctttttctcg

SEQ ID NO: 15829 - DNA, 44166 bp, Human
ttttccaatatatttactgaaaaaaatccttttataagtggacccttgcagttcaaacctgtgttgttcaagggtcagctgtagttatttttttctaaaagatgagctgctgtttttattctatttattttcagatcatttcaacatattctgtactgagtcttaattagataaccaatttgcaatctgctcataatttatattagcactatttggattaaaaaagtttaaaattatgcctgggtttcactaatatatttgttaaaaacaaaatgaaagaaagaaatagaataatctcttcattggaaatatactcacaagcttctcccacacgaaagggttattggaaacatcaaagtgtgtattactagaatgatagttatgtttttattattgattacagatttttcaccaaaagcctaattcctctctgtttttgtttgcagaaaagaaaggaaccagtttttcactttttttgtgatacctgtgatcgtggttttaaaaatcaagaaaagtatgacaaacacatgtctgaacatacaaaagtaggttttcttagttgtcctgaaactgatgtagcaattgtgcttcttctatctgtatatttggtagaaatgccaagcttgttttcctttaaagtttatagtttctgtagagatatagtttgacaacttgacagataggggcagtgaccctggggtttgaaagtggggatcccgctgcttcagggacgaggtaagatggtagcaaagaagggagctctgacagctttttgtatgtgtgtacctctactgcttgggaagaggctgtcctctcctctagttaccttgtgcatcttaatgagttctttcccctttaagtctgcccttgaccattaaaccatactgtgtaatgtggctgtgcctatcaccctcaaaggctggtccacaccttgtcaggtactagctagaaaactttaaccaaaatgtttaaaaggtttaaaaggaagcctttggttttgaaaggttctttttctgtttttgggaatgcccctcaactttaggaattaagagcatttcacaggtttattgatgtatgcctttgctcaaatggagaagtaaataagatatattattgtgccacatactctgagagtgtcattcctttgcctaaaggcagccctgttttggagtcatttttgtatgcagagataatactatacagatgggataactatgtaatacagccagaatatgtctgtgtatgtatagtggggtaaatttaacatggaaaacatttgttaaatagttttttttttcttttaaaaactcatagtgccctgaattagattgctcttttactgcacacgagaagattgtccagttccattggagaaatgtaagttctgtttttttatcctatttttaaatacatgctctttttattgatctgttatcttcacaactgtttatttatatacctaataataggtaacactaatggagtactttgtaaggattttgacatcatttattcaactttttcctcacaaacaactatggttgtttatattggccccatttaaaatattttaaaaaatgaattgcccaaggcctgagaattgattcttggacctcagtttcttgactccaaattgtatactgctttactacaccatgctgctacagattgtcacgtctactcatatctttagtggcctctctaggttttgattggtaagtcattcatttgggtgtttaatgtcatttgagagaatgggtggcatatctactttgtaatcaaaattatgttaccccttttccctctattaatagcactaattaaatacatgatagattcttcttcctttaaaggaaaagttataacacaaatagatacaacctgcttacttggttttaaaattgtgtccaacataagtttacttgtagaaacaaagtctccaagttagtcaaaagcatatgatattgcctcctgatgttcagcaggctttttccccctagatgcatgctcctggcatgaagaagatcaagttagacactccagaggaaattgcacggtggagggaagaaagaaggaagtgagtagagttcagaactggtgaaataactgttttactgtgacaaggcttattaatgtagttaaattcattgaattcccttagaatgttggaactagggaagaggaccataaggcatattatgtaagactattattgaacgtagttttaggaagacctaataagaactcttcatttaagtagcaaatgtgtcataatgggactgtatgttgctctttgaggggggctactgcatgtcacctgtcagatgttcagtggttgaggcaataatgggtgggtactcttaccaaaaagtgtattatacagaagtgtattatcacagaacagtacatctggcacatgactacccatgtcagtggatttaaactgaaaccttaaactaaggtgagctaagtacaaatgtaacctgctgctcaaaggagtttgaagtatctttcttgatctttaaggatagttcttcttgttttcatcccaggcttaccgctaaataagatgcacaggtgctaaggataagagatacaggtgcttgttcttaacaatgagaagatcaggaattcattcctatgattaaagaaatttgagcatcaccatgtaacctgtggttttacacttactaaggaagaaagtttagttgatgtctagctgtaatatacttgaaattccactagggcactgttatactgccttctcagaaaatactagaacacttcatcctgaagcagaagactatgcagaactactgtaatgatcagttgcacttttaaagtcaactgctcttttcctggaattaaaaaatgaagagagcctgggatgaaaacaagaagaactatccttaaagggcaagaaagatacttcagactcttatgagcagcaggttacatttgtacttggctcgccttagtttaaggttcactttaaatccactgtcgtgggtggtgatgtgccagatgtactcttctgtgaaaaagttagatgctgccctttaaggctttagaggtaattctgaggaagaccagcagaagcacgaagattcagaactgagaataaatataattcaacgaaagtgtatcaggtattaatactgtgtacaaaggaaagagttggataagggtgaagggacagttagaggaattcaatttttttttgagtcagagtctctgtcactgaggctggagtgcagtggcgcaatctcagcccactgcaacctccacctgctggtttcaagtgattctcctgcctcagtctcccaagtagctgggataacaggcgtgcacccccacacctggctagtttttgtatttttagtggagatggggtttcgccatgttggccaggctggtctcgaacttctgacctcaagtgatctacctgtctcagcctcccaaagtgctgggattacaggcatgagccaccacacccagctgaggaattcaatttttaaacaagtcaggtccaaccagtcaacgggacttggtggacataatatagcatttcaagagcatctgtggctagcaaatgaaggaatctaggccacctgtagtagagtatattagaatacctttttctttgatctctttggcaaaatcttacttatcgtgtaggcttgttttaaaggttgcctgacttactactctctccttacttttcaccacctctatgtcagtgctaccagagtgccagtctgtaacaaaagagcttgtaccagaatgtaaatcagtatattacttcctttgttgataagaaaaaaatgaaaaaataccagctgaactaaatatcatgcttagtgacgtagttgatttctactctggtgtgtgtggattggctggttgccagtccctgaaacacactaccctaaagcattatttactacctcctttgcaaatacatagcttatttatacaaccatagtacatttgtcacattacattgtagttggccctggtcttatacatctttaattctgctgtgctttgcacagtgcctagaatttagtatgtgagaaatacatatttgttgactgaagtacttaaacagtgtagtgtgggaatacttaaccttggcagtgataagggagccttagccaattgcaaggtcaaacttagaagttgaaggagtgtggaccatgctgtggtttaaatgtgtcccccaaaagttcatttgttggaaacttggtccccagtgtggcagtgttgagaggtgggaacctttgggaggtgatgggtcatgaaggcagaaccctcataaatggattaattcattcatggattggtggattaatggattaaaggagtagtgaattgtcaagggagtgggcttgttatcatcagagtgagtcaattataaagatcaatttgcctgtctcctgtgagcccccttgcccctctgctgccttgggcctctgcagagagttcccacccagccaccaaaactgtaagaaataaacttcttttctttataaattatccaatcttatgatgtattcagttatagcaacataaaatggactgagaccatgaagtagtttgacataggaattttgaagcacggtatctgaagttccttggcttctgtaggtagcttctttatagatacaaggttttctcctcatgacaccactccccaagtagctggactttttaaaaaatgttttgtttgttctgcttgtttcttttctatctattggttgtttcttcttcctcctcctcttgttgttgttattcttctttttcttcttcctcttcctcctcttcctcttcctcctcctcctcttctcttcttcctcttccttctcctcctcctcctcaccttcaccttcgcctcctcctcctcctcctttctcctttcttcttctccttcctcctttcttctcctcctcctttcttctccttctccttccttccttcttctttcattttttgcatagagcagtaatcaaacaagaagttaactccacttcgtttctgatatgtacattataaagagctgatgacgatggtatggaagattgtatcctgctggatgggatggaagtggcctaactgctaagacactaggttttttccccctactacttagcctggactttgatcagttagaggttggttcaacttattggtgtcagtcccttttataaatgtttaattctcttgaggggaatggtagcggttactagtcagcattgattgtaaagcaacttaaaagttatctaactaaacagttaaatttctgaagctttgagtttactgaagggtataaggaaggtctgaagtgacttcctgatttgccaacttcggttcttctatcttgtggtggtataaattaaataatttaaactgggaaatgtggaactgctattaaattaatggtaaccaactttactcttttctacgatgtctatagcactttcactctcccactatcctctgctattcccttgctcagcatataagaggaaggggacttcatctagtctggaagattagggtgtttcatgacaaaggcaggggtagctgaattcagaactaactaggaaaagataaggagaggcagggattagtggtcagacagaggttagcatgttcaaggaactgtgagtataggtaagagaaaatagaagctttacaaagatggcagttgtggggatggagagaactaggtggatgtagaacatttgggaggtgaaaatgggcagtgtttggggattaaatgattgtgaggttgaagaggagagaggttttaggagacttccaggtttctaggcttagcacctctatgaaaggtggttcttattactgaggtggggaacactggaagaggatgggctttggaggtattgggttggacattgttgagtctgaggagatcctgaggcatctatttgaagatgttgagtaggcattgggacttggaccagactagactggagatagttttttgagtcatgaaactgggaatatggaacagattccccacagagacagggtagagtgaaaagagaaggtagcctaatattgaaccttgagcccttccaacatccgaaggtctaatagagaataaaatccaacaagcctgctgagtgggaaccagagaggtagaagaaaacttcctctggaagccagtggaggggaaaattttgagaaggaagatatggttagcagtgcagattgcgatggaaaggtcaaataaaacaaaaactaaaagtgactgatgttgagacatacacagggcctccttgatgaggattccagatgattactccttggcctttctcctttgagctctgtgccatctgtcttcaagtctcacaccctccccagggattgattgcctttgtcactcgcccttggcatgttagatgctgcagtggaattgtgtatattttgaattcattcagtaccttttcactttcagatttctaacggccaagcctgagcaaccaagtgatacccttggtatctacaaaaataaaaagttagccaggtgcagcggtgggcacttgtagtccaagcctctcaggagaccgaggcaggaagatcccttgagcccaggagtttgaggttgcagtgggctgtgattacgccactgcgctgcagcttgggtaacagagcgaaaccttgtctcaaaaaaacaaaacaaaacaaatttccagtgcccttcaccttcatgcagtttcagccacttactttcatgaccacatcctggattctaaagttggacatactcctctttccatccgtccagctcactgtgatctctaccagggcttggaatagttgaggcttcccatcctctttaccttgtttttcttttatcttccttcttccttcacttcctacccagcctatttcacttcggctgctcttgtcgatatctcagcttccttcttccattatcctccattgcactcatctggcaaaatcccagctctggctcagttgctacatcctgttcaagaaaaccacacaattgaaatgtagtctgcaagtgaacacttgggcagtgctatctgacttaaggagttgacttgaccaaagagaagtttagggtattttctttgtatttgttgttttgtggtgcaaaattagatgttcaatatgcatatgtttcttagttatgtagatgactgtgtagtgtaaaatttaaaagtttgttaaactgattttatttttaatcagctgaaatgcctatgagaataaaactccatagaactggaaaccagaatcctataatgtgggcttaacttgtcttttctgattatttccatattatttgcttataggggctttttgtctcagtcaaacttgttatttatcatatctcatacagggtttgtgaactttcgcccttttagttttgttcgtgctgctgcttctagaagatcttacctactccatctttaaagttctgctcattgctcttagctcatctgaaatccatccacttttgggtatattttttctcatctgcctagagaaatgtcttgcccttctttgaatatggtatctcctttctgcctctttagcacagatatcctttattatgaccctgttggtgaacttctttgcatatgtgtcttttattcttgaattaagtgtgagctctgaaatgtaagaaccaacttttacctggctgcttctatcccatagtgccatagttatagggaatgcttataaatgttagtgtgtgtaaatggtgcttgaagatatttttcttatgggtataattctgttttggtacacacaagtaagtggttggagaagtcttactgagacttgtatttataaatcatgtttgagctgtatctttgttgtttttagagaaattgggcagaaatattttgatatgattaataattatgcttggaaattatagtgtaactaatagtacttaaactgctgtggttttgaacattaaattctcactacatagggtagggtagaccatcactgggacaaaccaaattcatccgtattttaaagtattaatggcttttccctacacgaatgtgaactatgcccccttgtggtttcgtgaataaatgattaaaggaaaaaatttccactggctagagaaactttggaaacattaatatttgaagatgaaaactagcataggcagcatgtatttatttaaagttcctgatagaagactagtttgattttctaatgttagcaagaaatctcagcaacctttgaatatatgttaacagacattttgcttatctttgcataacttcttgacaatagtttagtttgaaaattagaggtaaacattcagtatttgaaaggacaaagattttgctatatgtggctgagttcaccaaaacaaacactagtaacttcttgcctttaaggttctcactgtagtgtgaaatgaataaatacacatgaggtggccataagactacaagtaactgaagcattaattttagctatgtagggataatcctgactggtcaagggatatttgagtttttggaggggagggccgtctatttgtttttcaagacttcctataagaggcctccctcccccagtttatcttaatgtatattgtacatatagtgaaattcaccctttttagtggatagttctgacaaatatatactgtcatataaataccaccagaatcaagatatagaacagtgtttcttcacctggaaaaattgccttatgccctgatggcagcctcccctccacccactggcaaccactgatttattttttgttcttatattcatacttttgcagcaacatcatataaatggaatcatacagtatgtggcctttttagtctgactcacttatttttagtctgcatttgaaagttatccatgttgttgcatgtagcagttgtttgttttttattgccgagtattactcttttccatagtatggatgtatatcagtttgtttatccgttctcagttgagtgttgtttccagtatttagcctttatataaagtcttcataaacattcacgtataggtttttgttttgaatatagggttttatttgacttggataaatatccaggagtgagattggttggtcatgtggtaagcatatgtttaactttatgagaaactgccaaactgtgtaggaggatagttttaaatcaagataagcctatttgagcatggaaagtattcagataaaaggagatggtagggtgcagtggtgcttgcattagctagtcatgctctaggaaatggaatggcaaccttactaccatggcttagtgcaaagaggtgtcattttcccaaggttaaaaaaaaataaatccagggctgctgttgctgcatgacagtaccatggacgtaggctgtctcttgttgcaccggagtaggcggctctcctcttgcctgtcaccagaatgttcttgcatatgcaaatattaagccacagaataggcagaaagaagagaaaaagacaaaaggtacacgtagcctagtttccccccttttcactgggaaaacagtagctttgtttttatttccaaccaggagataatttatatagatctcattggctagaagtgggctgcttgaccaccttcagtggcagtggagttgatgggatgcctgaaacaaaattgttaaggaatgggggagaatagtcagtgtttgctttagttcttggtggcacagtggaatttcaaaactataagtgaattttggaagcggctctgtccttctgaataaaggattggtttgagcaagcatttaataggcttgctggtggctctttttatgtaggacaggtgggggctgaggggatagagtctagctctggtttccagaggtatgctatgacagcaggcagaagtgccttggaagaggaatgggcaaaatctgttgagggaataagtgaggttataggtttgtgaaatttagaggtgtttaaagagaatgaggaaatggggtgaagatggcaattttggatgaagtttatttatacctgtgatgttgctttgtttagtaagtgctctgaaaattctttgggcactgggtgagttcatctgaggttcttccatagtttgtttctcaggttcttgctctttaatatattctgaagagttcatatatattttttctgtatgtatattttattagaggatatgggaaatactgcttttcttttggtatgtttgatagatttctcaaaaatgcataaatactatccccactagcaattttttaaaaacctattatgggccgggcgtggtggctcacacctgtaatcccagcactttgggaggccaaggcaggcagatcacttggggtcaggagtttgagaccagcctggccaacatggcgaaaccctatctctactaaaaataaaaaaaattagctgggcatcgtggcacgcacctgtaatcccagatacttgggaggctgaggcaggagaattgcttgaacccagaaggcagagactgcagtgagccaaggtcgtgccactgtactccagcctgggcaacagagtgagactgtctcaataaaaaaacaacaaacaaaaaaaccctgttacaaaaatatacttactttctacattcctgtcattctcaatttttaaaaaatattacttgaactcctaaaaagagtaagttccacattggtgtggcagaatagtccttatttcatgaatttgatctttgtgtgagagctacattctttccgatgaagccactatattctttgacatgcaggaaaaataaggtctttatgtagttgctctgttaggaaaagcttgtgaaagatttcacagagtaagaattttaaagcttaaagaaaactgaaggtttgcttggcatatggcttccttatctttgacaaaagtacatctttgtccttacttctacatctctgtatttttcaggttagtcagactcaggggtaccgagtgtatttaatttaataacttttaaggctttccattaatagcctttcccctacctccccaaaaaagccaccaaaaaaagttattctttcttaattcctatcctatgtagtaccaatgctgtatgatttggctttagggaaaatgagtggtagaggtttgtttccaaaaccttgcttttattatagaaacagtggaacatttttcacagcagactgggagtccactaggtggagtagttttacaatttatttcaacgcttactgtggctctgaggaaatccttttgtttccctggttcatgcagaattccaacacaggagatctgctctaaagaatgctgtatctttttgatgttcagaaagaaaagtacaatagtgtagcttgtgtggaagcagttgtggtttaatgagagtgggaagagtaactatgttttatagaacaggcagaggggaaaagccaataaatgggtcgtgatttgagcataaggaaaaaattggagagaataatgtgaccagaatggtctgtgctaagataatggttaggacggtttgcccatgtgttggctctgtagtgcttaaagattgtcactggaggcataaggtataggcaatgaggaaggtgaagaagaggtaaaaaatgaaagaagagaggaaggaaaagagcatagtttcaggaccatttcctcttagtgaactgaggaaagatagaagtacagggagaaaatgattttagtagataaaaatatagaaaaaccaactgtgaaaatttcccttgtcacggtctttataacttcatattatccattctctaacaggagatattggactaagctttacatgtatgtaactgcaatgtaagacataatttatgttttttcaatagtctttggatttgttatttcttgtactttaggaacctgaactccttcatcagaactccttttttttcgttattcatttatctcagcttcatgttggtggagtggggcttcctactgttgtttatgtgtgtaattaggtcttgtgtttctgatttttcttttttgcgataatgtgctttttagcaaccatttttctctctagttttaaatatctggattctgtgtaaataagaatgtaataaattttggaagaggattttattgatttcagcaccaagaaaaataaaatcttacaactttttaaaactctaatcttacttttaggaacatgatacttaattttaggaagacaagtttccttacctttaggaacatgatatttaattttaggaagttaagtttctttacctttaggaacatgatactgcagtctgcctgaaagagaaaattagctgttttaaaaggcttccatcaaaggagtttctacacatcacatctttgatgtttcacttagggaactctttcttatatcttacctaaaatccacttgctataacaagtttaaattctttaccaatgaaaagcagttacctagcatctgctctctggtacgtagtacactgtagtgccaaattttatcatgtaacatatagcccaacatggtaagagtctgcaatactctgcaaaaatgttgaagaaacttaagtaataagtaaatttgagaattgtggagggtgttgagtagctgtgagttacatgtctcgccactgtgaggcctgtaaaaatcattactgtttttctcatttctacttctgcatattctcttcagtttgagaacaactggaccatcctctctgtaaaactatttttattgtcgcttctcatcttcttttaaaggttgcaaatagttcctttcatctttctttggaggttttatttttcatcctattaatcatctttgagtctcttctgaatcccttccaagtcttttttttttttttttcttctcagtgttcctttagtttagaagtacagaactggacacagtgccctgagattatctgactgcttttgagtatcctggaggaagatttcacactcgtacaagtgccagagtctacttcttataaccttagattatgtttgctttcgaaaaatgtagtcatgtattgctgactgtcagatttttatctcctatgaccttgatcttttccttttatgtttatttatagtttgtacattaatcatctttttttatggagtctatttttcttgactggatatatattgcttcacactgtcctcattgaaattcattacattttttttctgattacttaaccacttacccaatgtcatttccattcctgtctttcagtatggcccacccataggctttatatattgtctgtgctattcaagtcagtgttgcaaatgttaaaaaaaaaggcagaaggtagagaagtgtcctagaagcaatggcagaacacatttgttgatgtttctccaaacttactctgatcagcagccagacggggtagtagagagctgtgttcccttccttctatgttttttatactcctagaatctattgccctcttcctgaaagtttggtgtctgcatctccacacagctgtgcagagaaacaaagaaagcagttcatctggcacacttctgtcagatttcatcttaatcactgctttgtacatatctctccctgttcataactttctgtggctctctatcacctgctgaattaaatataaactttctagtttggtattcaagacacattttggcctgagtctccctttccagtctgattgcctgtaactgtgtttcataccatattaactacttgtcattgtccagatatctctttcactttttttttttctgtgagacagagtctttctgtgtcgcccaggctgaagtgcagtggcgtgatctcagctcactgcaacctccacctcctgggttcaagcaattctcttgtctcagcctcctgagtagctgggattacaggcatccgccaccatgcccagctaattttttttatttttaataggatggggtttcactgtgttggccaggctggtctcgaactcctgacctcccaaagtgctgggattacagacgtgagccaccacacccggcctctttcactttctgaagtcttggtttgtttgcattgtttggcctacttaacatactctgatttctgttaccatttaagaccaatttctttcatttcttttctttatggatttttccaattagatatagtctttccattccacccctaccccccagtctttataccctcttgggtacttttgtcttatgttatcactatttgtgtgcttttcttatcttcctggtagacagtatattttttattttattttatttatttatttatttatttatgttttgagggggagtcttgctctgtcacctaggctggagtgcagcggcacgatctcaggtcactgcaacctccacctcctggtttcaagagattctcctgcctcagcctcccgagtagctgggattacaggcgcccgccaccacacttggctaatttttgtattttagtagagatggtatttcactacgtaggtcaagctggtctcgaactcctgacctcaaatgatccgcccacctcaacctcccaaaatgctgggattacaggcatgagccaccgtgtatattttttgagaactgtctcctcctcgtcttggtaacttcgatatacctagcatgtatttgcataagaaattggatagacttggccgggcgtgatggttcacgcctgtaatcccagcatttggggaggctgaggcaggtgggtcacctgaggtcaggagttcaagaccagtttggccaacatggtgaaaccccatctctacaaaaaatacaaaaattagctgggcgtgatggcaggtgtctgtaatcccagctacttgggaggctgaggcaggagaattgcttgaacccaggaggctgaggttgcagtgagctgagatcgcaccattgcactccagcctgggtgacagaacgagactccgactcaaaaataaataaataaataagaaggaaataaaaggtaatgactagaataaattgaatagacttaaaaattttttttacagtatttataggtacatgccatatagatgaattaaatcagtttgagcacattgtatgatatatttgatttaaattccagtgtacacttgtctagttgcagactgctagcaaagtttgtggattagcaggtggtccacactttgagtaacattgttataagtacttttttccctcttaaaaaattgtagaagcagttaaaggtttataatttgctgtgttaggtgttaaacaaaattgctaaattcagcaattgcttgattgcttatttaaaattgtactctaaaagccctattataattaacttttattattttctagaaactatccaactctggccaatattgaaaggaagaagaagttaaaacttgaaaaggagaagagaggagcagtattgacaacaacacaatatgggtaagctccttatgcttatgaataatgaaaaggagcacaaaacaaaatcttaaaacccttatgtactcaattatgaaatctttgcttttgtaacttatttacttaaaaagataaatttatttatttttatttttatttatttatttttttgagatggagtctcgctctgttgcccaggctggagtgcagtggcgccatctcggctcactgcaagttccacctcccaggtttgtgccattctcctgcctcaacctcccgagtagctgggactacaggcgtgcgccaccacgcccagctaatttttgtatttttagtggagatggggtttcaccatgttggccaggatagtctcgatctcttgacctcgtgatctgcccaccttggcctcccaaagtgatgggattaccgcacctggccccatgcctggtaatttttgattggatacttgacactggaaattttacattattgggtgctgtattagtccattttcacgctgctgataaagacatacccgagactgggcaatttacaaaagaaagaggtttaactggacttacagttccacgtggctggggaagcctcacaattgtggaagaaggcaaagaggggcaagtcacatcttctatggatggcagcaggcagagacaggagagcttgtgcagggaaactcccctttttaaaaccatcagatctcatgagactcattcactcagtatcacaggaacagctcaggaaagacccaatcacctcccacctggttcctcccatgacatgtgggattgtgggagttacaattcaagatgagatttgggtggggacacaaccaaaccacatcaggtgctgtatatttttgtgtttctataaatgttcttgaacttttttctgggaagacaactgagttacttagaaacggtttcatccttctggatcttgcttttaagattttgttagatgaaaccagagcagtgtttagtctgaaactaactactcactactgatgtaatatcttactgggtatcttaccccatgccctgtgaaatatgaggtacaaacaggccctagttatgactcggagtgaagatgaggtgctgataactctgatccttttgggtcgtttttttcccccaaccttggatagtttcctgacaaatacatgccaatcagtcttctgctaaatagtccagggtaaatcctctgcaaatctctagagttctctctctttctgtagttttttcctctcaggtacatcctgaagctctagatgtcttgctctctctggtgtctcaactccagttcctcaattcagggattctaccaggtcccatctggattcctcttctccgcagtctggaaactctttaaggctgtaagcaagggcagttgcagggttcactattcatttattttctgtctttcagggctcacttctcttgttgcttcatgccctgtgtcatagagaccatcgtttattcattttggctagttttttggttatttcaggtaggaggataaattcagtccctgttactttattttggccagaaacagaagttcttaatggtgtcttttataaataaaaatttcaattttcatgaagtctgatttattaatcttttatttttatggtcagtgctgtgtgtgttctgccttaaaaaaaacttttgcttacttggagatcataaaactatttctttatgttttcttttagaagatttattgctttgtgtttctggtatatgtctagaattaattattgtacatagtgtagggtttaaggacctttaaaactttttcacatatgaattacagttgatccagcactaattgttataccatgcaaaccccaaccaaaagtaacctggtataacaatattaatgtcagaccaaatagatgttaaagcaagatgtgttattagggataaataggaatattttgtaatgttaaaagagtcagtgcaacaacaagaagacataccaattctaaatctgtatgtgtctagaacatagctttaaaatatgtaaagtgaaaattttgaaacacaactcttgagcagagagacaaaaatcctatacaaaatgttagcaaatcaaatctggcaatatgtaaaaatatgtaaaaatatgatataacatcatgactaaatgggatttattccaggagcatgtttatttatcacattaacaaagtgaaggaggaaaatgctattaacttaatgagtaaggaaaacagttcgataaaatgtaccacctgttcataaaaaagacatattagcaaactagtaatagaaaataatttctttaatctaataaaggatatctatcaatactctgtagccacatcgtacttaatggtgcaatagtgatcactcccccacctcccctaagattagaagcaagataaggatgtccagtgttaccacttttataaatgaatttagcaaggttgccaaatacatgtaagatcaatatttttaaaatcaactctatttctataaagtagcaacaattaaaaattgaaaatttaaaagataccacttagaatagcatcaaatgcctaggaataaacctaacaaaagatgtgcaagattctacactcagaactacaaaacattgctcagaaaaattcaaggcctgtataaatggagcaatatataatagtcatggactggaaaacaatataattatcttaattctcccccaaatccaattaattacagtcaaaattccagcaagttttttttttgttttgttttttttggtggaggagggatgggggagattgataagctttaaaattacaatgtgtcacttaatgacagggatacattctgagaaacgggttaggaaattttgtcgttatgaatatcatagagtatacttaaacaaacttagataatacagcctactacacacctaggctgtgcagtaaagcctgttgctcttaggctacagccctgtaccgtgtgttactgtatccagttgtaacacaatgctaagtatttgtgtatctaaatatagaaaagtttcattaaaatgcaccattaaaggcaaaaaatggtatacctgaatgggacacttaccatgaatagaacgtgcagaactggaagttgccttgggtgagtcagcgagtgagtggtgagtgaatgtgaaggcccaggaggctgctatacattactgtagacattacaaacattgtacacataggctacactaaattgttttataaaagtaattttttactttatgatgttatgacattactgggaattatttagctctgctataatcttataggactactgtcatatatgtggtccattgttgatcaaaatgtcattatgtggtgcatgattgcatatgaaaatacaaaggatctagaacagcaactaagaaagctcgagtaatgaagatagtgtggtgttgtccaaggataaatagataagtagagcagaatagagcccacaaacagatccactgagaaacaatcacctaacttatgataaatctggcaatataatgcagtggagaaaggatcgtgttttcaacaacctattccttttaaactttttgtgtctctatatttaaagtgtatctcttatatattatgtaattttgtcttcttagtaatccaaactgaaaatctttgccttttaactagtgcttagttcatttacgtttaatgtaattcctaatatagttgggtttttaatttgttcttcctttcttgccttcttttggatggaatcttttttttattaatctctccattttatattcatctacatttttatttacattatgccttttgtaactatttttagatggttgattacataaacttttcttttcaaatgattgtcaagtcgtggtataacagaactactcccttgaaggtgaaatagagtgcaaataacagatacactactttctcaattaagtcttatagatgtcattagtgaaggatcttcttaactcattacttattagtgaataccttaatgatgatcattcagaagctagctgtggtcagatgctgtaagagaaaagataacggggaaggcatccgtgaatgggagctcaaagaaagtggcatctcttcattatccttatggggccagtgggctggaggcagaaactagacctgttttctttgcagtgacactgttaggttcttagcctgacatctgtggatggacataggagattggtccatggctttctgcaaaatttggactatacatatatattaatttttgtaatgagattctccaagggttattatgaccctaaagggattaaaaatctctggattgcagatatataaacatgttgatttaacaaattatttcaaaaatgttatgatagtaaactaccatttattaagggcttaatgtgttatcttgctctgtgaagtactgtatttatattatctgaattctatgtccctataattcccattctgtttaaaggagtaaacaggcttaggcttacaaatatttgtacagcagacacagcccataactgacaaagttgagatttagatgcagatttctaattatttactgcatcctccattattaatgaaaaatgaattttgcccaataaatggcaaactgtcaaaagcctatctttgcaaaaactcagtcccaccaatgaataccttgtgttattgtctactatgaaggaacctttttttaactgtcttccccgcccccgcacacacacacacagtttaaattagaagatgctcacataaatacgtgctttcttttttttttttttttttttctggagacagagtcttactttgcccgggctggagtgcagtggcacaatctcggcccactgtgacttccacctcccgagtttaagcaattcttgtgcttcagcctcccgaggagctgggactacaggcacctgctaccgtgcccagcttattttttgtattttagtagagacgaagttgcccaggatggtttcgaactcctgagctcaagtgatccgcccaccttggcctcccaaagtgctgaaattaaaggcgtgagccaccgcgcccggccaatacttgctttctttctaaaagtagttgtagctgttgagagggcacttgatttgagctggctgtgaaattgcaataggcttatgtgttctgataggcctataaagcagagaaaatagtacctgtgttacctatttcagagggttcatgaaggtccaacaagtcatatttgtaaatgcttcagaaactttaactccttaaaaatgagtagacaaggccaggtgtagtggctcatgcctataatcctggcactgtgggaggctgaggtgggtggatcacctgaggtcaggagttcgagaccatcctggccaacatggtgaaaccttgtctctacaaaaatacaaaaattagccgggctgatggtgggtgcctgtagtcccagctactcgggaggctgaggcaggagaatcgctagaacccaggaggtggaagttgcagtgagccaagatcatgccattgcactccagcctgggcgacagagtgagactccgtctcaaaataaaatgagtagacaagagtgaacatactttataaactctgagaaacactttgagctgggcacagtggctcacacctgtaaccccagcactttgtgaggccgaggtgggcagatcacgaggtcagaagatcgagaccatcctggccaacatggtgaaaccttgactctactaaaaatacaaaaattagctgggtgtggtggcacgtgcctgtaatcccagctgcttgggaagctaaggcaggaaaatcgcttgaacctgggaggtggaggttgcagtgagccaagatcatgctactgcactccagcctgggtgacagagcaagattctgtctcaaaaaaaaaaaaaagagaagaaaaaagaaactttcatgtacaatagaagaatgaaataatgctgccagttaaattggcctttaatgataatacgacacagcccaatttcagagggataacaatatgggtagaaatttgcagcgtagaatcaagaaggtgtggtatattgtggggtgctgtccttctaaagttctatcataggcttccctgtctttgaaagtcactggaatttcttttattttcgtctctttaatgtactaggctacaagtgatcagttttacagctaggtttcttttgtatctagtagtctttttcaaaattttcttggaaggtcagtgccttttatattaaaaattgcaattttcttactccagcaagatgaaggggatgtccagacattcacaaatggcaaagatcagaagtcctggcaagaatcacaaatggaaaaacgacaattctagacagagagcagtcactggatcaggcagtcacttgtgtgatttgaagctagaaggtccaccggaggcaaatgcagatcctcttggtgttttgataaacagtgattctggtaagctaaacaggaaaataacgtatttataagtgtatagacaatgatgctgaagttgattattcacagccttgcttgtggaaagtttaatatcaaatgtataacaatgcagaatgatgcttttgtttttgtttttaataggagcatcttgtttaaaacgtcatttcagaacatcttttctgagtcttgggtgggcacatggggcagggaggctataggagaaggactgtatttgctggataattttcattagtatgaggtaatcttagaaatttcttaagattgttttgaatgtattaatgctgtgcattcaaatttgcccaaatatgtggattttccctttacctataaagcagcaattctaacggaagtcagtatactttatgctactgagcatgagcatgatctctgggcaaaaaatactaattcattatgtttgatcagtactgttcttcagagcatagattatatttatatatgtttgtccttgaatttcctctaaaacatatagggcaagttaacttgcttattagttgaaaaataaaagcattaaaatgctggtgtcacatacagatatcatttagcctttgagactccatttctcttcctgaaaaatgaaatgtgtatgtaaatatttttactacatttttctccagtaacattgtgaggctttatctaattgcatatgctttgtactgcaaaggaatacccaaagattattagtgagtgaattgacattagtgacattgtagatttgattgtaggctgtttagcttggatgatgttggcttctatgataatcacatggcaagtttttgaacttacgagtggcaagaaaagagaggataactaattcgttgactgaattaggatggaaaaagatcattgcataagggaacattaggctaagtagaagataaaatttaataacattaatgatgatatattaatatcaactaacactgaataaggcacttactgagctctatatgctttatatagatgaagtcttcttatgacagccttttacacatataccgttactgttaccattttagaaatgaggaacatagagactaagtatgtttatgccattgaaagtaatagtaaaaaatgcagttacttttgcatcaacctaatagtttatcttagtcattctgctcattagtggcagaatgagaatttgaacatatgagtctcactccaccagtacactacacatcctctaaatatgaagtctgaatttgtataaaaaaatattgtttgagtctaggatagttgagatgtgagagagagcaagaaaaaggcagatgatattttgagccagtgctgagtgtactcttgggcactgattttttgtttgttttctttcaaaaaattttagagagagctcacatgcttcttcagacttgtaatgtgtggccttgatgacaaaagaccatctgtactcaaatataagcttttatgtcattaaaacacttaaaacacaaatgtgaagactaccattataatcagtaagttactaatttgaaaattatgtaaatcttttactttgtgcaattttctaaatgaacacttgaaggactctaagaccgatattggatagtctttgttgttcttcattttgttaacttagctttggtagatggttaattctgttttccctttttatttaaaaaaaaaaagtatttcagtatatactaatctggtaaaacaccaactaaaagacgattgtatcttgcttctatttaagcttgtcttagtcctcagtagatgccttagacatgagaaacagtggtaaatcctctcatccttattggtagaaataattcagttggattctgaggagcagttgaaagagagatctcaggctgggcatggtggctcacgcctgtaattgcagcactttgggaagctgaggcaggtggatcaactgaagtcaggagttcacgactagcctggccaatatgatgaaaccctgtctctactaaaaatacaaaaattagccgggtgtgatggtgcatgcctgtaatcccagctactcgggaggctgaggcaggagaattgcttgaacccccgaggtggaggttgcagtgagttgagatcacaccattgcgctccagcctgggcaacaagagcaaaactcggtctcaaaaaagaaaaaagaaagagaaatctcaaataattttgttttggtttaaatgttgaaacccttacctataatgagggtcaaggatgggaacatgcctatttcgagtgtcaaagatgagaacctgtatcttgaatataaaaattacccatatagactacaaatttataattttgaatatttaaaaatttattaatttttataatattgtattataaccaaggaaatcacaatgccaatgatcaaattatggtagcttaagtttgtaggaaagctgtcatttaaattcaccttatcctttacctgggatttcctctggactttgacattttccaaatctgttttagaccaggggttcttaacccctgggcacagactggtacctggtacagttccttagcctgttaggaaccccaggggggagcggggatggggaggcggggagcagcgagcaagcatggcttcatctgtatttacacattccctattgcctgccttactacctgtgagctccgcctcctgtcagatcagcagcagcattagattctcataggagcgtgaaccctattgtgaactgtgcacgtgagggatttaggttgtgtgcttcttatgagaatctaatgcctgattatctgtcactgtctcccatcatcccaagatgggactgtctagttgcaggaaaacagctcagggctcctactgattctacattatggtgcattgtacaattattttatatattacaatgtaatagtaatataaagtacacagtaagtgtaatgtgctgaatcatcctgaaaccatccccaatccaccccccaccctctgtctttggaaaaattgtcttccacaaaactggtccctcgtgccagaaaggctggggaccgttgttttaggccataggttctttaacttttcactgcaggtatagctacagacaatctatccccctgttttcatatgtcctaagtcaggcttgtccaaaccatggcccatggactgcatgcagccaaggatggctttgaatgcagcccaacaaaaatttgtaaacttccttaaaatatgagattctttttttttttttttttttttgagacggagtctcgctgtcgcccaggctggagtgcagtggcgcaatctcggctcactgcaggctctgccccctggggttcacaccattctcctgcctcagcctcccgagtagctgggactacaggcgcccgccacctcgcccggctaattttttgtatttttagtagagacggggtttcaccgtgttagccaggatggtctcgatctcctgacctcgtgatccacccgcctcggcctcccaaagtgctgggattacaggcgtgagccaccgcgcccggccaaaatatgagattcttttgtgtgattttttttttttttaagctcatcagctgttcttagtatattttatgtgtggcccaagacagttcttccaatgcggcccagggaggccaaaagattggacacccctgccgtaaatattctccactctccaatatatgttttccacttgtttggaggcagcttctcttaccttgggcaagagccagccaaccttaaaatctggttattcaagttgtcagtggcaggccagcggccagcactgtgataacaagacccactgttctcatatggcagttgatacttttcagcactaagctcactttaataataaagctctccctattgcttccattttttgcctttttctggctcagaacttaatccagacatcagcactcacattttaaacaagactcaagttctagaggatcttcataactttcagatcatgcttggaaaatcattgcctgggttcaccttttctgtattgtatttggtgccatgtgtactctcagtaattgtgcagctactttgaattgagaattgacattgttttgatgggaaagccttttatttaaagaagtctcccaatttatcagttttgagtgtggcttattgtctgtcattagatttccttactagcatatttttttatttccttgtgtattctgctgactggcctaacttaaggattgttttttctttgtttattttggtatctcattagttagcatccagttcattttgttgccattgtttaaaatatatatgcaacaagtttatggctttcctagcctgtagttttaaacagtaagtcagttgtctcagctaggaagaaagtgggtcagtaaggtagcattgagcatctgtgactgaagtgcctcagcatccacaagacaaaggcaacccaacttattagtcatttgttgaaatacagctattgtcgtagaacactgggacgtaagtctaactatgcactcacgtaacctaggttgttttaaaggtaggcattaaaataagaaaataaactggcccagcacatcaggtgtcatggatacccactggtaactgtcttctttgagagctggagactataaagcaaagtccctatttttgagggtgactttgaaaatatattgcattttttaaagaatacttaattgcaaatcttgggctagagcatataattgtgctttgctccataaaggcaataggaaatcgtgggatgggggttggtgggcagggggtacggataagtaagtaaagaaataagttacaggaagaagccagataggaagcttttacagttggtgtttagagcggacaaggcattcaaagggcaatgttattttgctactttcctttcagtggggatttataaggtcctgcgtttggcttacccagcactgtaatccactataatgccgaggatttcaaaggagtctccctgccttccagaaactcatagtctaagaataatttttagatcattgcattagatttttttagggggggatggtgggaacatgatgtgtgtatacgagagaggtgagatttaccctaagaaaagtgtcgctaatgttttaatggtaaaagaaattgtttgagctcgtattttataaaaatgctaaagtctggttctgtcagatcaattgctgctatctctatgctggtattttcagtttagaaagatgttttagctgtttttataaaatgaagtttcttgagtattattttgtcagccagtacaatgccttcagcatagtctttacctataggtgctaaaaatgcctgcattagaactactaggtagatcccagggacttttctttctttctttctttctttttaagatgaaaagttactgtaggagatgttctgagagtgccaaaaggacagtatttttcaaagtgttattacatatggtttgtcccttaaacatttaactgagtggagaagaaaaaatagggaaagagttgtttatttgtgtgaatttgtaacttaccctttaggtaagtcaagtatagtgagctttgacactcctaggaacaagtatacctagcactctaattgtggtttccaaatactattctccaggtaaaggaaccagagcctgttggagaaatgactgattctggggttgggacagggaaaatataagctgaacctagagcatctcatagcgccagaaagtaagaaaatgctaaaaaaatgtgaagatgtgggtatgtcagaaggatactagaaagagttcccaagggccaaagttggaacaattggtgccacaaaataaataataataaattataaccctcagaatagaataaatacccatgagtctatactgatatgagtgcctaaataaataaataaatgtgggggaggagggacaggtctttcttacaaaataattctaattattaaatgtagaagaaatgagagaaatagcaagtcagcattagagcaccacagtaataattgttttgggcaagatccactgatgaatggtaaaattagtggtgaaacgttaaaatgaaacaatatttgttatagcctcaaaatatctccccccaaaatatttattaattataataattattaattaccatggttttaacatatgtcgaaaattctttgatattccttacttgagttgaagcttaattcttcttccctggagtgtgagctaaacttagtaactcatttcaagaaatagaataatgaaagagaaaaatagtaactttgtagtagagaaagcaggcagaccataaagtggtcaaggtcaacattgccagtaataagtcctactgatattatggacctgggttgtgatgagaagggcacatctctgtggtattccttctcaaaatccatagcctcagtctaatcttcaaaaatgtcagacagacccaaactgagggacattctaaaaatacctgacaataatcttcaaagtatcaagttcaggaaaaacaaggaaagactgagaaactgtcacagatttaaagaagattaaggagtcatgacaaccgaatgcaatgtagtatagcagattgtatcctggaacagaaaaaaggacgttagtggaaaagctggtgaaattacattacagtctatagtttaaatactagtgtggtaccagtgttaacttcttagctatcataaagtactttggttatgtcagatggtaacatcagggaagctggatgaaggatatatggagactctgtactatctttgcaacatttgtataaatccaaaattgtttcaaaatacaaagtttaaaaaagaagggaggagggaaaggacattaaagccttgccctcggcttcatgaattggattgtgaagaatacagttttccagagtcaatttccctttgtttttatttttttctgttattttctgattataaaagtaatatagaaaatgtgggagctgggcatagtggctcatgcctgtaatcccagcactttggaaggccaaagtgagcagatcatttgaggtaaggagttcgagaccagcctggccaacagggtgaaactccgtctctactaaaaatacaaaaattagcctggtgtggtggcacgtgcctgtaattccagctacttaggaggctaaggggagaatcgcttgaactcaggaggtagaatgcactgcactccagcctgggcagcagagtgaaactctgtctcaaacaaaaacaaaaacaaaaaaacagaattatcaagatgattgaagctgagtaaaataatagagaatggtggtcagaaaaggggatatgtgcttttatctgaagtgatcagtaaaggcatctctaataaggtgacattaagacatctgaatgaaatgcgaggctgatacctaagggaatagcagtcaaggcagagagactgccacagtcaccccagcctttagtgaccacaaccctgatcagtcagcagccagcaacatcaagacagtaccctccatcagcaaaaatatcacaatcccctgaagtctcagatgagttttagcattttttagcaatgaaatatttttaaattaaggtacattttttaagacataatgctattgcacacttcatatgctacagtatagtgtaaacataacttttatatgccctgagaaaccagaaaatttgtgtgacttactttattgccatattcacttgattgcagtggtctggaaccaaatctacaatatctccaaggtatgattgcatatcaaataactgtttggagttttactataaaagggaggaaagaaatggagctatagctgggagacattattagcattattgtggaccataaagacactttgataggatggcttcattttaagaagactttgtctgtgggaagcattctagctcactggtaacaatttggatttggagtcagatagccaggctttaaatttgacccaactgatttatagttatcttaaggaaaggttactcaaattctctggatttttgtttcatccctcatcacatacctcataaggattaggtcagatcatgcttttgaagagcataatattcaactattactgtactttttgttacctctctttgagtcttggaaataaatgctgcagttttttctttcatcattcagccaatgaatgggaagtctccatactaacactgtggtggatttctgcttaatctactagtaattcacataaacttcatactttcctttccctttattaatcaaggagtaaaggtaacttagcttaaaattgacaaggagtacttttataggtgtgatggtgtgtagtgaggagagaggatttagctccatccagcagaaggtggcagttgaacattcacatagaaagatattcccatttcctactggcatgctttggtttcccctagactgacttggtgaacattaaatgcttagtcttgaaacattttatattggttttaggttgagttggttaattaaatagacaaattacttattgtcttcagtgaggccttatttttattggttgtctagaatagagttactagattgttagagctgccaaaaagaaatgtaataggtggtgtcctggggctacaactaggcttgctgggcctggatcaaacactttatatttggcaggcactttagtattatgcttggtaaattctcatggttgccttgtttatttaagttcttagaagttttaaataataaaaactttgagtgggctggtcacagtggctcacacctgtaatcccagcactttgggaggccaaggcaagctgatcaacttgaggccaggagtttgagaccagcctggccaacatggtgaatccgcatctctactaaaaatacaaaaaattagctgggcatagtggcacacgcctgtgatcccagctactcaggaggctcaggtaagataattgcttgggcctggcaggcagaggttgtggtgagccgagattatgccactgcacttcagcctgtgtgacagagcaagactctgtctctaaaaaaactttgggtggattaattccagcattactgtttgactaagcctatagaatgctttgaatattatttggatccccaaaaacagtcttaaaaacagttaaaagcataggtattttaatacttcatttatttctaaacctaattttcagaggcagtgatcccaatccagtgaagttaaataaagtttgggtcttcctactacctgtaaatgaacagcaaagactatgtaattaagttaatttagagtatgctcagattgtataacctgtgaagcatgctaagtaactgagctctatatagcttccttttccctcactgtctcctctggggcaaatggtttcttggcccatgaagatgtctaaaccaaggggaagtgtttctggccccctagaattagtcttttggaaagattaaggaaatgatcagaaattacttaattttcactaacaaatgagggaatgggggatggacagcttttttatggtggtagatgttttgaatctgacttcttttcccttcagagtctgataaggaggagaaaccacaacattctgtgatacccaaggaagtgacaccagccctatgctcactaatgagtagctatggcagtctttcagggtcagagagtgagccagaaggtaagtcatggtgtgtgttgttacagggttttgttttgttgctttttgccttttgtgcatgctgcgcattaataacatccaggatgtgcatcctttatttggttttcaaattccttttccatttgaatcagaagtaaagttaacatgggttaaaggaactctggagtaataaagaaatgtgttgctactctgggaataaaaaggcaaaaaaatacaatataggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaatacaatataatgaaagaataggaaggaaaagaaaatatccactaacagaactgaagaaaattctaaacgaaatggcaaaaagaaaattcatttttttctctctgctctgaagaacccttgttataacgtgtttatagcatctttggtagatggagagagatcttttatgacaaagagtgtgatacaatttttttaatgcatatagggcattgttcttcctagagcatatttacataaattatctcatttggaaaacacaacaaccttatacttgtgtctgcattagcttgtgcattttaaaggtcggaagaaattgaatcttttcaagagtctttctgagaagtcagtaactttcagaatacatgtcttacctttaaagatgatgttacggatggtaacgtgtgaggcttcattgtgaaatttaattgtgataaaccagtttaatttccttcagcatctctttcagggctacctgaaagagccatgagtaggctcttgatctgatgcagtgtagcagtttttaatccaaggtttatatcaataatccagcatatgtttaatgaataaatctatgttccactgttgtggacacctggctctgtgtggtcattttatttagactttaccagccgtgagaaaattcatgtctatgtctcaggacaagatgtgtaatcaaagtaggagctgtgctgagaataagaatacaggtctaaaagtgtttatatagaatgaagagaagattcaaatgtaattggatgggccaggcacggtggctcacatctgtaatcccaacactttgggaggctgaggagggtggatcacctgaggtcaggagttcgagagcagcctggccaacatggtgaaaccccatctctacaaaaaatacaaaagttagccgggcatggcagcacgtgcctgtagtcccagtacccaggaggctgaggcaggagaattgcttgaacccaagaggcagaggttgcagtgaggtgagattgtgccactgtactccagcccgggtgacagtgagactctggctcaaaaaaaaaaaaaaaaaaaaaggaaatgtagtttgatggagatggcagcacttttaatgttgactaggctagagataatcaatgtttatgtatttggaagatgttgaataaggagccgttaggctttaatatgaaaaatggtgtttacatgtatctgtaacatgggaagttttttcttttttaagtgggccatggcttactatggtagcttcttaatagctacttgaattttgaaatataagctactttggctttatcacagtattccttaacagatggttgcctattttaattttaagaaaaatagcatttttttgtgctcttgtttctcatacattggtgtgaagatggagttattctttaaacacatattacatttcctgcttatcagttgtattcataacaggtgatagcaaagaaaactattaccagaattacagaatcccataaaaacaggctggactaatgcttgcttctctgtttcttaagatggaacagtatttttatactcatgtcttcattttgagactgccatcattttaaattggaagaaaggaaactggaagggatctttgagatcacctctttattttatagaaccttaagcatagaaaggataagcttggtcgggcacggtggctcatgtctgcaatcccagcactgtgggaggccgaggcaggtggatcaccggagttcaggagttcaagaccagtctggtcaacatgatgaaaccccatctctactaaaaatacaaaaattagcctggtgtggtggtgtgcgcctgtaatcccagctacacaggaggctgagacaggagaattgcttgaacccagaaggtggaggttgcagtgagccaagatcgcaccactgcactccagcctgggtgacagagtaaaactccatctcaaaaaaaaaaaaaaaaaaaaaaggaataagcttggcaagctggtatgtagcagacctgacatataggtttggagtcttaaaagtccgaagaagccaactttcattgccttccattatagtctttctctctttggcatttactgtcatcctgcacaataatgcgtagacttttcttttatagataacaaaggatattatctgttaaactatatataagattttgtatgaatgtattttgactaattgttaaaatgtcctgctttaaggaaaaaacccttgcttcacattcctaagtcttaagaattattttatataatttgaattcagctttattaagccatccaggtcactagcaaatttctagctttcagtattaattctgggctctaggatgggatattgacacatagggagttttaaataaataataccaaggaaacaaagtggtcttttaaccatgaaatagtatctagaaggctgcttatttacctggattctaaatatataggaacaatctgtttcttcctgagtttaacaattgtgtcttcataattaagatctgtcttgacttaagaattagcatgaaagtgtttggaatcttaaacatggatagcatttttctggaaagatatttaaacaaggaaagtgtccctcaagtaagactgaagcaaaggaagaggtaatactcacatcagggtctgtaagaatcactaagatacaaatttaataagaaatacttccaaatgggttggtttaatatctattctgcatgttagcattttagcatttttttaactgtgttagaatttaagcacagttttacaactccccaaaattatgtttcctcaaactgatttggctataatgggggagatttccaaattaaagactatttcagaaggccacaaaccaaaaagggtgttaaatgtttgatagaactgaatgagctatatttaaaatttaattggtgaacattacattaatatatgatacttatctgggaaatgttgtaaatctcaagaaagagaaaaatataaatgttagtcccgtcctcatttcttagcagaaaattgacaattataagctctgattcatttgactttgtgttcctgaattgagtgatcgatacttgaggggaagggaataatagaaaatagtgtcctggtttttcttatttatcatctctattttatagatgaagagatttaggtagagataagtagcttgcccaaaggtcacacagctagtaaatgatggaactaggatttgaacctaacagtctggcaccagagtctgcttttaacacttgtccctatacttcttttcaaatataatttctacattcagtcctatgtaatgtttgagtattatgggttttgccactcttgtctaggcaattgaaccctgtctcccaacttctagaatagaattctttatatcatatcacactgattcatagtaagtaaatagtataactattggggagtggggagaggtgaagattctgagcttaaaatttgtgaattttcaactgttcatatggtttttctcctttattctgttaataatggtgaaatgtcaattgattttcaaatgtcaaaccagcctgtattcccaggataaaatctacttggtcatggtctattacccttttaatacattgatggatttgatctaatattttattaaggagttttgcatacatgttcatgagggatattagtctatggttttcttttattgtaagagatttggtatgagtagggatctatttcctcctcttttttaagggtttgtgtaggatttctaccagtttttctttttgtttcttgtttgtagaattcagtagtgaagccatctgaacctggcattttgtttttgggaaagttttaaattatgaattaaatttcattaataggtccaggactattcatattttcctatttcttcttgagtgggttttgatgatttgtgtttttcaaaagaatttgcttcacctaagttgttaatttattggtatatagttcataatatttcctgtgatatctgtaggatctataatgatgtcctcctcttttatttctcaagttgttaattgatttttttctctttttctcaaaaagtcttggtgcatttattaattttattaatcttttcaaagaaccaacttctggttttgttggtttttctctgttgtcattgattttcactctaatccactgattttcactttttagtatttcctctttcctcagaccctacacattacagtagaagcatagataattgattttagacttttctcatttctaatttaagcattgaaagccataaatgtaccttcatgaactgctttagctgtagtccacaaatatgatacattatgttttcatttttatttatttcaaaatatttcctaatctctcttatgatttgttctttaactcttggattatttagaagtgtgttgtttagtttctaaatatttgggggttttctagctagttttctgttaatgattttagtttaattctgctacagtcagagaacatatctctatactttcaatttcttcaatttattgatacttattttatggcccaacacaaggtaaatgttcatatgaacttgacaagaaaatgtattaggtcgggtgttctttgtcaatttgagttaatcgttagtgatattttgtatccctacgaattttctgtccaatttttctttaattactgagattggaacgttcaatattcaatcataataatggatttgtctaattctcttctcagttctatcagttttcgctgcaatgcatattgaaaatctgttcttaggtgttattctttgtcttattgacgaattgacccctttagcattatgaactgttccacttcatccctggtgatgttcactgttctgaagtcttttttgtctgacattaatacagactttcggcgttcatgtgattggtatatgcttggtatcttctttcatccttttgacttctttgttttactttttaggagttggtctgcagtttatagtatgcagcttaacttttcatcgtgtactttcaaatgatatctacttcacatgtaatttaagattttacagtgtatactacttacatattccttctgcctttttactattgttgtcagagattttatttctatagatgttataaattgcacatacacttaatatttttgctttagttttaaaattttgccaatgaggagaaaaagtcttttatatttattcacatatttactttttccagcacttatccttcctttgtatagatccaagtttccatctggcattatttctttcatagagatcactttctgtagctcttcatggtagtcttctcaatttttggtagttacagcttccaatttgaaaaatactagaatacattataaatgccttgcaaaaatctttcatagttttaagttattaagtgaacaatattatggctaggaggattattatggatttgttggttgcttttgaaaggtctacctgttttgttttgttttgtttatttttgtgtttgtttttcatcacacttagaaactcccatcaagactgaagcagacgttttggcagaaaaccaggttcttgatagcagtgctcctaagagtccaagtcaagatgttaaagcaactgttagaaatttttcagaagccaagagtgagaaccgaaagaaaagctttgaaaaaacaaaccctaagaggaaaaaagattatcacaactatcaaacgttattcgaaccaagaacacaccatccatatctcttggaaatggtaaattatttttctttaggttctaatctttgtgttctcacatcataaagatagagccactggggtgtgtgtgtgtgtgtgtgtgtgtgtttgttttaaggttaccagagacacattgaccttggagactttgtatcttaattctgtagctacatttggcatatagctggtatattcagtgaatgtggaataatgtaatttttacaaccacttaaaataaatttaggtttcactagttggtaaggaagtatctactgaggtttattgactttcttttaagtttccagtgaaagcacagctaaaagtacaatggcaagctgaagggaaaaaaagatttttagtacaaatgtctattgagaaccatacagtaacaaaaaggaaaggcctaaggttttctgacaattctcatttgttatcttctgggattgtcttccttccctccctcctccacctattttttttttttttttttttaagagttgaggtcttgctttgtcacccaagctggagtgtagtggcgtgatcatagctcactgtggcctcgaattcctgggctcaagtgatcctactgccccagcctcccaagtagctgggactatgggcatgcactaccatgctaattttttttctttgtacacctttatttatttgtgtttattctgtgcattcgtggctttattctcagcattatgtgctcaaaaatctaatagctttcttcaaattataaagaggaagcaatgcatcttcaagttctcagtagtggacatgaagctgtttgaaaatcaaagattttcatgtctaagcaatagaagtattttacattttttagtggagttataaaacttgacattctgtgaaaagtctgtttggttttgacttacaagttaagtacttattttgtagctaaagtgttcagtggctacactcttgaggtgctacatgtagcacagttgcttcctattaaaatggatctgaaatatacgctccattttgtatacatagtaaattacattttaaaaagttaccttataattggtaaattaagtgagctttccactgaaagtttctgtatgatgtttctgaactctatcaataacaccagaaaataaaataaattcctttttggcaaactacatgtgattccttgattatgtgcttgttctaaataccagggatttttagctttcttttaattacaataagcacaaaaatggaaagttataaaagtcaaggaatgttggaagtttttactgctattttcattgttacatgtaaatagatgtacttaccaatttctagactgcttatgaatttgggtttgggcaatcctctttgacataattttagattaaagaattgcagactttttagccgggcatggtggagcatgcctgtaatcccagctactcgggaggctgaggcaggataattgcttgaacccgggaggcggaggttatggtgagctgagatcgcatgattgcactccagcctaggcaacaagagtggaactctgtctcaaaaaaaaaagaatcgcagacgtttaaacctattttcctgtcctatgctagatactcttagagaggactccaaatataagcgttagtactgtttaaaaagctagattgtcttggctgggcatggtggctcacgcctgtaatcccagcactttgggatgccgaggcgggtggatcacaaggtcaggagatcgagaccatcctggctaacacggtgaaaccccgtttctactaaaaatacaaaaaattagccgggcatggtggcgggtgtctgtagtcccagctactcgggaggctgaggcaggagaatggcgtgaacccgggaggcggagcttgcagtgagctgagatcccgccactgcactccagcctgggcaacagagcgagactccgtctcaaaataaataaataaataaaaagctagatagtcttgatataaattaaaaggacatgttcttgcatcgttttttagcaaaatagtgaatataatacatatttcttattgttctgtcttctttatatggtgagggtacatgcaatattttagattgtatttcccagatataatttatttactacctcatctttttttaaattgtgttttagcttctagctccggacattcgacatgaaagaaatgtgattttgcagtgtgttcggtacatcatcaaaaaagacttttttggactggatactaattctgcgaaaagtaaagatgtataggcatctggtgtttcagcatacataactgaagcatgtgaaacagtatcatcctcgttagtagaggaaaaccaaaacccttttttccgtcaaaattggatttgtaattaaattgtaagcctcgtaggatgtatgttggaattttaagtctttcctttggttctatgcaaataaaaaaataactgattttttaagactgtgtctgtattgttgggattgaatctagtatttgctgggagaattttttctttgtatttattttaatgtattgttctcatgtaagaatgactgatgttgtgttagttaagaattgaagataggtttagcagtaaagaagaaagcttttaaaaggattgattcagctaagcaaagttgggcagagaaatacagccattttgtttttaatgcagaaaaggaagatgttctgtagcaagggggaatattttaaaaataaaccagatcaaattaatacaatcagaaggtttcgaaatgtaaatattccttatttaagacatgtttaaattcacctactagcacgacttacatagctcaaatattgaatgtttaaaatattaatacagatggggcctctttatgtttagataaaattgaagtacttaattgaagctttttaaaaattgtaaagtaaatgaaagctattgagatctttttgtctcctataataccagggaatttgagcttgtgttctagtcattgtactagctgtagctattggtctgtccttttgacatacagctaaaagggactaaatttgtaaaaaattagtttgttatagttgaagattaacttttcctaacattgtgattattgaagttcatgaatcttgctgtcaaggaagaaaggtaagaaagctgatagctcctccatgttggtaaaatcctctccagaatcttggaacacctggcatgtgaccctagtgacgtcacagacctgagatgaagattcatgtttagccagtgttttccagccttgtacccaccatacagatctgtttattctgtttcaccctactcctccagtgagccccatattttgggaaattatctgccttatacattaactaattcaattcatgtaacactgttgagtgcttactctttgtacctctattgtgcctatattaaaggtatacaaataaataaggccatgtctgacttcaaggaactcagtttaattttgatatattcaaagatgtgattcccaaccaactcaggatgaagtaactagtgttacaactgagttgatattctaaaatataacacagtttgtacttttattactagttagcatacacattttataggcttatgggttaataaatgaattcatggactcctggactactttcattgatgaccatatctccagggatgttgttgatccccacactgccttaaggtatattatataaacagttttattttccgtttttcttgtttcctgataatcaatgtatttaggactgaaaatacttctgagtactcccttggcagtatgtctgacagtctttagctatggtgactattgtttatttttaacgggtatttcagattccaagtgtatttaaaatttctaaggagatataatatagcctgtatggtttctattttatggaattatatggtcaatatttgtaaatattctatgagttttgggtgggtagaggggtgctttgcctgttttgggtacaggtttttttggatttagcttgttaattgttcaaactttctgccttctacattcctatcttattgttcgtttaatcagtttctgaaatgtaagcattacatgactattggtgagttgtgccttttataactgaaatactttactttttctcatatcctctataattgacttctattttccttaatcaaaccagctctgggaaatttaatacatttatattaattgagattattaaaacatttggactattcctggctgtcttactttgtattttctatatatcatgctctcttgtttttattttgtcatcttactggcttgttatttttttctccttgttattcctccagtggtttggaagtaattaaacctattgctatttctttagtgattaccttttttctttaagtttagagttaattagtagccacatcttccatccatctcccaattaagtcagtaaccttagcattgtttcacttccccacctcagcctctttttgtgatgtaatcagatacgattttagttttagattaatccctgggatcttggtgcgtatgtgtaaatagttattaggccactgtgagttttactgttttcttctgattgctttctcttgcatcccaggattagttttctggtgtgctgctgcatatcttcaagtaattaaatgttgaatcttcaatttaaagttttttaaattgagttatggttttagactcaaaatcattttcctttggaattttgaagctataacaatcatttgctgttatccagtattgttgattaaagtcacaccaatccgattacctctctttatttattgataagtaacctattttttcctcatgaaaaacttttggggttttctttttatgcttggagtcctaaaatttcaccaatttgtgtctagatctctgggacatttgtcattcatgctgcttacccccacggtcctttcatctgagtcattgtaccattcttgtactaaaaggcaattttaaataagatttttaaaattatttttcttaggtggatgtcaaacctattaacttaccctctacactatacttctgtattttgtcttgatctatttattctgaaagatttcttcagatatcaccttccagaccactaattcactctttgaacatatccattaccttattattcagctcttctatttcattttaaatttagtaattctttattttttagagacagggtctcactctgttgcccaggctggagtgcagtggcatgaccatagctcactgtaatctcaaactctggtgctccagtgatcctcccacttcagcctcctgattagctgggaccgcaggcacgcacaccactattagcctggctactttttaaatttaaattttaattttttgtagagatggagtctcactatgttgcccaggctggtctcgaattcctggccccaagtgatcttcctgccttggcctcccaaagtgctgggattacaggtgtgagccacctcgccttgctagtaatttgtatttacatattaaagattgctgtctctaattcttttttctcttctttttctttctttctttttttcttttttgagacagagtttcactcttgttgcccaggctggagtgcaatggtgcgatcttggctcaccacaacctctgcctcctgggttcaagcgattctcctgcctcagcctcttgagtagctgggattacaggcatgcaccaccatgcctgactaattttgtatttttagtagagacggggtttctccatgttgattaggctggtctcgaactcccgacctcaggtgatctgcttacctcggtgctgggattacaggtgtgaaccaccatgcccagccccagcccctccctcccccgcccccaccttttttttttttttttttttttttgagacagtgttttgccctgtcacctaggctggagtgcaatggcactatctcggctcactgcaacctccacctcccgggttcaagcgattcttctgcctcagcctccagagtagctggagttacaggtgcgcaccaccacgtccggctaatttttgtatttttagtagagatggcgtttcacgatattggctaggctagtctcaaactctcgacctcaggtaatccacctgccttggcttcccaaagtgctgggattacagacgtgagccatcacgcccatcctctaattcttgtttcatacatgtagtacccttacatctcagaggagatcaatcagaattttcacattttctgttccttgttttcccctttgattatcattggctctgtgtgctgtctgttgtccttaaatgttcccccttagctaggaaagagggattccctcttggtagttggtgtatgttttccctgcatttg

SEQ ID NO: 15830 - DNA, 192506 bp, Human
ctttcaggactcactgccatatacaagatgtagagtgacattcttaaacaattcatacatccaacaaaatatttactgaggcttccaggtgtcaaataatggggataagagcactgaataatttatacaaaaactcttagccgggcatggtggctcacgcctgtaatcctagcactttgggaggctgaggcaggcagatcacgaggtcaggagatcgagaccatcctggccaacatggtgaaactctgtctctactaagaattacaaaaaattagctgagagtggtggtgtgtgcctgtagtcccagctgcttgggaggctgaggcaggggaattgcgtgaactcaagagggaggttgcagcgagccaagatcgcgccactgcactccagcttggcgacagatcaagactccatctcaaaaaaaaaaaaaaaaaaaaagaaagaaaaaagaaaaaaaaattcttgctttcatcctggctttcttctgaaactttctggcttcctggctttggaggtttgggaattgaagaaaataaagtaaaaaagataataaaaacaaccaaagaggaaaggtttttctagatctagacatcctactctcccatacaagatttatgttgatggaacaacgatgtaaaataagaaaattcctgagataattttaaaaagagggcagaaaaaactcatagtagacttcatcgaggaatgtataaaatgggtagaacctggagtattcagtggcaaaatcttggacacaggaatacagtaacacaacatattggtctagcaagcactggaggagactgaggcggaattgtccagcgaatcccacaaaaatggaaatgaagaggtctcagtatctctaggtgcccgggtccgatggaataccgatgtacataccttttctaacacagtagcattagtttatatatcagcattacctctcttttgtttcagttgataagtatcctactgtaatccattcattcacactttgcttgttcattgttgaaacaaattctccctggaacaaaattctagtaaccaaatacatcatatcaggggaaacttccttacagcagggatggtattaaagtaaaaagaggaggaagtcccttcttcagctctggcagggacccggctggggaggaaaccttcccgcaaggtaggtgatctgctgtggtgaccaggctaaacccactctacagctgcaggagggactggcatcccttagaggtgaagaggggaggagacccacctcctggaatgtgtccctgtggtctccagatgatttcttcctctaataaggacaattctgccaaaggaatggaatgcttcgtcacaggctcaattactctgtctccgccagcctaccacctataaacaattcctcaaattaggaaagcggggagatttaataaagacataacacgtaaagtgtaggaaaactatttgtatggcattccgagacgactaggtcagagttaacaagtaaggagcaaagtagttaataataccaattctgtttacccatcacaacacctgtgctgaatgtcagggtttaaaaaaatctcccaacctttatctaaaaagatagggctacgtaacaatcggtgtggtttttgtcggtagaggtctaggaagccgcaagagtagtggacgccttgacagctgcccttctcgcgggccccgcggcggcgtgcccgtgtggttgcgtgcgcgcggacggggcggggctgaggagggacgtgcgcgcgcgcggacggggcggggtggagctcggagggcggacgcgctcggggccgtctggtcggcagggggcgctgcgcacccatgccgcgctctgcctgcccccgggtgctgtccgcggcggttcgattggagcagccgccgaagagcgcttggcgccattttgaagcggagaggaggaggaacggcagggctggctgcggaaggggagggggggggagaaggcgattggatgcggcggcggcggcggatcccggagagccccggagtgagcggagtagcgagtcggcaacccggaggtaggaaacaattcagttaacggaaagaaaatgtctctcttctctggctgcggcgctccatttttcagcggccgccactgccgctgtgtgcgtgtgtgtggcagggctgaagcgccgcccgcctgggtgccaggcgcgactcgcctcccggcatcgggggctgcagcgggtggctgcctggcggtggcccggggcgggggtcgcggggcgcgggccggctgcgcggtgggggtggggagggccccgcggccggcgcgcgcctccacgccgcgggttctgccgcagcctctggaaaattaaacttgccgctctgatcccggccggggcggcggcggcggcgggcggtgaccttgcgcgcgggcgggggtctcggggccgcccggccgcccgcgccctcccgccgccgccgtcgccgccgccgcgcccctccccccgcgccccggccggccggcggctgtttcccgggcggcaggcgggcggcgcggtgctcctgttgaatcctcccgcgggcgggcttctcccccttccgggcgaggggcgggcggggaccgcgggtcggggccgcgggcgctctcgcccccgccgccgggtccccgcgcgccgcctggcctccgcttcgggccaggggacgggctgagcgtgacatttttgcactgtccctcgccgctcgccggagggaaatcgcgctcaccgcgccaccccgagtggtccccgagcagccagttgaggaagagcccagcactggcgtggagggactcctcccaggccacaactgggttctagctttcctttcagaaggaacggcggggaaaatggtgtgcaattgtgactcgttattgtttttacactgttattttaatgttactttaaaagttttcggtccggagaaaaaccttgtttgttgttgttgctgctactgctgttggtttttggtagagacgtgaaagctaactcttaagtagctcgacagttattttggacgaatgactgaaaccagaaacgccgcccctcgccttcggagctgcaggctgctgcgttccttgccgcggacggggcgagctccgggaagggttggtagagcagctacccacccactccacgcgcgtcttcaacagcctctctcccccagcgagggttaacccttttttatgtcgaagaaagtgcttctcgtacttttaataagaggtgatggatgggcagtggtgcccagactgatcctaccctgttgatgaaatagtttcgaaaactttgggtatagccttaatttagagggttggtctgcggtgtggagagagttgggtaatcctatactatcttcctaatgaacttcaaaaactcaagttgtgtttacatacaggaggcgagctgtaaataaatcgtaattacccaatgcttgaacggcagtatagtcattgttctcagttaacacatcccgagttcccagacagaacgttttttatattaactcatgtagtggtcaggtaaagtaattaaaagccacaaatatggacttgaaagacagctcttcatgcagtacacatgtctgagatgttcgcatctttagggacaataaaatgagtattcaatggtgtatgcaggtcagttcgtgcaacaattaatcttgtatctcatggtgatagcagaaaacctaattaaaatttgtagtgctgaatatgtaggtgaaaattacatgggaacttttatgtgaagatagatttagtctcagaaacttaactgtaaaaacacatcttaagaacattattccttataaataaaatttgtacttaatatacatttacaaatatgtctaacaagatgcactttagactttataaaaattaccaaaatagtgactttttcctcctttttctgatggttttaaaaattgttctcttctcagctggcgtttacttaaaggtatattttaaatgggaaggtagtgtttgtcttggccttttttctttttttcttttctccttgtttcggttaaggctgattttccctatattaacttttcttttacagcagcttttgttactcttgtaggctttgttctctcgtgttatgtctctcccctctccccatattagagagagatgtggtgatgatagtgattgttgttaggagatgtttgtattaagcttatttgtaataagattctaccgagttggctgttggatgaaagttgtttaaattgttctgcagctttgtttaacgaagtaacattttgagcagtaggctttatcaataatttgttaggcctaagataaagtgatactctgtattaggcagggcttgccctggagaggggtgcaatggtagaaaatacccaaaactttgtggggaaggaatatttcgggaagctgtattctttctgctttacctcttgggaaatttagagactgccttagaactaacaggagtgctcagtatgatttggcatacggactcttgaatgacatggactgtatataacgtatattggaaaagaatacatttgtgtttcctctgttagtgttaaagagcaacaagaaaacttaaggatgatctccaactcacttatacatgagaaattaggttcagattttaatttcattgatttatctgaggtcacagtcatattcatgtggtggaactggggcagcccttaagatatcctggaagcttagaagtttccccattgtctttttttgttctattcaggatttagcaatatttattaataaaaattcagggtagtacattaccctccatccccttctcacctttttattcatttaaccaagaataaagttttgtggttagccgtctgtttcagcgtctggtttttaataatttctgtttaggattcagtccatttaggttgtctcagaagatagcctcttgtaggtctctgtctccgggagccgtctttctttatgtaacattacttgacatggcatttatttattctttgtgaaacttctaagagtaatttgggaaagttagtattgacctttgttttgttacaagatatagtgcgtgcatgagtatgcgtgtattttttcatttttaaactcagtttgctacacaagtcatctgtcacttctagttacaataggcgttttacttggttttcgtattcctgttcgggaatgttaaagattccaaaaatacttagtttaaaaacaagcccagtagtttctctgagagtgtatttactttttaagaagctgccaaatggttcgcaattctgactccttggagagtagaggtaagaagccctttcctcacactgttctgttacaaccacttgattctaaccatttcccccattacttgaaaaaggttttagaatcctttctcattaattagttcagaattaagaataaatttgctgtgttgagactgtaattgttttagctggcatgagtgatcgtgcacagtgaaaaaatcatgataataaaacttagatgaataaaatttatttgttcaaatcttaaagcctttgaggtttaaaaagtataatcattgtgttctaataattagacattaataataagtagtaattaaaaatacttggtttagctatgtaaaacataaaagctaacaggcttgggggaaagactgattaaagtaagaaactattttgaggcatctttttaaggactaaaagtattccactagcctgccattctcttttttgacggataattacctgattcaattaaaatgaacaggtacaaaacttccatatacatacagtaccagggatgatgcactaaacaggactgaagacaccctgtcctatagaagtgcagagtagtggttggccatccacagcaaggtgatgagagctgagacagaccagagagtaggatctctgctgttacttagttccgaaggagcaggccctccttccttttcagtggcagttgaggttgctctttttatgtgggagagtgaaattagccaagattagatcccataaggagaaggaggggctcttataaccaagaccattgtctttctctagaagaggatggttagggacctgaaaagaaatgagattttgtgtttccttaggtaagataggattctttctcctcagaggtgattttagggaagtaattgaagatattttaaaggaaagctccatatctccaaaatattatttagtagctgaagttctaccaggtagtttcagttagctttcagatatgggatgctttgggttgggtgtgggggtgagagttgcaggggcaagttgcaggggcaagatgctgggcaaattgcaggggtgagagttgcaggccttaagtactctattaggggaatagagtacctaaagaattgtgtattttaagttaaaggttatacaggtatatggtaaaaaaaaaaaaaatttaatgatagagtaaaaaatgttacttttctcctccccccacaggtaatccactgttaacagtttcttaaaagtttactttaaaaaaaattgtacaaagagtattgttatactgttgtactgtaatttactattttatttatttattttattattattattattttttgagatggagtctcgctccgttgcccagactggagtgcagtggggcaatcttggctcaccacaacctccacctcctgggttcaagtgattctccttcctcagcctcctgagtaactgggactacaggcgtgtgccaccatgcccagataatttttgtatttttagtagagactgtgttggccaggctggtctcaaactcctgacctcgtgatccgcccgcctcggcctcccaaagtgctgagattacaggcatgagccaccacgtccggcctactgttttattttttaactgtgatttacttttttccttagttaagtcacaagctcttttcatactggcacatacagatcaacataattaagaaataataagaatattttattataacataatttattttttctgactcctgttgagtagtactacgttgtaatagtttacattgaccagcagcgtatgagaatgcctgtgacatgtatttaccaacattggactttaaaaaactatattgccaatttgatatatgaaatttgtcttgttttgggtttgtatttctttgtgagtgaaggtaaacatttgtttatatgcttattagggggaggccatttgcaacatattctttaatcaagtggtttaatgctagtttaatttacttgctgcccccaccacctaccttcacccttacctaagagctaagatggtctgagagaagtgggactttaagaagaggaaaaatattttggggctcatggcaccttgacggggagcaatgctctgaatggagaggctacagcacctggctttgaacaactctgggtcagtatgagagtattgaaagcccttgacttggtgtaaacataaggtagaagagaagctgaagcgacacacaggaagggagatttgagagtcagggcaaataaattttgtatagagtcaaccccaccttgtaccatctgcttatcctgtctcatcacttctccctcccaccttcaactatcatttcatttttattcatactgtcatttggttttctcctcttttcctgtcaggcatggcagcctggacctgggtatttcaaatgccccagagatgaggtgtgcttagtttttggttttctttttttttgagacggagtttcgcacttgttgcacaggctggaatgcagtggtgtgatctcggctcactgcagcctcggccttggcaggttcaggcgattctcctgcctcagccttctgagtagctgggactacaggtgcacgccaccacgtctggctaattttttgcatttttagtagagacagggtttcaccatgctggccaggctggtctcgaactcctggcctcaggtgatctgcccgccttggcctctcaaagtgctggaattacaggcgtgagccactgcgccctggcctaagtagaagctcttgagcactttttccccctctgtctctttggtactattcctttcagctttcgactctcctagccttctggggtaacataaataggtcaagtctttatagctgtagttggaattcggaaggtcactggcatttaagacttgaacataggagcatatatcacaatatatgctcctatgatatatcaggatgtgatgcttgataagtggggtccctttctaaggaatgcagaagagcatggtggttaatttaagcatatagacttaagagtcaagacagcttgggtttttatctcctctagctaaacaagcaattacctaatcttactaaatctcaacttcttaatctgaacagtgggactaacagcagaaacctcatttttaaaagcagctttattgagatacaactcacataccataatccattgaaaatacacaattcattattttttaggatactcataggtttgtgcagccatcatcacagtctgattttggaacatttttgtcttctgtgaaaaacgccaaaccaaatgtaaatgagtagagccattacggagaatattatgggggctcctcaagaggtgagaagggatagagagaggttggctaaaggctacaaaatttagctagataggaagaataagttctagtgttgtactgggtgactacagctgacccttgaacagcgaaggggttaggggcaccaacccctgtgcagttgaaactccacatataacttttatttctctgaactttggtagtaatagcctactgttgattgaaagccttactgataacataaacagtcagttaacacatggagtgcagtggcacgatctcggctcactgcaacctctgcctcatgggttcaagcgactctcatgtctcagcctctggagtagctgggattacaggcacctgccaccacgcccggctaatttttgtatttttggtggagacggggtttcgccatgttggccagactggtcttcaactactgacctcaggtgatccgcccgccttggcctcccaaagtgctgggattacaggtgtgagccactacgcctggcctccattctgtattcttaaagcaagctagagagaagacaatgttattaagaaaattataaggaaggaaaatatatttgctattcattaagtggaagtggatcatcgtaaaggtcgtcagccttcttgtcttcctgttgaataggttgaggagaaggaggaaaaggaaggattagtcttgttgtctcgagggtggcaaggtggaagagagagaggaggtggaagaggaggcaggagagggaggcgcactgtaacttttactgaaaaaaatccatgtataaatgaacctgcacagttcaaacctgtgttgttgttacatattttcaactagctagaagagaggcttttgaatgttcccaacacaaataaatgataaatgtttgaagtgatggatatgttaattaccccgatttgatcattacacattgtatatgttgaagtatcaccatgtaacccacaaacatgtacaattatatgctggttaaaaagcataaaaataaaacccccgaacctactagctgtcacttcccatcaccccttatttctttagtgtttgggataagccaggtcaaatgcttaggttggtgccaaaatgtaagtacacagtaaaaaagcagttataactttttgcagggagactgtgtggcaaagtccatttacatagttttagagaatgcaaaaatgggataattactgaatggatgtttgcatacttccatactgtgcaaggatgtggtgcacagtgctggctagagatacaaagatgaaagatactcaatcaagagatgtatattcaagtgggaggaaagaggctggtataaaaatacttataaaacaagccagagtatagttagtgccttcaggaagggctcaatacaatatttggaattggaaacttgacaaatggagattagtcatgttactctgagagtacaggaactatgaaaaaattcttgaaggagcaaccattttgaccaagtcttagatgatggaaagatgggatttctggctttaatgaagagtaaagaatgcaatgctttttgaagtcttaaactatttgtttttgtttttgtaccctcatgctgctgccagatgattgcctctggaagctattcctacacctttttttgatgtttctaatctgttatgaacctgggggactaaattagtaaataatcttttagtgagagcctgatgtctgtatgaaaaggataccaatatatggtcttacgctgtcgttttgatatagttgcttttttagtttattctgtgggtcttggtttcatccctgttaattggtcttacagaataagtaattcctagataaattagcctcatatacgtgtcttcttctccaaggcttctagtaacaactatgtcccctgaccattctcctgaatttcccatcttctttttctagtgcactgttggacacaacacctccagtacaatatatcccaaactgatctaccttctcttactctttaacatctttccaacttgtaccttgattaataacagatttctttcttaaaaaaaaaaatgttgtaggggatgacatgactaggtttatcatcatgctagaaacctgggagtcatcttgacttctccatctcccctaactctcacattacataagttaccaaatcctgttgattctgatatagtatttttaaaggttattattattttaaattatatgcacatatatactccaaaagtaagacggcaaaaaggaaaaagatacacaataaaaaacctctcattccttccccatttgcctcattcctagactcccacaaaagtttatatatgttaatgttatgttatatccttctgggggtttcaaaacacaactatgtagaaggaaccacatacttaaacaaatagtaacacatagcatgggatttccacaatagaggtatacacagagtctgtgagaaggagaaagaaccaccatgcattccctaaaagaagagttaggtattggaaaaaccttcctattgggtcctgaatagaagatgaaaaggagaactttggacacgtgaataaaccaaactgagctgttaataagcagagaactatcaattagacacagagacaaagggtctaacaataggatgctagaacatttcattgtttggggggttcaaaggacctataaggaaataaaagaaaatgctggcagccacacacagtggcttacatctgtaattccagcactttaggaggccgaggtgggcttcttgaggccatggacttgcagttactttgggatctagcaaagatttcagcgcattgtagatgatgaatatttattgaatatgtgtaataatgtatatatactaaacatatatgtgacaacccaagacaaggaaaattaatacaatattaagctcacagatttatttagaaatataaaattttatttttattgaggtgtaattaaaatacagtaaaatgtgcagatcttagctgttcactttgatgaggtgtgatgattatacacatgtaaccaataaccacaagaagatgtagagcatttttattaccccacaacgtttccttgttgctctctccattcaatttcttttgcctccaaacactctttgatttttaaatgtagattagttttgttctatcttcatacagtgtgtgctcttgtgtatctggcttcttttgcttaacatattttgagattcatccatggggttggatgtatcagtttttattgctaagtaatatttcattgggggaatatttcacagtttatcttctgttgatggacatttgggtagaatccagtttttgactattatgaataaggcctatacagatctttttgcaagtgtgtgttttcatttctcttgagtaaatacctaggaatggaattgctggtttgtaggcatatgtgtgtttaactttacaggaaactagtttttcaaagtggttttcctttttatattcccacctgaatatatgaatgttctagttgttttacatcctcaccaacacttggttagtcaatctttttaattttagctattctagtgggtgtggaagggtatctcattgtggttttattttggatttccttgatatctagtgatgttgagcacctttttgcatggttgttgacagtatattttctttcgtaggatgcctcttcaagctttctgcccattaaaaaatggattatctttttactattgatatgcaggaattcttaatgtactcacgatacaaattctatgtcagatcagagtattaagagtattttctcctgttttgtagcttgccttatcttttttttaacagtattttgatgagtggaagttttaaaatttgatgaagtccagtcaatcaactttttgttttatggattgtgctttgagttctttttattttttatttttttgagacagcgtctcactctcccaggctagagtttagtggcgccatcatagctcactgcagcctggaacttttgggctcaagccaccctcctatctcagcctcctgagtagctgggtctacagatacgtgccaccatggctggctcatttttttttttttttgtattttttgtagagatggggttcgccatgttgcccaggctggtgttgaactcctaggctcaagtgatcttcctgcctcagcctcccaaagtgctgggattacaggcatgagccagtgtgcctggccctttaatttctttttcacatgttattgcagcatctgggatcttcaatacaacattgaagagaaatggtgagagtggctgggtgcagtggtatggtcctgtagtcccaactacttgggaagcaagaggattgcttgagcccaggagttcgagtccagcctgggtaacacagagagatcctgtctctttaaaaaaaagaaagaggccgggcgcagtggcccatgcctgtaatccgagcactttgggaggctgaggccgaggggggggcggcagggggtgcgggggttgcaaggtcaagagatagagaccatcctggctaacatggtgaaaccctgtctctactaaaaaatacaaaaattagttgggcatggtggtgtgcatctgtagtaccagctactcaggaggctgaggcaggagaattgcttgaacctgggaggcagaggttgcagtgagcagaggtcgtgccactgcactccagcctggcgacagcgagactctgtctcaaaaaaaaaaaaaagaaaattaatttcagtgttaacataaaatatgttttaaaatgatgaatttttttttaaatgagagtgaacatcctggtcttgttgtgatcttaagggggaaggcatttagtctttccccagtaagtagtatgtcagcagtggatattctgtagattaaaaaaaagaaaatcagacgagacgtttccttccagtttactgggattttaattaaatcaaattaattaatttactttttgagatggagtctcactctgtcacctaggctggggtgcagtggtgtgatcttggcgcactgcaacctccacctcccgggttcaagcaattctgcctcagcctctcaagtatctgggactacaggcacccgccaccacgcccagcaaatttttttgtatttttagtagagatggggtttcactatgttggccaggctggtctcgaactcctgaccttgtgatccacctgccttggcctcccaaagtgctgggattacaggcgtgagccaccgcgcctggccaggatttttatttttaaattatgaatgggtgctgaattttgtcagataccctctctcctttttggtatttattgagattattgtagtttttaaatattccattttattaacttatttagagacagggtctcactgtattgctcaggctgaagtgcagtggtgtacccagttcactgtaacctcaaattcctgggctcaagcagtcctcctgccttagcctcctgggtagctaggactacaggcacatgccaccaagaatttcctttaatgttgcataatgcataggtctagtaatagcatcagttttcattactttaaatatatctatattttactgtcatttttcaaggatatttttgctggatatagaattctcagttgatggttttttttctctcttttttttttttttttttgagacagagtcttgccctgtcacctaggcaggagtgcagtggcactatctcggcttactgcaggctccgcctcctgggttcacgccattctcctgcctcagccttccgagtagctgggactataggcgcctgccacggcgcccagctaattttttgtatttttagtagagacggggtttcactgtgttagccaggatggtctcgatctcctgacctcgtgatccgtctgcctcggcttcccaaagtgctgggattacaggcgtgagccaccacgcccagcctcagtttttttcctttaatcaatttaaagatgtcattttattcttctctggtctccattgtttctttaactttcaacaatttgatgttgaaagttattgtcatataaatataacattcatattgagtaggataaagttatattgaatttgtgaattgtttttgtattctgtttggagtttgctgagcttatttttatttttattttttttgcgagattgcatcttgttttgtcacccaggctggagtgcagtggcgtgatctcagctcactgcaacctctgcctcctggattcaagcaattctcctgcctcagcctcccgagtaagctgagattacaggtgcacgccaccatgcccagctaatttttcgtatttttagtagagatggggtttcaccaggttggtcaggctggtcttgaactcctgaccttgtgatctgcccgccttgggctcccaaagtgctgggattacaggcgtgggattaccacacctggcctatttgatttgtaagttgatactttttcccaaaatttggtacattttagaccttacttaaaaaataccggccgggcgcggtgactcatgcctgtaatcccagcactttgggaggccaaggcggatggatcatgaggtcaggagatctggaccatcctggctaacatggtgaaaccccgtctactaaaaatacaaaaagaaattagccaggcgtggtggcgggtgcctgtagttccagctacttgggaagctgaggcaggagaatggtgtgaaactgggaggcggagcttgcagtgagccgagatcgtgccagtgtgctccagcctgggtgacagaatgagactctgtctcaaaaaaaacaaaaacaaaaccttttctgccccattcctctgtttttcctcttgagattctgcttacacattattctgtttaaaattggtccatgagtatgtattaatttttttctctgtttttcagagactcttttaaatgttgtatctaatgtgcagtgaagcctgttttcagtgaatgcacccttcagttacagtattttgtttaaaaaattccatttatctgccaagattccccattgtgaccatatttttcttttaagtctttgaatgtattcataatagctgttttgaagtccttgtttattcctttgtctgtattaatggacttttgactcttttttcccccttgatagtaggtcacattttcctgcttcatttcataaatacaaaatttttgttgtagagtggatatgatacatcatatctctaaactctttttatcttcccttgatgaatgttaaaattagtggctgattatattgaatttttggaaccttggtcttctgttttaagatgggtctatagaaagtctgaggcgttggccaggcgtggtggctcatgcttgtaatcccagcactttggatggccaaagtgggtggatcacttgaggtgtcaagagtttgagaccagcctggccaacatggcaaaaccctgtctctacaaaaatacaaagatgagccggtgtgatggcaggcgcctgtaatcccagctgcttgggtggctgaggcaggagaatcacttgaacctgggaagcagaggttgcagtgagccgagatcgtgccactgcactccagcctgggcaacagagtgagacttcgtcttcaaaacaaaacaaaaaaatttgaggtgtttaccaagcccttctcacttgtccaaacttaaagctcatgtgttctccgcagtggacagcagctaaaattgctgctgagttctttgagctttttagttgttgttttcttctgggatccttggaatcttccctgagcatatgaagttcggggatcagcaaataatttgaaggagtttatatttttatatttttgaggcttccctaccgtagctctctcctttgaattttccctttgattttctagccactttgtagccttgaataaaacagctttctgcttgagctctatctgccctatgctgctgcaaactgggagtgtcctcaggagtaatgctgtacaaatttgaatctcctccactatacttccccttctttcatgatcagatctccagtttctacttgctcttgattgctttcctctgttttcaagtcattctttaaaagtattttttttcccagggtttataattgctatttgtggaaagattatttcagtgagtttgctgaattctattccaccatgtccagaactgttcacactcattttcattcattttaaactgggcgttaaacacagttgctaacttaatacacaccttgttttagaataagatagaaactcagtattgtttcagtcacatacacttgataagaataggttatttgatggaaagctaagagctaatgaatgtttatgaaggctggtgaaagggatagccatatttctactgttgtctcttttcctctttattggcagcaacctgatagacagcagtgggacacatggtaccaggtgatactggaagaaaatatcatttttcagctgtctttgacctttacccctcttgatatttctactctgaggaaaaaatactaaaatgtaattgttggtctcaactgcttctgtctaaaaatagatagggctgttggacatttatctttaaatggttaggtaggaccagctcaagtccaaaagaccctttaggatcattttacaaatatttgtttgtggctctgactttagctaagcagattaaagaaaaggtatattcaagagggaactacattgaattggttttagagatggcacatacatcttttaataagttggttattttgtattgccagcacaagtataagggacagtgcagtttaaatgcatttattaaagttgatttttcttttgaatttgaacattgtccgttttgttttaatgtaaatgtaactgtaagaagttaggttttaatatttgatcttgctcctttaggaagtgaatgcattcaaaacaatgtttttcagttaaattcttttttttttaaatccttgtcttttttttaaaattatactttaagtgctagggtacatgtgcacagcgtgcaggtttgttacatatgtatacatataccatgttggtgtgctgcacctgttaactcgtcatttacattaggtatatctcctaatgctatccctctcccctcccttcccctcaccccactacaggccctggtgtatgatgttccccaccctgtgtccaagtgttctcattgttcaattcccacctatgagtgagaacatgtggtgtttggttttctggccttgcaatagtttgctcagaatgatggtttccagcttcatccatgtccctacaaaggacatgaactcatccttttttatagctacatagtattccatggtgtatatgtgccacattttcttaatccagtctatctttgatggacatttgggttggttctaagtgtttgtattgtgaatagtgccgcaataaacatacatgtgcatgtgtctttatagcagcatgacttataatcgtttgggtatatacccagtaatgggatggctgggtcaaatggtatttctagttctagatccttgaggaatcgccacactgtcttccacaatggttgaactagtttacagtcccaccgacaatgcaaaagtgttcctatttctccacatcctctctagcacctgttgtttcctgactttttaaagatcgccattctaacgggtgtgacatggtatttcattgtggttttgatttgcatttctctgatggccagtgatgagcattttttcctgtgtctgttgactgcataaatgtcttcttttgagaagtgtctgttcatatcctttgcctactttttgatggggttgtttgattttttcttgtaaatttgtttaagttctttgtagattctggatattagccctttgtcagatgggtagattgtaaaaactttcttccattctgtaggttgcctgttcactctgatggtagtttcttttgctgtgcagaagctctttagtttaattagatcccatttgtcaattttggcatttgttgccattgcttttggtgttttagtcatgaagtccttgcccatgcctatgtcctgaatggtattacctaggttttcttctagagtttttatggttttaggtctaacatttaagtctttaatccgtctggaattaatttttgtgtaaggtgtaaggaagggatccagtttcagctttctacatatgggctagtcagttttcccagtaccatttattaaatagggattcctttccccatttcttgtttttgtcaggtttgtcaaagatcagatggttgtagatgtgtggtattatttctgaaggttcttttctgttccattggtctatatctctgttttggtaccagtaccatgctggtttggttactgtagccttgtagtatagtttgaagtcaggtagtgtgatgcctccagctttgttcttttggcgtaggattgtcttggcaatgtgggctgttttgtggttccatatgaattttgaagtagtttttcccaattctgtgaagaaagtcattggtagcttgatggggatggcattcaatctataaattaccttgggcggtatggccattttcacagtattgattctttctatccatgagcatggaatgtttgtgtcctcttttatttcgttgagcagtggtttgtagttctctttgaagaggtccttctcatcccttgtaagttggatacttaggtattttattctctttgaagcaattgtgaatgggagttcactcatgatttggttctctttttgtctgtataggaatgcttgtgatttttgcacattgattttgtatcctgagactttgctgaagttgcttatcagcttaaggagatttcgggctgagacgatggggttttctaaatatacagtcatgtcatctgcaagcagggacaatttgacttcctcttttcctaattgaatacactttatttctttctcttgcctgattgccctggccagaacttccaacattatgttgaataggagtggtgagagagggcatccctgtcttgtgccagttttcgaagagaatgcttccagtttttgcccattcagtatgatattggctgtgggtttgtcataaatagctcttcttattgtgagatacgtcccatcaatacctagtttattgagagtttttagcatgaagggctgttgaattttgtcagaggcctttctgcatcttttgagataatcatgtggtttttgtctctggttctgtttgtatgctggattacgtttattgatttgcgtatattgaaccagccttgcatcccagggatgaagccaacttgatcatggtggataagctttttgatgtgctgctggatttggttggccagtattttagaggatttttgcatcgatgttcatcagggatattggtctaaaattctctttttttgttgtgtctctgccaggctttggtgtcaggatgatgttggcctcataaaatgagttagggaggattccctctttttctgttgattggaatagtttcagaaggaatggtaccagctcctctttgtacctctggtagaatttggctgtgaatccatctggtcctggactttttttggttggtaggctattaattattgcctcaatttcagagcctgttattggtctattcagggattcaacttcttcctggtttagtcttgggagggtgtatgtgtccaggaatttatccatttcttctagattttctagtttatttgcatagaggtgtttatagtattctctgatggtagtttgtatttctgtgggattggtggtgatatcccattcatcattttttattgcatctatttgattcttctctcttttcttctttgttagtcttgctagcagtctatgaattttgttgatcttttcaaaaaaaccagctcctggattcattgatattttgaagggttttttgtgtctctatctccttcagttctgctctaatcttagttatttcttgccttctgctagcttttgaatatgtttgcttctctagttcttttaattgtgatgttagggtgtcaattttacatctttcctgctttctcttttatagcatttagtgctataaatttcccgctacaccctgctttaaatgtgtcccagagattctggtatgttgtgtctttgttctcattggtttcagagaatatctttatttctgccttcatttcgttaaatgtacccagtagtcattcaggagctggttgttcagtttccatgtagttgagtggttttgagtgagtttcttaatcctgagttctagcttgattgcactgtgctctgagagacagtttgttataatttctattcttttacatttgctgaggagtgctttacttccaactatgtggtcaattttggaataagtgcgatgtggtgctgagaagaatatatattctgttgatttggggtggagagttctgtagatgtctgttaggtctgcttggtgcagaggttagttcaagtcctggatatccttgttaactttctgtcttgatctgtctaatatcgatagtggggtgttaaagtctcccgttattattgtgtgggagtctaagtctctttgtaggtgtctaaggacttgctttatgaatctgggtgctcctgtattgggtgcataaatatttagaatagttagctcttcttgttgaatcgatccctttaccattatttaatggtcttctttgtctcttttgatctttgttggtttaaagtctgttatcagagactaggattgcaacccctgcttttttttttttcccatttgcttggtagatcttcctccatccctttattttgagcctgtgtgtgtctctgcgtgtgagatgggtctcctgaatacagcatactgatgggtcttgactctttatccaatttgccagtctgtgtcttttaattggagcatttagcccatttacatttgaggttaatattgttatgtgtgaatttgatcctgtcattatgatgttagctggttattttgctcattagttgatgcagtttcttcctagcattgatggtctttacaattggcatgtttttgcagtggctggtactggttgttcctttccagatttagtgcttccttcaggagctcttgtacggcaggcctggtggtgacaaaatctctgagcatttgcttgtctgtaagggattttatttctccttcacttatgaagcttagtttggctggatatgaaattctgggttgaaaattcttttctttaagaatgttgaatattggcccccactctcttctggcttgtagagtttctgccgagaggtctgctgttagtctgatgggcttccctttgtgggtaaccagacctttctctctggctgcccttaacattttttcctttgtttcaactttggtgaatctgacaattgtgtgtgttggagttgcccttctcgaggagtatctttgtggtgttctctgtatttcctgaatttgaatgttggcctgcctcgctaggttggggaagttctcctggataatatcctgaagagtgttttccaacttggttccatgctgcctgtcactttcaggtacacgaatcagatgtagatttggtcttttcacatagtcccatatttcttggctttgttcgtttctttttactgtttttcctctaaacttctcttcttgcttcatttcattcatttgatcttcaatcactcataccctttcttccacttgatcagatcggctactgaagcttgtgcattcatcacgtagttctcgtgccatggttttcagtccatcaggtcatttaaggtcttctctacactgttcattctagttagccattcgtctaatcttttttcaaggtttttagcttctttgcgatgggtttgaacatccggagaagtttgttattaccgatcatctaaagccttcttctctcaacttgtcacagtcattctccgtccagctttgttccattgctggcgaagagctgtgttcctttggaggagaagaggtgctctgagttttagaatttttcagcttttctgctctggtttctccccatctttgtggttttatctacctttggtctttgatgatggtgacgtacagatgggttttggtgtggatgtcctttctgtttgttagttttccttctaacagtcaggaccctcagctgcaggtctgttggagtttgctggaggtccactctagaccctgtttgcctgggtatcaccagtggaggctgcagaacagcaaatattgcagaacggcaaatgttgctgcctgatccttcctctggaagctttgtctcagaggggcacctggctgtatgaggtgtcagtcggcccctactgggaggtgtctccagttaggctactcgggggtcagggacccacttgaggaggcagcctgtccattctcagaactcaaactctgtgctgggagaaccactactctcttcaaagctgtcagacagggacatttaagtctgcagaagtttctgctgccttttgttcagctatgccctgcccccagagttggagtctacagaggcaggcctcctttagctggggtggggtgggctccacccagttcgagcttcccggccaacttgtttacctactcaagcctcagcaatggcgaatgcccctcccccagcctcactgctgccttgcagttcgatctcagactgctgtgctagcagtgagtgaggctccgtgggtgtgggacccgctgagccaggtgcgggatataatctcctggtgtgccgtttgctaagacctttggaaaagcacagtagcagggtgggagcgtcctgattttccaggtactgtctgtcatggcttcccttggctaggagagggaattccccaacgccttgcgcttcccgggtgaggtgatgccctgccctgctccatgggctgcacccactgtccgacaagccccagtgagatgaacccggtacctcagttggaaatgcagaaatcacccgtgttctgcgtcgctcatgctgggagctctagactggagctgttcctatttggccatcttgaagagggatcttcagttaaattcttaagtatttttgctgatggaaggaaagccagtgcatgattaccacaaaagggctgaatatgttcacctgcctcttctctacctgatataaccccaactgacttttaaaaagttgcaaaaatttagttggggttatatgaggtagagaggagacaggtggacatattcaccgctttctatagtagtctaaccctaaattacacttccatctctgtcagctagggtttgattaaagaagcaaaattattgtgtttaagagatttattacagtgattgatatatatatttttaacgaattgtaggaagcgtttgtatgcttctgagtctggtgctagacttgaagttgttagggctggcagttgggaagggacgatagacatgaagtgggggagatcatggttaagctggaacctacagagatttggaagtcatggaagtgagctgacccataagctcaaacttgaacctgcattgttgtctcactgcttctgaacctgcaactttgatgatgtgggcagtagatatggcacactttaccatggaactgcacacaaactggtcccaggattatttggagaagttggagaacgagatttgataggcactggaggagctgtgagcccagttgctaccctgtgccaccgaaggtgaaccaaaagatctatgacaacatgtgagaaagtggcaatgcttatcttatgttgacctagtgaacacaaatgtggctactgcttcacttttgtcttctaaatttcatggaaatttcttttgaggcgaaccctaactcacacccattcatggaaaagaatttagagaagggtagttgctacctagctaggttgatacaatacaaagccatcacagttcaccctcttgtcatacacacctcttttaatcatatttaatttgcaaataaaggtggttggaaaattgtacttttgctgtgcataatgcaactatccttagttcaaataacacataaatcctctccttaagagaggctccaaatccctttatccgttgttggattaatttttcttttacctaagtcacattttgtatttaatttagatactgaaatatgaggctagctactattagattgttgtagaaaaggtgagaaaagaataaattggttaattatatacagagatttttttttttacattaagaggaaaatacttattagagttcttacttctgcatcaagttatgtgcttgtagttgttatctgtaattaccttcttccactgccattccatgttccctctgtctttggctaacaactcagttagttgtggtttcttgcctggtggggtgaaccaagcttgcttgcttgctttcattcatttattctgtaattctggaccattagcagtcttgcctggattgtttccactgactttaaccatagtccatggaaatagtaagtggtgtcccagaggaactcctacattccagacatactttttcttagcccccttgtgtagtagcaacccagtttccccttgatagtgagatcagtcactctagtcagttctgtaatcttcatcttttgttggtcatgaagagtccaaagtggctgggtggcagtctcagcttacagtaatggaaccattgctgcatccgttggtggaaacattccttccttgggaactgagatctctagcagaggctaaaattgtggggatgggaagaaaaaaagaaaaaaaaaaaacaaaaaaatgagaacacctttttatgctaatggcaataaaatttaatagaggaaaaaagttgatggaggcaggaaagagatgatagaattgctggagcaatgtcctgcagtaggaaaagattaactagtgtaagagttggcttatttaagagcactgagaatttcttgtaacatgaagagatggtagagtatatgggcatagatgcatataagctggcagatgatgtggtgtgtcttatgtatcagtggattagatcatcagttgagaatgacagtgagttaatacaaatcaatgtaggtacgtataggtaatacttgggaagttaagggagcccaatacaaaaatgttgaagacgtataaataagaaagtgcataataagttaagggacaggttgctgttagcgattgagttctaattctaatgatattctctgaaagacaattttgaggattagataaaataccctatgtaaagtgcttaaggtgtaatgtcttgatgtattccagtaagtactcaataaatgttaagtatgattgttagtaacactaacagttactctgatattttgcattcctaaccaaatgttcataataatcctgtaatactgtgatcttttccttcttacacttgaggagatggatagagttgcttaaaagttaccaatgtgccaatgttagtagtagatccaacatttgaaccaaatttttttttttttttgctttaaaaatctaattttttcctttgagagatatatagtggttaaaaatgtggactctggaacttcactgtgtttgagtcctggctctccccttactagttgttcatccttgagtgaatgatttaacctctttatgcctcactctctaggaaagagattacttacctcagagttcttggtgaggatgaaatgaattaatacgtattaagtggttagaattttgagcactgggtaggtactcagtgttattcctctcctcttagtattataccatgctgcctttagttcaaaccttttaaaacctttcttattgaaaagtttaagtgaggctgaaattatcactttcctttttagagccatctttttttttttcataaagtagtgttaatctttatggtttaagttcccaaatataataattatgaattttacttatgtgaattgatcacaaataggggcatttcagtttggagaaaaactatcccacaggattttgtcttttttgtttttcaacctcctttctaagcgttttctgcatagtcattcatttccatggcttcccttatatgttactcccaaatcagcatctgatgttttacctcatttctcattttcattcactgatttgttttcttctttcttcaattagtcactaaatttacttcttttattatcccaaacccttctcttctctatgcctgttgcttttggtttagttaaggtccttattattattttttcattcattagtgtagtagcctcctaactggtctcccaattccagtcttgtctttttctactccatccttcagtaattgttaaaacagtttctgtgaaagacatttgatcattttattactttggttaaaactttttttttttttttttttttggagaccaggtcttgttctgttgcccagactggagtccagtggcatgatcttggctcactgcagcctctgcctcctgggctctagtgatcttcctgcctcagcctcctgagtagctgggactacaggtgcgtgccaccactccctgctaagtttttgtattttttgtagatacggggttttaccttgttgcccaggctggtcttgaactcctgggctcaagtgatccttccatctcagcctcccaaagtgctgggattacaagcatgagccacggtgcctggttctcactgcccccgcccccctttttgttaacttcccattgtctgcaagaaaaaataagtttgatcattcagggttcctgatacatctgtctctgcttccctctccagcagaatctttacttttcaacagaatttctgagttctggctatatgaaactattgaatactctcatattcagtacttttaatttcatatgaaatctgcctgggtttgttctgttggcagactttcagactgtgcatcttttttttttttccttcacgtaggccatccctcaggagactgtgcatctttttaaagatttaactggtgtaatttctcagggagttttccttacctcagggcacatgtattcagacacctggaatctttacctgtattggtatatgcctttattatagcatttatcacccaagcccagctaatttttttgtatttttagtagagacgggatttcaccatgttggtcaggctggtctcgaacccctgacctcaggtgatccactcacctcggcctcccaaagtgctgggattacagacgtgagccaccatgcccggcccacattgtttttttaagaacaattttatttaggtataatttacatatcgtatagttaactaatttaaaagctgaacagctcggtggtttagtatattgacagagttgtacatccatcaccacaatcaattttagaatgttttcattaccctcaaaagaaaccctgcacctcttagccaatgccgtctgctatggtttgaatggttccccaaagttcatgtgttgggaacttgatcctcattcagcagtgttgggaggtgggacctaatttgagatgattagatcctgagggttgagtgaatggattaatgctgctattgcggaaatgggttagttatcacaggagtggattcattataaaaggggaggcccttttctctttcttttgcccatgtgatgccttccaccatattatgtggcagtaagaagaccctcattagacgctggcccctcaatcttggactttccagtctccataattgtcagccaaataaattttcattcattatgaattacccagactgtggtattctgttacaacaggacaaaatcgacacccctcaaccttaggcatccactgactgactttttgtctgtagttttgcctattctgaacattgcgtattaatgaaatcatattgtgttttgtaactagtggcattcattcagcgcagttttccaaagttcactgatgttttagcatgtatcagtacttcattttttcttattaccaaatatttcattttatggctgtattacattttgcttatcagtttgatgagcatttgggttatttccatttttcagctattataaataatgctgtttgaagatttgtgtacaagtttatgttttgacatatatgttctttctcttgggtataaacataggagtagaattgctggatcacatggtagttccatgtttatccatttgaggaaaagccagactgttttccagagctactgcatcatcttacattccctccagcagtgcatgagcgtttcagtttttccatgtttttgcccatacttcttattgtctgtcattttgattatagtcattgcagtgggtgtaaactggtatcacgttgtggttttaatttgcatttcctgatgattaatgatgctgagcatctttttatttgtatattggctatttgtatatcttctctggaaaactgtctattcatatcctttgcccatttttaaattgggtcatctttttactattcagttgtaataaagctttatatattctagatacaagtgccttatcatatatatgatgtgtatgaatgttctcccattctgtgaattgtctttttactttgttgatggtagcttctgaagcacaaaagttgtaagttttaatcatgtctgtttaacctgtttttgctatgttatttatgcttttggtgtcatatctaagaaaatgctgtctaatctagggttgtaaggatttaaatctctgtttttgcctctaagaattttatagttttagctcttatatttaggtctttggtctgttttgagttaatttttgtatatggtatgaagtaggcatgcacattcattcttttgcgtgttgataacctgttctgtcaccgtttgttgaaaagactgttcttttcccattaaattggcttggcatccttggaaaatcaattgattgtaaatatgagagtttatttctaggctgtctgttctgttccattggtgtatatctcattgtgccagtgctgtactgtcttagttaatgtagctttggggtaagttatgaaattgggaattgtgagccctccaactttcaattttttctcaagtttcatttgcctattttgggttccttgaatttccatgtgaattttaggatgagcttatccgtttcagcaagaaaatcagcggggattcacattattcacattggaatttttttttttttttttgagacggagtctcactctgtcacccaggctggagtgcagtggtgtgatctcagctcactgcaacctccgcctcccgggttcaggcgattctcatgccttggcctctagagtagctgggattataggcacctgcaaccatgcctggctaatttttgtatttttagtagagaaggggtttcaccatgttgaccaggctggccttgaactcctgacctcaagtgagctgcccgccttggcctcccaaagtgctgggattacaggcatgagccactgggcctggtccacattggattttcaatagtttactcatctgtctcaaatatttatctaataattaatttcttatgatgtatgaaccaggcaaagtagatattacttattgccaggtttattttacaaacgtaaaaacgttcaaaatggttgagtgagctgtctaaggtgacagtggctcaagtcaaaacattttggctgttgactccaaatgtcaggttctttccactgtacctactcatgtgactgattttcttgtatcttcctcttaatcctgttggaagtcttgtgaatatttctctgagactattattatttaaagttctccagtagagattgattgagcttagttgagtttgtcccttttgtaactttttcttgatgtgtgtacaaagtaaacacaagtttataagtggacaggtttgtgaatttttacatgcttatgtaaccagcattcagatcaagagacaacatcaccgacaccacagaaccacctccgttgtgccccctatcaattattattaccccaagggtagccactatcctgattttgtgatagcatgttttgtctattttataacttgatataaattgactcatatctatatatagtttgttgtatctgacttattttgttcaacatcatgtttatgaggtttgtctatcttgttgcatgtagtagagtaagcagggatactcctggtacttttgttatgaaattcttatacattattttcagttactcatcagatagtttttcatcaattgcaaaattatattatccaaagctgaattgagatttgtgggaatcagaattttgatagagtgattaggaagatccctggtatacaaaagtgaaatgtatacctatcataatttattatataaagcatgtgtattgaatcatcaagaatagatggctcctactgggatcgattgtactttattatattttgccttttctataatttttagttgtgtcgtttttataatgagtgaagagaaagtctgtaccctttagagacacttattgaacttctagtcatcatggtgtaatgaagagtgtgtgaattttggaattacatctggaattaaattccagctgtatcaaatacaagtattttcaccatgtgagctctggacatgttgcttctcttaataagcatggatataaaatatctcatggttgctggaaatataaatcatagaaagtacatataagtaacttatatagtccctggcaataggtgctctgtgaattttagttttaatctttattatgtgattagtgcaataattcatcaatccagagtagacttttgttttcagaatattgaaatttttttatagtgtctaaattcttgcctaaagtcaaagacttccttgatactatgaaacatagctatatgttgggttttggaaatacatcaagatgctaagctagaagtgatatttttcctcctctctctctctctttttttttttgagatggaattttgctcttggtgcccaggctggagtgcaatggcgcgatcttggctcactgcaaactctgcctcctgggttcaagcgattctcctgccccagcctccctagtagctgggattacaggcacccgccaccacacccagctaattttttgtatttttagtagagacagggtttcactatgttggccaggctggtctcgaactcctgacctcaggtgatccacccgccttggcctcccaaaatgctgggattacaggagtgagccactgcgcctggcccctcccgtctctttaaaatttttttatactttaaaaacacgaatgggatcatactatggatactattttgccttttcaatttagtgatgcattttggattttgagccagcacataaaatgcttcaccattttatgatgttaccaagaaatatataacttttctattgaaggacatgtaggtattttcagtattttgctattatgcctatgtctgcatataaatacaagaaaatgtagcccgagttgccattgtctgatttctaatccaagggaattggacagaaattgggccaagaacattgttggaaccatgctgaagccttctctaccttgggattatttatttacctgagacaatatagccttttaaaaaaaaatttgtttaaggtagttgaactgcaaaattttgttccttaacaattcaagaatcctaacatattgcgaacactctcatttttcagttgtcctagtggaaatgccctagtgtttgtaagtttactgtttatttctgaaaagtagtatttatcatagtaaagaattttccttcttttcctgattttctctaagggattaaagtcaggaataatgaacagtttaatttagatgatcctgtgcattttcttcttttacctattaatgtaattcatctattaatagtttctctgacgttgacagtctttgcgtagagaactcatatgcaaaagagagctctcccagtagtgagacagtgaaatcatgtccatattatgtgtctcatccaaaattctgagctacggtcagaccacctctgaataaataacctctggctagaagaattgccgtatcccaatcagcttaaatctgttttatcctaagccatttatttaatataatctagggcgatgaaattatcctgtcttggccaccagttagcacctacttacagagttgcttgttagtacttccctaaattttattgtagttacattatcagagagagaggtgtaatgattgtgggagaggcagccacatacatatctacaacacagacatactgttttggatatcttgggaacagaacaatacgacataaataagatatgtaaatattggaaaggaagagaccactgtggcaaatgctgtttttattcagtagctattctcccacttgtttcttgcacatataactcaagattttttacaggtattcagggcccgtttgattcagaggaggctggtccctgtgaaccctaagggttaaagaagagtagtttaaaccagctgtgccatttctgtttcccttgctgttatctggcttaataatggcattacctgtttcagtttttgctaattcagtgggtgtaaaatcctcaatgtggtcctaatttgtattcctcttattacaaatgagaggggtacaacatgtcaagtgtttattggatatttcttcttttgcagtgtgctgctaatcttactgttgggttgtgtttttcatcattatgtatgttctttatatattctgattactaacttagtcccatggtgctgctataacaaaatacctaaggccaggtaattttttataaagagcagaaatttatttctcacagttctggaggctgggaagtccaagatgaaggcactagcaggttgtgtagtctggtaagggctgcatcctccagaggtgaatgatgctgtgttctcatatggtggaaggaaggcggaagggccagatagccaaacgctggctgccaggagctgcttttttaagggcctaatcctgttcataagggaggagccctcgtggcctaagcactcaggccccagcctctcaatactactataacattggttgttaagtttcaacacaagaattttggaggggacacattctactaacttgaattcactaactttaaaaaaaaatcagttttgtgagttacagatacaatggtcctacccgaggttttgctttcagtgatttcagttaccagtggtcaaccatggtctgaaaatactaaatggaaaattgttataattaaacaattgctgttttaaggtgcccactgttctgagtggtatgatgaaatcacttgctattctgctccatcctgtccaggatgtgaattattcctttgtccagttacccgtccagtgtaatactactggcccattactgtgtagaaaaaaaaaatgtgtatatagggttcagtagtatatgttttgggcatccactggtggtcctggagaaggtcacataccttctccctagtttctcctttgttgaagttaataattttactttttttggtgtcttgtgaaaaacagatagtcttaatgtagtaagatcttttatggtttatatgggcattcatgtatttatttatatttacttttgtttaagaagtcatctcttcaaacttgggtaattaaaatagtttcctgctttaaagctttgtctttcatctcagtccactggggttgctttttttcttttttccccaccagtagtggaacagggattgatacttactttttgccatatggatagttgtcacaacctcattttttagagtccatcttttctgcagtgatgtgcagaacgaactctcatagtcaagtttccatatacatgtgagtctgtttctggactcaattctgttttgcagcctaattgtctatcttcaccgtcataccacacttccttaattattacagctttatacaagtctcactgtctggcagggcaaatacccctaccctgtatttcagaagttgtttggctgtttgcatgtctaaatgatttaaaaatttggtggtaaggtgtttgaggtaccctgttgggggagagttgacatctttatgatattgagcatctttatgatatagacatagtagagttacatgtcacttaacaacaggggtacattctgagagatgctttgttaggcaatttcttcactatgtgaacatggcagggtgtacataggctatacggtgtagcctgttgctcctaggccacaaatctgtacagcatgttactgttctgaatatcataggcaattgtaacacaatggtatttgcatatctaaacatacaaaaggtacagtaaaaatatgatggataaaaaatgtagagcacttaccatgaatagaacttgcaggactagaaatttctctgggtgatgcagtgagtgagtggtgagcgaatgtgaaggcctagaacattactgtacactaccatagattttataaacactgtacaattaggctatgttaaatttatttcaaaaaataaagtatgatatcatgatggtttatgatgtcacaagatgataggaattttccagctctattataatcttatgagaccaccgttatatatggtttgttgttgactgaaacattacgtggcccccaaaatgtaataattttctccacataggtctgagacatctttggttaaacattttattttatttgagatgaagttttgctcttgtcctctaggctggagtgcagtggtgtggtcttggctcactataacctttgcctcctgggttcaagtgattctcctgcttcagcctccctcgtagctgggattacaggggcccgcaaccacgcccagctaatttttatatttttagtagagacagggtttcactatgttggccaggctggtttctaacttctgacctcaggtgatccacccgcctcggcctcccaaagtgctaggattacagtcatgagccaatgcacccggccctggttagatttttaaaatgtatcttataataaacttttttgtttaaaattacattttcagctgctttggctggtatgtggaaatgaaacagatttttttggtccaccttgctaagttttaatgttcacaatactaatgttttgagtttctgtatagacagtactatcacctgcaaataatgagactgtggtttctttccaatccttatgttgttgatttctttttcttttcttagtatgctggccagggtcctttggtaactgttaaaaagtggtagtgatagcacggtggctcacgcctgtaatcccagcactttgggaggccgaggcgggcggatcacgaggtcaggagatcgagaccatcctgtaaatggtgaaaccccatctctactaaaaatacaaaagattagctgggtgtggtggcaggtgcctgtagtcccagcagctacttggcaggctgaggcgggagaatggcgtgaacccaggaggcagagcttacagtgagccgagattgtgccactgcactccagcctgggcgacagagcgagactccgtctcaaaaaaaaaaaaaaaaaaagtggtagtgataacgggattctgattgtttctagctttagaggaaatgcttgatgtgtttcaacatgaagaatggtggtgttagttttgggtagataacctttgtcaggtaaagcttttctttttattgttatttttaacaaatgggtactgatttctacatttgttgacatagttttcttctttctatctggtgatgtggtgaataataaatttttctgataataaaccaaccttgcattattagagtaaaccaagcttggttgggatatagctacactggccaacatagtaaccactagccacatttcaagtgctaattgtggttatggctataatggaaaaacagaaattacagaacatttccattattgtggaaaattctgttagtgctgtggtagagttgtctttttaaatacattgctgaagttatctggctaatctgtgtatgtatgtttatgagttttcatgtcaaacttatacttgtttcattgaaagagatggaatggctgggtgcggtggctcacgcctgtaatcccagcactctgggaggccaaggcagacagatcacttgagctcaggagtttgagagcagcctgggcaatatggcaaaattttgtccctacaaaaaataaaaaaattggctgggcgtggtggtgtgttcctgtagcaatctcagctactctggaggctgaggtgggatgattgcttgagcctgggaggcagaggttgcagtgagccagtattttgccactgcgctccagcctgggtgacagagcaagaccctgtctcaaaaaaaagaggagaaggtggaaagtattctctttgtttctgtgttctggaatcgtttgtgtaagatggagacagttcttccaaaatttggaacagctcatcaagcctgatgtttctttttgggaagattttaacttagtttctttaatgattactgctctattcaggttttacatttcttcttgaataattttttgttaattacatttttttttctaggaaataacatctaaaatagcacatttattggcataaagcaggactcagcaaactatggcctgtcacaggctgcctgcctctttttctaaataaaatcttgctggaatatagccacacctaatcatattgtctggttgctttagtgctataaatgcagagatgagtagttatgacagaaggtatgagccccaagccaaaaacatttactgtctggtcttttaagaaaaagtttgccagtctctggtttgaactattctttatctatcattctttcaatatttcttttaatctctgtatttaacatctcattttttttccctaatgttaatctctttttttctattcttgatcagcgtcaccagagacctgctaattttgggctatttagatgcattctcttatttaattaactaatttccactcttttttatcttctttctctgttctttgatttcattctcattttattcttcatttcttttcctggcttaagtttgatgcttagcttatttgtattaaactttcttcttttcagtataaacatttaaggctataaatttccctttctataccacttttcctaattcctacaagttttatatgtattattttctttactattcaattataattatttgagtgtttttacatttcctaacatatggaaatgactttctttttttttactgacttgattacattttagtcaggaatatgtggtgggtgagatttggattatttttaatttgttgagacatgggttaagtaccagattgtcattagtttttgtaaatgttatatgtgtgcttgaaaagactgtgtaagggtacaaagctctataaatgaccaacaaaacgtacttgttaattaccttgtttaagtcttcttatgtctttactagtttttctagtatataatctatcagtagtggaaaagatgtgttaaaacttgtactgtgccggtggacacgttggtttgtccctccgggtctatcagtttttattattttcatattgtttaatagctgatataaattaatttttttctgataatttgaatcttttaatcattttgtgatggcttctgtatgtgttaaaattctttgtttttaaaaatttgtttggtctgatgagaatgtaggtgcctgttacaacccattgaggttcttgcctgctgcacagaaaaaaccaatatgctgaggcaacaggtattgcagcagagaaagagtttagtcgcagggcagctgagtcaggggaatgggagatagttcttaaatctgccttgccaagaatttggagactagggtttttaagggtggtttggcaggcaggcaggggtctagggaacgagttctgctgattggtttggttggaaatgaaatcacagggatgtcaactgttttcgtgtgctgaatcagttcctgggtgagggttacaggaccagtttagtcattttcttggtatgggtcaccagccctgtgtggcatcagttggtagaacagaattcaaagtctgaaaaatatctcaaacactagttttaggtttcatagtagtgatgttatctataagagcaattggagaagttacacatcttgtgaccactggctacatgattcctgatcagcaagtaattataaaaaagggggctaggggacaatgactggttactgtttatccttatatcttagtagaattgaggcccctaccataattctaagcttgtggccttgtgttcgttatacaaagtcggttttagtccctcaacaaggaggggtggattagtcttgggaagggactattatcctccttgctttaaactataaacatagtaacatcgttagtctgacctatgtataggaataagcaaaggcaattagcttgtgaggttagaagcaagatggagtcagttatgttagatttctctcactgttataatttcgcaaggcaggtttcatacccacctttctgattgttataaatttcattttctttttgccctatttttcccttttctttgcttgcatttttttttttagttttaaaaaaagtttagttactttcatttttccacaatccatttcttttttctttctgttagggaaattacagtttataatctattccttttttttgctttgttgttgttgagacagagtctggctctctcgccaggctggagtgcagtggcgtgatcttggctcactgcaacctccacctcctgggttcaagtgattttcctgccttagcctcctgagtagctgggaagacaggcgtgtgccaccacgcccagctaatttttgtatttttagtagagatggggtttcaccatgttggccaagctattccttttttttaaaaaaaaaaattgttacacttgaaattttgccttgtatacttaattccttagctctttgcaaaattgacacaaaggcccttttaccaatctggtcaacactccccttccaacttccatgttgatgttgcctagcattttattctcccttttatcccccaaattatacatgctattatgtatttatattttgctttcatgtttagagtttctttttctttattttcttttactaagatatcagagttgtctttttgtcctctagcatctcctaatttcatttaaaatttttcatctgtttgtctcttggccctgcattttgggtagtttcttcagttactggtttttgtaaaactagtcgtgtttaatctgcttgacctgtccattgaggttttgaaatcaacagttacttttcattaaagtatttattactgttcagtctcttgttattttcagcagcctcttgttgcttgctgattttgtgatttcatttttaaaagtttaaacattcatattttgtattttggcaatgaggttataatatctgaattcattggggcgtgaatcactcttggtgtttggttttcttatgtgtttgttggtccttgggaaggactcatgttttgttgagcttggtatgtggaaaatttgggtgcctaaactgaggaattttttaactccacagaagatttcagtttgcttctactgagaaattgcttctactgagaaataggatttgtcatctacctgggaactttctagagtccaagctcaattggcaaaagggcaaatgctaatatgcacatttgcccttttgcatctccaagtgcatactacttactgttcaggtttcaatttaccctttttttgtgcagataagagacagatggtgagtgtggaaatgaaggttgggtgtcggtaggttctggtagattttccttacttttttgagctcagcaatgtgataacagttttctgctggatttattgggcctttcaggatatacagtattaatatatatattactggaaaaagatgttcagtttttaagcttttccttttcattcattcgctcattcatttattcattcattttgagacaagatctcactctgtagcccaggctggagtacagtgacgtgatcacagctcactgcagccttgaccatctgggctcaagcgatcctcccacctgagccttctgagtagctgggactaaagggtgtgaggtggcaagatcataactctctgcagccttgaactcctgggctcaaatgatcctcctgtctcagcgtcctgagtagttgggactacaggtatgctccaccatgcctggctaacctattttagttttacatatacaaatctctgcacatttcattgtgacagcactaaaaattaaaaaaaaaattcttttgtgtttttctgtattaatgtttaattttacataacctgttgtgattctcagtttgtgcacctcttttggactatttgagtctcctgatgtacttgatttatcctgatggggttttgtgtataagtggaatttcattttattttaattaatttcaggtattttgagaagtcattgaaataatttcttaggctagagtttgtaaatcaggttttaattaaagtagaaaacctcagaatgaagtacacacaagaagcatattgtttaatgagacatttttttttcctgagcatatttatatactgggttgtgttgcaataaaaaaaaaaaagtttgaaatgcattgtcctaggttttagtctgtgaagcagctgagaccagtattctttttttttttttttttgagacagggtctcgctttgttgcccaggctggattgcagtggggaagatcttggctcactgtagcctttgcctcctggattcaagcgattcttgtgcctcagcctccagagtagctgggatcacaggcacgcactaccaacgcctggctaatttttgtgtttttagtaggtatggggttttgccatgttggccagtctggtcttgaactcctgaccccgagtgatctatctgcctcggcctcccaaagtgctgggattacaggcgtggtccactgcacccagccccagaccagtattcaagtgagatgctttgtaaagctgagctgctctaattgaaggtctggggcaccataatcccttccctactgagttgttgaagtgctagaggcccctgtgaatgcagttacaggtatggagggagataagccagaccgtggtcctatgttcctcctcaactacaaacagaactttgctttttctgtattttgtaactagaatttaggggagatttggcttgaaaagagggctcatctgctaaagtgtattggaaaaccattgttagataatcaaggttttaaggctgaattcgaccttgtctttaaataaaccattaaataggcaacatttgggaattttttcttctttaattattgtagtcagtctttagttttgcctcctgcttttctagaacaaaatgtgatcatgagcctcctgtcaccatcctactcatttttgacatgttttcagtcttgctgttttttttttattttctttgccttgtctgcagtgaagaaagagtaaagatgttgtacaattgtgcaacttacatctattggaatctcttataaatgtacagtgagacattcccaaatgttctgttcatggtgtccttagtgtctcatcattttttcatggagccaaaatagaatacataacagttctgttttagttagatacaagtagcctaataagtatttatggttcaagaattatatgttcaatcaaataaaaacattccctttttatgcttaaatagtgacatatgcttactgatctgatgtgtgtgcctgttgggcatatgcaaagttcttaagtcttggaatcagattgaacactgccacctttgtttcctgttttccactgatttctatctagcacttttttttatcacatcagctgtcccaaaacctagcttctcaaagataatattaccttcaaaaagaaggtagaacaatgatctcatgttcaagtggaactaccttgagctgataagcttacctggtgtctgacagatcttgagaatagctgtattttccttgagaacttaaaatatccctcagtgcctgtgaatttgctgtgatatctaggggactctgagatgtcttgttttacagtttgataactgcaggtgcagtgctttacagtctgtacagtaattaagcagatggatgctatctacattttatggaagagaaaatggagtcaactttgtagaattagctatagatatttgtacaaagctgctctgttgagttatttgcatctcacaagacagtatatactttataatttatttctgaatggtactttaaaaatatgtagttcatttcctgggttttttttactcttttttaggaagaaagtttttaaatttttttatgtttgcaagggggttgaaaagaaatatcttttttctagcagaaccattttctttattgcagttctttccattgtgatttgttttcctgggaaaatgaaggaaaaaagagaaaaattaatttgcaaattagtaattgcattaatgaatctgtaaagaacagattatataatattgttggagtgataagtattaaggattgccaaaaactgcaagtacatgatatagtaagataatagaattgagagttttagatctggaaggtgggatgaggatagagatgagagttgggtcatctaattgatttcttgcataccgtttgagatcttacactgggaggtggaggagaaagtaagaagggagagaaagagaagttagtggggagaaggaggaggaaagagggtgatactgtatgattgtattcttgttaaaagcagaagcacttttgacatttcagaatatttactctcttggctcctgccagagtatataatctagaatagatctgttgcccaatctttatttaaagttcagttttaagggaaaaaaatgttaatagagaacagccttgaaggataggcaatccataatacctatagattattagttttctttctttaaggattgcttttaaaaaatactttattacaaatactttgaaataacatatctacaagagatgtatcctttcttccatcccaagctcaaatcatttctatattccatttttacgtatttgcaataataatacaaataattttgggctaggtgtggtgactcacgcctgtaatcttagcactttgggaggctatggtgggtggatcacttgaggtcaggagttcgagaccaccctggccaaggtgaaaccccgtctctacaaaaaatacaagccggatgtggtggcaggtgcctgtaatcccagctacttgggagactgaggaaggagaattgcttgaacctgggaggtggaggttggagtgagccgagatcgtgccactgcactccagtctgggcgacacagagagactcccatctcagggaaaaaaaaaaaaaaattatgctctatacttcccattaatttaattatgtagatttttttttggtgttttttattgcccaataggtacttttttggtgtatgttatatttggtgtttattttaccaaatatactattaaacccacacgtgtgcacacacatacacacttgagtataatgcctttcccactcgttagtacattaatattattggctaacactgttatatttttttctttgtaatgactgcataatattccatggtaaagatttaccacacttcatgtagctgttgttcccttttcgatgtcagatttttttttccacttgttttaaacagtgctaagataaatattctagtacatttatattgacatttttattcctgtgagaattggaagagaagtattgctgggttgaagggaatgtgtcattaaaatttaataggtattaacacaaatcttttcagaaaggctgtaataattcacatttccagtaacatctgacagatcaccggttttcaaatttttctctgtgaactttcttgacaagagaagttgggggtattggaatacccatcactcaattcagccagagcagctctcttttaacctatttgatatattgcacattgttataatgttttggttagaagagtttgtttcatgattaaaataagtttgaagaatcattgctccgagttgttcgattttttttttttaaccttttcttttttttctaggtcaaaccagacattgagatcactggctttttggataccttgtgttggctgcatttcttgtatatttggataccgagtgttggctacattggataccttgtgttggctacaattcttgtagaatgttttctactgaatcatactttaagtactttgaattgtactttggcttgcattgagggataaaaaggggtggttaaaactcacttctgtgtttatccttgttggagttatccattacattactcactgacccattaggtttcagcgaggatgcagatgtcacataaagcttcacttctcctcaatagctcttagacaatgtttatcttatggttgatatttcttattcatcttatgccctttgatttattggttttgtaccttgcttacagggcttttatagtttatttttgaaataaaccaagaagttgagtgtgcctctgtggccatttccagccatataaccatgtaagcaggtatgatgtagttctaattctgccatttgggaactttctgatcttgggcaaaatcagcgaatttctcttgtcccagttttcttcatttgttaaaaaatatggatgataataaaatcagagttgatgattttccaaaaacatctttcagcaaattcagtgactagtttataggcttttaatgggttacttaatgaaagccaaaaagaaaagaaagaagatacccaattgcattcaactaactgaaagtgaatgtaggggccaagacaagtatagctcaaatttggagtttccaggtattgttcttcacatccttgagatattagaagcagtgttccttaactttcttttttgacgatagatgttagagaatacaccacaagctctgctccatctccccagaagaatgtacattatcacatgcatgcaaactctgtatactcttttagatgactatagatggttcatagacctcctgaagaccatttatgggtttcctatgtggaatctgagtgtaagaacagacctagagcagtagttctcagtgtggggtgattttgccctgcaggggacacttggcaatgtctggagacatttttggttgtcacaactggggatggtgatggtgtgcatgccctcctcatatctagtgagtagagcccagggatgctgctgaacattgtacaatgcacaggtgcaccctgacctccacttgcaataaagaatttttggcaaaaaacgtgagagtgctgaggttgagaagccctgatgtagaggaagtgatgaatgggatttctttaaaaaatccttcagaaatataattgttctctggtcttttttgatagtagttgggtagtagatagtgcaaggttaaaatctctgagcctcactctgtcttgagtattcttccctcaggtatttgcatggtttatcatcattctttttcaggtttccactcaaatgtcaccttgtcatagagtcctttccagtctttgcaagctaaaacagttctcttccttactttttttttttttttcagacggagtctcacttctgtccaggctggagtgcagtggcgccatctcggcttactgtaacctccgcctcctggattcaagtcattctcctgcctcagcctcccgagtagctgagattacaggcatgcaccaccatggccggataatttttgtattttttctttttttggtggagacagggtttcaccatgttggccaggctggtctcgaactcctgtctcaagtgatccacctgccttggccttccaaagtgttgggattacaggcatgagccaccacacctggccatctctattgattctttttttctttctttttttttttttttgagatggggtctcactctgttgcttgggctggggtgcagtggtgggatcgtggctcactgtagcctcgacatccctaggcttaggtgatcctctcacctcagcctcccagttagttgggactaatttttttgtattttttgtagtggtggcgtttcaccatgttgcccaggctggtctcaaactcctgggctcaagcagtccacctgccttgacctcccaaagtgttaggattacaggcgtgagccgtggcgctcggcccctatttttcttaacatttcacattatctaacacatacattgacatttgttgtctgttttccttcaactttaatataagctatgccacgagaacaataatctttggctttctcctacagttatattccccagtcaacagtacctgggatataataggtgctcaataaatatttgttgttgaaagaatgaatgatctgagtctgtattgtggcaagtttgattgtattgttttggcagagcccaatgttttagagatcaaaggtgcagtaaagttgacagttttttgtgaaaattaggagttcttacctaagttgtcagttggatatagtataggccaggaatatgtatctgaaggcaaagccaggatttaagggaaaaaaaagttctttggcttctttacaacatgaattgagcacctgaagttgtgttctaaactgttttctaaacttgtctgaccataggaattgtctgagacattccttaaaaacggcagaatctgaagcttctccccacacctcctgaatcaaaatttctagaggaggaaccaggatatccttattaaaaacaaagagggaaagaatatcttcaacagatgacactgggacaactggatttccacatgcaaaagaattaagttggacctctccttcacatagtagataaaaatgagctcaaaatgatcaatgatgtaaatgtaagatttaagcctgtatacttttagaagaaaatatgggagtagaattttatgaacctgaatttattagcacaaacaataaaaaatatatattggactttataaaaattaaaaacttttctgcatcaaaggacataagaaaatgaaaacacaacctacagaagaaaatatttgcaagtcatatctttaacaaggatttaatgtccagaatatataaagaactacaggtcaatgacaaaaagacaacctaatttaaaagtgagcaatgatcttgaatagacatttttccaaagatacacaaatagacctgtaagcacataagatactcaacaccattaatcattaggaaaatgaaaatcaaaaacataatgaggttacactgcatacctactaggatggctataaaaaaacaaaaccagaaaataactgttgaagaggatgtggaaaaattggagccctcatttgctgatgtagctagctgctgctgtgagaaacagtttggtggttcttcaaaaagctaatcataaagttaccataaacttagcaattccactgctagctgtgtgctgaaaagatttgtacagggactgaaatgggtatttgtacagcagtgtttattgcagcactgttcacagtagccaagaatggaaaccaagtgtccactagcagaagaatggataaacaaaatgtggtatatacatataatattcagtcatacaaataattgaagctctgggccaggcgtggtggctcacatctgcaatcccagcactttgggaggctgaggcaggcggatcttgaggtcaggagatcgagaccatcctgcccaacatggtgaaaccccgtctctactaaaatacaaaaattagccaggcgtggtggcgcgcgcctgtggtcccagctactcaaaagaatttaagctctgataagtgctgtaacaggatgaacctgaaaatacactcagtgaaatttgacagaaaaggacaaatactgtgattctacttacatgaggcacttaaggataggcaaatttatagagacagacagtagaagttaccaggggctggggaaaacagggcatgggatgttactgcttaatggttacaagtttctttctgttttgggtgatgaaaaagttttggaaatggtagtggttgcacaatattgtaaatataattaataatgtcacttaattgtacatttataaatggtagattctatgttacatatattttacataaaaaaagtattagatctaaaactattgaattgtacactctaaaagatgaattatttgatatgtgaattctgtcttaataaaactatttaagaaaacaaaaacaaaaccagctatccgtgtttggacaacactgtcacaaaacaaagttgttgattttagccaggaagcatataaggtagatgtaatcagtgagactagattcagattagatttagtaatattaatccgtatacagtccctcaaaactaatgtctttcaggaatatatcaagtgtttatgtactataatgattttgttaagttttccccattatagggaaatttattgagaaacttatcaaattaaactttttggtggacttgacatcctaatttttcttataacccctcccccagtttactcattattaatattttatttacaaggtacataactttgtaagcagatttgttgaatatttgtttatctttatggatactgtgttacttttaatgaggtagaattaatagttgtactctcatttgtcctgtatacagtatggtacattgggtccttacatatcaatatgggtggtacttttatgcccattttattgtcatcttaaagagctacattgtaatgttatgcaatgcctcctggattttacttctgtctcaatctcttttctcctactaaactatacttctctcctgttttctgttatatcctctcttcaaatactcttatgttatcttccagttgttcagagcttcctgttactgcttcagtgagcctcttgcagtccctcatagattcctgcagtcttcctgtgttctagctggtatgtctttgtctttggaaattctctaaaatacaaatctcatttctctttaaatttcttagaaaagaaagaaaaaaaatgacaactgccttatgtgataatgaccagactccttatcagagacttaaagccttagattaactggtcccaatttcttttataacaccttcaccaatatgtgcacatgtatatgtacatgcacagaatctagttgattcacttttgtttcagtacttttttcctttttattccaattagtatcattttgtttatccattcaccagttaatagacatttggattgtttgttgtttttgggcattatgaataatactgccatgaatattctggtaaaagtctttgtgtggatataggttttctcttggatggacacctagaaggggaattgctaggtcatattgtaagtttacatttaacttttttttttttttttgagaacagtgtcttactctgtcacccaggctagagtgcagtggtgcgatctcagcttactgcaacctccacctccagggttcaagcgattctcctgcctcagcctcccgagtagcggggattacagcgcctgccactgcgcctggctagtttttgtatttttagtagagatggagtttcactatcttggtcagactggtctctaactcctgaccttgtgatccacccgcctcggcctcccagagtgctgggattacaggcatgagccaccgtgcccagccaacatttaaccttttaagatactgtgaaacgtttttcaaaaatggctgcagcattttacattcccataaaatatgagggttccagtttcttcacaacctcagcaatatttcttactgcctctttttttttttttttttttttaaagaggcagggccttactcttgtcacctaggctggagtgcagtaacttgatgatagccttgaactcctgggctcaagccatcctcctgcctcagcctcctgagaagctaggactacaggcatgcaccaccatgtccagccaattacgttttttttttttttgtggagatgggggggtctcactgtattgcccaggctggtctagaattcctgccctcaagtgaccctcctgccttggcctcccaaagtgctgggattacaggtgtgagccactatgcctggcctgtcttttttttttttttttttttaaagacggagtcttgctctggtgccaggctggagtgcagtggcatgatcttggctcactacaacctccgcctcccgggttcaagtgattctcctgcctcagcctccgaggtagctgggattacaggtgcgtaccaccacgcccagctaatttttgtatttttagtagagatggggtttcaccatgttggccaggatggtcttgatctcttgacctcatgatctggccgcctcaacctcccaaagtgctgggattacaggcgtgagccactgtgcctggcctggcctttttgattagtgccattgtagtcgcctaattaagctaaaatatctttgtgccttgagtttctggttgggcaacgtttttgtttctgttcagtttgctccgattttttagtattctgattttttttttttttttttttgaggcagagtcttgctctgtcgcccaggctggaagtgcagtggtgctatctcggctcactgcaagctccacctcctcggttcacgccattctcctgcctcagcctcccgagtagctgggactacaagtgcccgccaccacgcctggctaatttttttgtatttttagtagagacggggtttcaccgtgttagccatgatggtctcgatctcctgaccttgtgatctgcctccctcggcctcccaaagtgctgggattacaggcgtgagccaccgctcccggcctagtattctgattcttaatttccaattcagcattccctaaagagcctgaagtaaaaacgagaaaacttgacctcttgtcattgctctgccacttactacagggtgactgtatgcgagttcgtcagctttctgaacttcattttcttcatctgtaacatagggatgattcctacttttatagaattttgaaggaaaatgtgtgcatgaaagagctttgaaaaccatgatctgtttttaaaaaattaaagctgtcatgcttacgtatatgaagtatcagaaatgcttacagagatagtaggcagaattagcactatattgtagtgttaaggcatttgttactaaacttggcatgtaaatttcctcatggagcttttttcatatggaagtgtttgggtctgattattagaggattcagcagtgcaccagagatggaaaaccattaggttaagggcataggctttggaatcagatatggctcaatttaagttcagttgttgataactttagcatagttatttaacctctttgaacctcagtttccttgtttataaatgggcataattatatagttcatcttagtaagaacatttattcagcttttgctttttaacctgcattgtgttatgcattaggtatgtagcagtgaacaaattaggatccctaaacttttctcatatagtttacagttcagaaggggaaacacattagagaatttgtatttacatttatgataaattctttgaagcaaaagtgcaggggtggtgtgagagcatgcagtcaagattttatttagactgagtagatttgggacagcttccctgattgacaggtgagacttgaaagagcagtgttagccaggcatgagggctagagaagagaaaaagtttattgaagcagaaggaatagcacaccctgagacagaaggatcttggtttagtgtcttcaaggaatagagatgtgactggagtgtaatgagcaaatggtcagattagtatatttggaacttattcgaagggcagtgagaacctatttaagaattctaagtaaggcagtgatatgaagagattagcttattaagatcattctggttgctctctgaagaatgagttggatgtggtgtagatttatgttgtggtgaagtaatggctaatgatttcatttacattttgaagtaatgtaaatgatttcatttacattttgcaaggtagcatttataggatttgattgttgattgtaaatattgaaagggaattgccaagcttcattcccagaaaactgtgaggaagaaatgggtacatgaaggcaacacacactgaagagggagaggaatgaagaatgaggatttttttggagggagaaaaaaattgggagacattttgtttagttttgagtatcttgagttcgcggtatctttgagaatacccaagtggaaatgttaagtagacaattgtatgtgcggactggagttgaaaagagagatctttatggagtatgtattaaaagaaagcttagggcaaaagccttgggagaagaacataaacagtaaaaagagaattgaactctgatgagttaactgatatttggaggttgagtagaagagaaatcaaaggagacaggaatgaccagtaaggtaggaaaaaatcaggaaaaggcaatgtgttactagaagaaacaaaaggaaaataatgtttcaaggaggaggctgcggtcaactgtgtatcatactgctgagatgaataaaataaggattagaaaagtgttcacttgatttggcaacatagaggtcaactgatgacttttagttagcttttactgcataacaaatcacccgaagactgacttactgaaaacaactgttcccaattgtgtatattggcaatttgggtttggcttatctgggtggttctactgatctggaccaggcttagctgattttagctggggttgcttatgcatctacagatatgcctctgtggtcacctggtgatttggttagggctggcttgttcatgatgaccatggctgggacaatgtgcctctgtgcatatacattctaattttccactgggatagcttggacttgccgacatctccatagcagaattccaagagcagtaggtaagctaacccagagcacaaacacttactaaacttctcaatgtcccattgcctaaaagagtcataacgccatctcagattctaggtctgaaaaaacacttttatttcttgatgggaggagcagcaaagtcacattgtaagggtgtagatacaaggaatggaaaaatttgttgtcattttttgcaatctgctagtgactgtggcaaaagcattttgctgatgaggtggagtgtgcgggtggggaactctttggaagccaggttggattaatatgaatagtgaatgggaattgaaagtagatagtatagattactctttgagaagcttgtctgtgaaggtaatttgggagagaggacaatacctgaggcaggggaggtatttgtagtctaaacaggtatgttgtattttctttcccttcctgcctgaatgccttccatccatccaataacagaatatatttgcatgctgagagaaagtatctagtagacacagaggatgctgatacgggggaaagaggagataactaatcaagtaaaagtctttgagtagaggatgggattttgtgtgcttatgaaggggttagtgttttgatgtgaggagggctatttcctttctggtattagggaagagggagggaaggaaggaatggggaaggagggaagggagggaatgggtgcaaatgtacataggcatgtaaattgggtaataagaggctgagggtttccgtttgatggcgcttctgttttctcaatgaagcaacagcagtctacatgggggcgtggggcgggggcggcgttgtacaagaatgtgtgttggagatttgacgtgaatagaaaaattcgtaattttatccacccccccaccccccacaatgggatatcgagttgactactgagcagagaaatactaatcactcaataaatgagagatattatcactattaatatacaagaattactttaaagagatttaacagaacactttctgtgcggttagaaactgatgcaggtcgagatattccagggcctggggctccttttctgtttgagccagttaaactttagtatcttccataacattgatggtccttaaaaaatgatgtaggcaagtgaccatgtttgcccttttacaaataaacattaacaaaaatatgtattcaaagaaagggtccagtttctaaaagaacttcctaaagtattcaccgtcactgttttaccagaacaaataaggaataacataaatacactgattttgaattaataaagattaattcaaactgcatggtagattagtcaaaaaattgtatgttgaaaaaggcagatttttgtttaaacagttggaaaatatgtaaacagggctttcaagttgtatgcttaggggagaatagcataatttacttagcattttttctcgtaggaaaaactcccattagatttttggttgtccctcaacaagaataagctaaacttcttacactgtttaattattgtgtactgaagagttgtctttatggagggcaccatctgctggttgcaagaggtagcagttgtggcgaagactgccttctgtagttatatcagactctttacaaaatcttatgttttcctttgaattccacctcaaacctggagtgaaatcccagaaggaaaaacagctttaaattaacatggcccagtatggattctagtagtggtttgatttgatttctgtgactgtgaatttttaagaaaaatcaacatgaaactggcagatgccggtctttatttgttgatttggatgcctaaatcaactaaaaaataggattgcttattgttatgattgctcttgctctttagtcagtactttgttttccttttctattcagtgaaaatatcttacatattttttactacagtctcttgtttagttacatctatgaacatttatttatgtctgataatattaaagaatgaccatttcattgatttttcttgtactcagtgtgattaaaagattctcatatatttaattaatgatcattttatttgaactttaaaaaaaaactttagtattagaatattttcttttcttttttctttttgagatgaaatctcgctgtctcacccatgctggagtgcaacggcacgatctcagctcactgcaacctccacctcccaggttcaagtgattctctggcctcagcctcctgagtagttgagactacaggcatgcgccaccatgcccagctaatatttgtatatttagtagagacggggtttcgccatgttgtcctggctggtctcaaactcctgacctcaggtgatctgcccactttgggctcccaaagtgctgagattacaggcgtgagccactgtgcatggcctagtattagaatattttcttatgcttactgttcatgctgaacataaaaatgtaaatataataatatgcatatgataatttttgaactgaattgttttctgaaaatgcttgtttcaaataaccctttgaaagaagggaaattctaggttatagttttactattaattggtggtaaatttaaagtttatattttttaaatggagaaactcataaatcagcacattgttggccaggtgtggtggctcacgcctgtaatcccagcactttgggaggccgaggcaggcagatcatgaggtcaggagatcgagaccatcctgggtaacacagtgaaaccccatctctactaaaaaaaatacaaaaaattagccaggcgtggtggcgagctcctgtagtcccagctactcgggaggctgaggcaggagaatggcgtgaacccgggaggcggagcttgcagtgagccgagatcacgccactgtactccagcctgggtgacagagtgagactccgtctcaaaaaaaaaaaaaaaaaatcacatttttctgtaatatactatagtttataaaatagagtctgatataggccagttttatatgactattttctaagtgcagttatttttcattttttgtttgctctaccttaatagtgaatggttgagattccccaaagatgaaaggaactattatatgtcaaatcatttatttgacattctgtttaaggagcagctctgtatcaatacctgtttttcattgacttaatgataccctcttcttctgtgttgctccttttctgcttcctcttttttcttttcacctttttcttatctcgtaatttggtattcattcccatcattttctggacacttttttctcaaatatcctgtcaagttcaagggagtatttgctgaagtcattttgtatgttttcactgagggtgatcatcactatatgtcacccctccattttcaaacatttttgcctaggtttttgtaatatcactatatatcgtcccttcatcttcaaacattttttccgtagatttttgtaacaattactctcatttttctaaagccattttcttgactttcttctgttttccttctttatctcccctgtgggctcccaccaccccaatcactataggtatttcattaaggtttagtgttggtatctcagctcaccctactcattttctttactcatcttgtaaacccataaagcatgaacaataaattgttctaaaaatattttctcattttacactttttttctagaactttagatgtataatctacagttgccttctagagcaaactttatttttcccaagacttaatctctctctctgggttttcccccatctccattacaacgagggcagagctctttcttgtacatttgctcatcattgtattcctagtacttagtgtattgcaccaagcaaattctcaataaatatttaaataaatggccttctaggaacaaaggtttcgaatcttataatcatgttctgcttctctggtataatcattcgtaagtcgttgaatcagttttcttgttttgtagtcattgcctacagtcagttcctcattacttctttcttggaattttgcagtagttttctaacttgttttaatttctcctgtgtctagctctactttttgctgtaaccataatttcttcgaatagttctggtcgttcattcattcattatttcctgagtgcctactactgatagtagctatttgcgatagatgctagcagatagatgctagcataaatgttatatgctacttttcttaaggagcttacagtctagtgggagagacaaagatagaaataagtacaatagatacaatgtgataattgctaattgtagtaggttcaaagtgtgactagctgtaggggaggagcctagctctgcctggttgaggtcagaaaaagttaaaatgagactttaaggtctatagagtttgcttagtagacaagggccagtatgttttactcataggaaaaacaacctgtgtatattcacagaggtgtttcaaacctctccttacaatgctgttcataagactgaagtgcaaattgagtaacctccctctttgttgtctctttattttttccgtcttagctccctttacttccttccaccttttccttcagtcatacttctggtccagtaactgaaatttgctctcttgagatttattcagaatgtttttttctgtctttttattctgtgtattattaccactttacccctgtccacttacaaaagtggtttttctttcagtcttattttttccaagcttgttgtttatttctgttaggataatttcagaatcaactgtgattcacttatttaggggaatgtctgtttctcttcatggattttgagacccattttacgtgttttgctctgtagtttctgctgttgtgttctgcatatgaggtgcttgataaatttttggttacatggatgagtatattttacaaggtcactctgtctacattgtatagctgtggtctgtggccatattcatgtatttgtttttatgaatcatgaacagcttttgtctctgaaataaggcagagagactttcttccactccagactcagtggaagagaagcttatcacatttatcaatccatttatcaatctttccctggagtgctttgtcctaggcattggctgagtatcttctttggttgaaggaatgtaactatgaacttggttcttgctagtgtttttcctaacctgaagtcatgcagctattctcttttatcatattctaaaagcttttaacactttgcctttatatttaagttgttactgtacctcgaattcattttgtatatggtgtgaaatataggtacagtgtcctttttaaaaaacttagatatgaaagtgtcttcagaactttttattgtattctctctgctctttcctgttatcgctaccactttttttcatatacagttgcgtaccacacaacttttctgtcagtgacggactgcatatatgatggtggttccataagcttataatactgtatttgtactgtatcttttctatgtttagatacatttagatacacagatacttaccattgtgttacggttgtgtacagtattcagtacagtaacatactgtacaggtttgtagcctagaagcaataggctataccatatagcctaggtatgtagtagtctgttccatttaggtttgtgtaagtacactgtatgatgtttgcacaacaataaaattccccaacaacgtatttattagaatgtatcccatcattaagtgatgtatgactatgcacaggaggaacacagatttttggatgttaatcttgtatcctggaacgtcgatgaactagtagtttattttttgtagattcctttggcatcttctgtgtagataatcatgttgtctggatgtagggacagtttcttttccaatatgtatgctttttattttctgtttctttgtgtgctgcctagggcttctagcattatattgaataaaagtgctgggagtagacatcatttctttgtttctgatcttaaaggggaagcatttagtcttttaccattaagtatttgtgttacctgttgttacctgttggtgacttatgcttgttatggatgtccctgacttatggtggttcaacttaggacaattttttgactttatgatggtgtgaaggcaatacacatttggtatgtttcttgacatatgatagaaatgcacttttggcttaactatattttaaatttacaatgggtttattgggacgtaaccttattgtaagttgaggaacatctctatattgatgttttttacttttcatccttgctaaactcagtcttaataattcacatgttttatctgtaaatccttttgaagtttttatgtatgtaaacatatcatctgtgaataacgactggttcattttaaatccttataccctttatttctttttctttccctcctttgttgattagcatctttattgcagtgtcaaattaaaaaaaaagtgatgatagtaggtatgttcctgtagttcctgaacacaaagcttttaatggattgtcagtaaacattatttatgctgtagggtgtttatagcatcctacttatctcagataaaggaaactttcacccaattcttagtttactaaacttgtttcttgtttcgtttttgttttacagtcatgagttgttgaatttaccaaatttttcttaatttattgagatttgaaaaaatctgtttagtatataatttaaatatgattttctttttaagcctgttgatgtgatgaatttaaccttgccttcccgggataaacacttatgaatatattgctgcatttggtttcctaatattttgtttaggagttttgcatttatgattaagatttgtctgtgatttattttctctgattgttcttttcttttttcttttcctttttcagatacagactctcactgtgttgcctaggctggagtgcagtggcacaatcatagctcactgcatccttgaactcctggcctcaagtgatcttgtcacctcaacttggctaattttttattcattttaatttttttgtaggggcaagatctcgctttgttgccctggctggtcttgaactcctggctttaagcagtcttactgcctcagccttccaaagtgctgggatcacagacaggagccattgtgcctggcctctgatagttctcattgggttttgttgtcagagttatgctaattagttgcttaaaactagttgggaaggattcccttgtttttcatttcttggaactatttgtatgacatgggaaatatttcttcctttatttgacaggactcactagtaaagccatctagacttggatatttttccttgtggaaagatctgttaatgattgattttgtttcttaatcatttttttctttcttgagttagttttggtaataagatgtagtttctcagctttatctacattttcaaatgttatattatcaaatttataagattgacctgtgatttttgactttgttgatcctacgcttgttttcttttgattcattgattattaagaagtgctttaaaaaatgtaaatgtctggagcttttcttgttatctgttttgttaagctttttgttgaagtataacatacattcaggaaagtgtaaaacttatgtctttagctctatatgacttcacacaaagtgaaaatacttgtgtaactagcatcttagaagtatcttttcacccctttttccgttaacatttgtctcccaaaacatcactgtcctgacttttactgtcatagattaggtttctctgttttcgagcttataaatgtaatcatactcttatgtagtgttttgtgtctggcttctttcactttgatgtgtgtgtgtgggtgtgtgggtgtgtggtgtgtggtgtgtggtgtgtgttgagacaaggtccactctgtcattcaggcttgagtgcagtggtgtgatcatggcttgctgtggctttgacttcctgggcttaagcaggacttccacctcagcttcccgggtagctgggaccacaggtgcacaccactatgcttggctaatttatttttattttttgtagagatgaggtctcactgtattgcccaggctggtcttgaactcctgggctcaagtgatccacctgccttagccttcccagatgctgggattacagatgtgaaccatcatgcccatccagatgtttgtaatgttaatccatattattgtgtgaggcaatgatttattctctcatggctgtgtttttttttttttttttttttttgcccccattgtatgactatactacaaattgctattcattctagtgttgatggtcatttgtgttttctgttttggcaactgaatggtattgctgtgaacatttttttatatgtcttacggtggacaaactatacgtttctattgagtaaataccacagagtgaatctggggcctatttatcttttttttttttaacttgatatttagcttaacgggttttagtgtttgcatgacataattttccatccttttactttcagcatgtatccacttttttcattgtcttttaaggtgtttatgttgaaatttaaaaatcttttcttttaacctgattgtgtatattacatacacatatagtacttagtatgtgctaagcaatgttgtaggtactttatatataaatacttacacctcttagttttcatttggctaatttgcccttattttactctgcacttaaaaattatactccttggttgtaaacttctagatttgcagttatattctttctctgctttgaagataacattttgctgtcttctggcttatgttgttgctgttgagaagtcacctgttagtttaaatgctattcctttcaaggtactgtgtgtgctctaaattttgtttgttttctggaattattattattttaaatttaaccctgtttggcttactgaatttgtaggttggtattttatgatattctctgtaggtatttggcctctgcttcaatctagtccttctggtactctcatgaatcccatgagtgaatctctcattcttctctctctataacttccatgaattgtaggctacatttaggcctttctatccttatgtatttcaggtgtatgtttcactgtgttgcactccggataatttcttatgacctttctttcacttcattctttcttttttgagacaggtggaatgcagtggcgcaatctcagctcactgcaacctctacctcctgggttcaagcagctcccctactgcagcctcccgagtatctgggactacaggggtgtgccaccacacctggctgatttttgtattttttgtagagatgggattttggtatgttgcccaggctgttcttaaactttggagctcaaagtttaagctcaaaaggcctgccttggcctcccaaatgtgctgggattacaggcgtgagcaatcccacctggcctttaatggtttttcgtatctgcgaatacattgacctgttgaattttcaatttcagtaattgtattttttcatttttagaagttctatttaaaaaaaatcttctagtttagtctttataattttttttgtttcctgtagatatttttggaattgtcttttatttctttaagattatagtagttttacagtctttgatagacacaaaaattgtgtctgtttttgttgtgtggtatttctgctggttctccctcatagttgcttggttatttttgacttgatacttgctcattgttctagaaacatcatagtggggattctttgatacttaggatgaaggcacccttctctaggcaggacttggatttacttatgttaggtgcttggggctgttattaaccaggggtctgtgagttcatgttttgagattctctgggccacttaggtcatgtcagccccagcaagtgtgcaggcccatggccaaaactaattacctgttccttccctgtattcatgttgcctttctctgtttagcaccaaggcagccttctcagcggttccctctagggggtggggctggggaaaagaggtgttcatttctagtttaccctctcctttgcaggtatatcttctttgggtagggtggtggcctacattaatgtcaggagagtttcctatttgactgtctgccttgatatgttcagatttacttctgttccccttgccctataagaccatcaaaactgaatcccacatttgtcagaaatgaaaaatgctttcagagtataagtagctataatgtcccagtgttcccacttacttccctggattcctattttctcttaggttttagtttgagtactttgtggtgcttttaaaaagtatttattttttatttttctctagcttactattattattattatttttagttggagggttaggacaaataacaaagcttgccactgaggaaatgaaagtaaaaataagttttgtttttctaaaaataatttggggaaatgttcaatagagtgattttcattaaatggtaaagtaaattactataaattaggaggtagttacaaattttggttggtggggaaggttaccatttatgtttgttaagaatgtttatatctattttttggtttgcatctaatagttttcttgtttcaggggtagaaatatttctgtcatggctcattcaaagactaggaccaatgatggaaaaattacatatccgcctggggtcaaggaaatatcagataaaatatctaaagaggagatggtgagacgattaaaggtgagtaaaattctattcttttttacatctgtgtagggcagaggtcccctgtggaaatcacatggggctataatgtatcttgttggggtaacttaaaaaagcaaagcaaagcagcaaatggcatagaaaagatctaagggagtagagtatataaggtacagtggggattatttggctatgattaaagggacagcaattaggtgaagcttagattttctaggatctcctatacttgggtataaagaacaagtctacaatactcatattccttattgtctatacaaagttgtctcctttcttctatatagtttctaaagacaaccactttaagggagttttaggtctttatactgagtaattaggctgtgtactactttcttgtaagttattttcaaagtaggtcaaagggcttcactttaagcttcttcctctgcttctgacatgtagtaatgaatcaagattgctggtgaacttctatggatgaggctagggcctcttcatatgtgtttgaataatattttcaccttttcctttagggtggtggtgatctctgtaattgttaaaatggataaagaagcatagtgttcaaggagaatgttaagctggtctattagttagtttagatggtctttatttttgagcatttccgatcgaggttgtatctacctagatatttatgttgcttgatatattattatttatctggatgtcagggctgaaaaatgttcccaaattaatcattgaagatccaggggcttaaaaacaaatactcttctttattgctacatggtgtatagaatttttataaagagaaaaagatgctaatactatcataaatttcacataaagtcttaatattgtacatgtatgtgtttatacttaaagtatcagaatgtcagatatcagatgtttattcaaaggaaaatcatctttgagcagattaaatttactaataggtggatattttatctagttgggaactggtgtgtattttattaagaatagtcaagctatgaatcccttctatatatgacatgtttcattttctatgtatttaccttctcttgacctattgcatttttagagaaactaatacatttattaccttatatttgtttatactaagtgagcattcctgttgtttgttgagaaactaatcttgaactcagagcctacacttaaaactgatcagcattagtgtcttttagagatgttattttctcagatttctttcctaatttggaggactcatgagttattaatgagttttataacagcatttgagttgtagacagtagtgaggaattcccattttctggaccttgaacaaactttgtggttattgttggtggaatgattgcctcagtactcatatttaatgtttgtaatatgctttcattattttgtagacatttatgtctagcagtaatccagttatacttttttctcatttattttcctaatttatagttccatttttagcatcctccttcttagaaaaatatgaaaaaattatgtaggatgatatgtacaaatacccatgtaagttttatacattataacaatttgttaacgtgtaaggtgatactgtttataaaattttttttcctgtaacattttattcaaaatatgcttaatctcttatcttttgttaagagagctacagaaataaatagttacatgcatgcagttcttttttaccctttgtggtttttcctaaacatataggcaatcaaagcataaatcttaaaagtaataaaataaaaaagctaaaagacccagacatcatacccttaatctaaatgtagtgccaggttgcaaggattagtctactgttggttctggtatctggcataatagaactgagaggctgctctgtgaggagcagtgttttccacagctgctctgagaattcagtagaaatcgagccatttgttactcagaagtctagctggatggcaagtggaaatcgttgcagcataaaggaccaagacatttaacattgatactttgtggccagccccacttgttgcctagtatttgcagcaccacctagtggatgctggatggtcacctttccattggagttgtatttaaatgtcagttcctgtcaagttaggcaattttgtttcatttaaagtaggaatagtgcagactgagatcatcattgtaattactaatattgaaatcagagaaagctcttctgagaattcatggtataccattctattttctattcaccttttatagaaatatttttgaaaaaagaaccatttcttttagcttcctttgtcttaactcacatgtgcaactgaattaatgaattatccacatcatattctcttttactgccacacaagaaatattttgttggatgccgtggtagatacttcatagtagcttttcagtgttgagggatgcatctttgacatcctttcttaaataaaaccatgtgactggagtggtttaatgacttaaatggaaaattaaattgtcatcttagggttttctttaggcatatactttttcttctcatgaaaggattagaaatattatttttaaaaaagatggtattcttaaggacatactccttttagtccagttgtacaagtgagaccagaagtttccacaaatattctattggaattcttccaataatgactactacataagggcaatttaatctttaaaaatctggttagcagatattttgggtaaatgaaaaaatattttagtaagtcttttaaatagaagtttactttgtagttttaggagaattgtgttctctcaaatagagactttctgcagaaaaatgaaagtatattcatttgaagttaaccttagcaattaacatgacctttatttcacatgactgtagttttacatggagcatttcattatttgattttttatttttgtatagatggttgtgaaaacttttatggatatggaccaggactctgaagaagaaaaggagctttatttaaacctagctttacatcttgcttcagatttttttctcaagcatcctgataaagatgttcgcttactggtagcctgctgccttgctgatattttcaggatttatgctcctgaagctccttacacatcccctgataaactaaaggcaagtactgatttaaataactccaagattgaccgatactttgatttatctttctaactaaaatgggagttaaggtatttagatgatttccttggattctttgacattagctacagtaatcttttgctaaacttaatgttttttttttttttttagaacttatttttgaaaaactttctggtcttgaggttaagaagtagattaatacagtgtgtattttttttatatcatgtcatcattagctctgtttctttcattataattttgggggcaattccttttcacttttgaaaatccatattgaagaccatggccattatttaaaacataatacctagtataaacatgagtttataatatataatcctcatttatttaatggaaggtgtgatataaattgttatatttgtgttataaattgtgttatacattgttatgaagaaaatacaggccaggcgcagtggctcaggcctgtaatcccagcactgtgggaggccgaggcaggatgattacttgagttcatgagtttgaggacagcttgggcaacatagcaaggcgttgtctctactttaaaaaaaaaaaaaaaaaaaaaaaggaaattagccttgtgtggtactgtgcacctgtaatcccataactacttgggaagctgaggtgggaggagtgcttgaacccccggggggcggaggttgcagtgagccaaaatggcaccactgcattccagcctgggctgagtgagaccatctctattaaaaaaaaaaaaaaagattcagtgaacaaaattttaatggaaaggtacaaaagacatgtggtacttggttacagtaattgtaagtaaaactatataaatgcaaaatctttaaaagatgagaaggggaatagcacgagtaatctttttaggaaaatgctggtagaaagcatgaagtaattagagttgtgcaaaagatactgaatgtttataaggcagatcaggtaggaattaaaaacagcaacaataaaagataattgtggagtctgggtgcggtggctcacacctgtgcactttgggaggctgaggtgggccgatcacctgaggtcaggagttcgaaaccagcctggccaacatggtgaaacttcatctctactcaaaatacaaaaattagccggctgtgttggcacatgactgtaaccccagctactgtggaggctgagacaggagaatcacttgaacctgggaggtgggggatggagtgagattgcgccgctgcactccagcctggccaacacagcgagagtctcagaaaacaaaacaaaaaaaagataattgtggaaactatgggttagagaatgagtccatagaaagattattaatccacagtgtgaaaaaatggcaggcaatttatatttatttcacttaataagtcttgctgttacttatgtgtcaggaactggatttacagtggtgaaaaaaacccaggcatggttcttggactcatggagttcttgataactgaagtgaggaatgtgcttatttgatcaagtctaccacaattcaagtagaggatgtgcaacctgttttgggcatgcttgttttaaattttgattggtgaaagaatcttaggatgagggaggtagagggcaatatttgtcatttaaaggtggtattgaattgtaagatttgagaatggtcggagacttaaagtagataacatgagctggtccatgtagttgtatacccaggtactagcttgatttctaaatgtgaatttctcatttggagatacttaattggtttaaggaatgattccatttgtttgatagtggctgtggctctcccgtactagatgtcttgttggcattctcatgacgaggaagtctaacttaagactgctactgtacaatttatttatctctcttggggatctttcagtttgcataatcaaggacctatttcagggctttgggggtaacgagaaattctccctaaagaatagctacatatctgttctgtttctaacaggacaatttatgagaagactgtaaaagagctgaaattagggtctttgtgcattattccctagctgaaaaatgttaagtatttggtttttctgatgaatttttgagtcttattctaaatgcctcttttttctttttgggggatagtacttaaaattactgactttgagggtgctttctaaatatttaagagatttcacttcgtcttgattagcggcaaattcgtatatctgtatgtctatatattttgtctacagtagtgttgtatacagattagaaaattgtgatatttgagccttacctttccactttcagttagttattgtcatcagcaaaccccttttatacagttggcttcatgtttaggcagtaattggtgaggttataagtgactgttgtctttccatcgctacatagggtcaatatggcgtgtgtactctttcagcaatccaggaagggttcattcatagagaacatattttccacagtactactatcaaagtaactttttttgttttaagtaacctttttttttaaaaaattgtgttttaggtgcaggggtacatttgcaggtttgttatgtaggtaaattacatgtcatgagggtttggtgtacagattattttgtcacccaggtaaaagcatggttcccaataggtagttttccgatcctcaccctcctcccaccctccaccgtcaagaagatgctggtgtctgttctcttctttgtgttcatatgtactcaatgtttagctcctggtgataagtgagaacatgtggtatttggttttctcttcctgcatttgtttgcttaggataatggcttccagtggcatccatgttgctgcacaggacataatctcattttttatggctgtgtaatagtccatggtgtatatgaaatattttctttatccattttactgttgaatggcatttaggttgattccatgtctttgctattgtgaatagtgctgctacgaacatatgcatacatgcgtctttatggtagaatgatttatattcctttggttatatacccaataatgggattgctgggtcaaatggtagtcctgttttcagttctttgagaaattgccaaactgttttccacaatggctgaactaatttatattcccaccagtgatgtatcagcacttccttttctctgcaaccttgccagcatctgtcattttttttttgactttttaacaatagccattctgactggtacgagatgatatcttgttgtggttttgatttgcatttctctaatcagtgatgttgagcattttttcatatgcatgttggccatacgtacatcttcttttgaaaagtatctcttcatgttctttgccatatatatatatatatatttttttttttttttttttttttttttttttttttttttttttttttttttttttagatggagtttcacaccgttgctcaggctggagtgcagtggtgcgatcttggctcactgcaacctccgtttctcaggttcatgtgattctcctccctcagcctccccagtagctgggattacaggtgcccgtcaccacgcccagctaatttttgtattagtagagtggttttaccacgttgactgggctggtcttgaactcctgaccttgtgatctgcccgccttggcctcccaaagtactgggattacaggcatgagccactgcacccggcctgccctctttttaatgggattgttttttgcttgttaattaagttccttataccttcttgatattagacctttgttcaatatatggtttgcaaatattttctcccattctgtaggttgtctcttaactctattttgctgtgcagaagctttttagtttaattaggtctcatttgtcaatttttgtttttgttgcagttggttttgacatcttcatcatgaaatctttgccaggtcctatgtccagaatggtatttcctaggtcatcttccagggattttatagttttaggttttacatttaagtctttaatccatcatgagttgatttttgtatgtggtttgaggaaagggtccagtttcagtcttctgcatatgactagctagttatcccagcaccatttattgaatagggagtcctttcctcattgcttgtttttgtgcttttgttgaaaatcagatggttgtaggtgtgtagcattatttctggactttctgttatgttccattgttgtatgtgtctgtttttgtaccagtaccatgctgttttggttactgtagccttgtagtatactttaaagttgggtaatgtgatgtctccagcttctttttttttttttttttttgcttaggattgccttggctgtttggggtcccttttgattccatagacattttaaggtagttttttctaattttgtgaagaatgttcttggtagtttgataggaatagcatttaattcagtaaattgctttggacagcatggcctttttagtaacattgattcttcctatccatgaacatggaatgattttccatttgttgtgtcatctgtggtttctttgagcaatgttttgtaattcttgttgtggaggtcttttaccaccttgggtagctgtattcctaggtattttattctttttgtggctttttttttttttttttaaaagacaaagtctggctctgtcacccaggctggagtgcagtagcacaatcttggctcactacagtctttgcctcctgggtacaagcaattctcctgtctcagcctcctgagtagctgggactgcaagcacatgccaccatgcctggctaattttcgtatttttagtagagatggggttttgccatgttggccaggctggtcttgaactcctgggctcaagccatccacccgccttggctttccaaagtgctgggattacaggctgagccactgtgcctggctggtattctgttcttgatttggctgtcaacttcaacatatgtggtcatcattatgtggtgaatcacattttaaaaatttgctgaagattgttttatggcttattatgtggtcagttttagagtatgtgccatgtgcagatgagaagaatgtatattctgttgttttgaatggagagttctgtagatgtctgttaggcccatttggtcaaatgctgagtttaggtctgaatatctttgttagttgtctgccccaataatctaattctgtcagtggagtgttaaagcctcccactattattgtgtcattatctatgtctcttcataagtctctaagaacttgctttatgaatctgtgtgttcctttgttggatgcatatatttttaggatagttaggttttcttgttgaattgaaccctttatcagtatgtaatgctcttctttgtcattgttggtttaaagcctgttttgtctgaaattagaatagcaacccctgctttcttctgttttctgtttgcttggtagatttttctccatccctttactttgaccctatcagtgtcgttgcatatgaaacgagtctcttgtagacagcatacagttgggccttgcttctttaaccaactgaccacactgcaccttttaattgaggcatttaatgtgtttacattcacggttaatattggtatgtgctggtttggtcctgtcatcatgttgttagctggttattatgcagacttgattgtgtggttgctttatacaaatgtagatacaaatgcagatatagtaataagtcaaaaatatgagatgggaatagatttagaaagatggggaaaagcaggtaattacaatgattggtaggaagcttgacaagttgacttctaagagtctaagcttctctgtggtatctattgtattgtcatttggcaattaaaaaaaattgtttcctaaactgctcttgctatttaattaccatatattttactgttccaggaaacctgatcagctctcagtcattgcaacattttttattctaaaaatagcataaattttagctatctcacttttcaggtttatttgtttaacttttgctataagatgaagttttttgactttaagattatggcaaatgatttactgttttcctatgaaggatagtaagatatttaatgttgttcatataaaggtgtacttttaaaaaattttagccaaataaaatttttttctggttctttatagtttattatgatatgtacacatgagtgctgaataaactcttggagtttcatggttattttcatttagcgttcataatctaaatggcactttgtctttttttatttaaggatatatttatgtttataacaagacagttgaaggggctagaggatacaaagagcccacaattcaataggtatttttatttacttgaggtaagcaatatcttgtatcttgagatgacattttaaactgatttttttgtttgtatatttttaataatcaaaatgcttaactttcacttttttacaccttatttttagaacattgcttgggtcaagtcatataacatatgctttgagttagaagatagcaatgaaattttcacccagctatacagaaccttattttcagttataaagtaagtttattttattaagtatgtaacattaaaaaaaggtaacaaattttgaacttgtaggtgaatctgcataaactgttacaatgaatattagaaggctgagagatgtaacttttaacacactttatttttatacatgtttcaaaaatgaatagagcttaattttgtattatatgtaattattggttagaggagtggcataaggccagtgtaaaatttttttggattgcattatttgtctataaaacatacatactgacttcttaatgcatatggctatttgagctttttgtgtatgctttaaaattatttactggaattaacttcagagcaattcaattttctgaatttaaggcagaactgaagttgcttttgatgtaattacttttgattgtgagactggttaaaaattagggaaaaatctaagaaatgtagtgtaaaaatataatttgtatacttttgtatgatgtgggagagagggaagctttaagtgaatatacatagaattttatttaatattttagtattatttttgtaaagcataatgcttgtcagtgtcatcttaagagtaaatcctgtatatctcagttgtaattgaaacaaaatctgttttgaattgcagcaatggccacaatcagaaagtccatatgcacatggtagaccttatgagctctattatttgtgaaggtgatacagtgtctcaggagcttttggatacggttttagtaaatctggtacctgctcataaggtgagtagcaatgtatactgtaatgtgtctaatgcccgttaatattaaggcttaaaatttgtgcttaggttctaaatatggtttatcctgctttaatcttttagagaatctgttggtttagttatattaatacatatttattgtgattaatgtgtaataaaaagatacacttaataactaataagaaattgtagatttcatgtaataacatatttgttataattcagttgcatatggagtgtatttcagggagtgagttagtagtagctacttagatgctgttacataacttacttgtcagaagatggaaccaagtagggccataactaaaagatagtgataatgtagatagagaggactggtgaaatttaaagggaagtctctactaaatgggagaggagtgatatgttggtgacagtgtttcttgcctgcgtgattaattaagatgttatgtttgtatgtttttgtgtgtgtttgtgttttgattttagaaaatgactgaatcttcagttagaaatacggttctgttatttagaaggggtttgggttaaggagaggaggacaggaatcaccagtgtagttatctgtgcaaatataagacctctctggcaagatataatctcagtgtagagactgacatgaataatggttcagtgaaaatgatctcataattcaaaaattccaaactcttaaagaaaacagtctctgaatcctgaaacttagcagacactacaaatagcaagattagagttcagaaattcagataatatatttattaaataaaatctacaggtcctggtgtgctgtgggttcctagtcagctgccatcttgctcctcttcccacccctcactccttcctgctgcaccttctgaatgcagcccaccatgtcctgactctacccagcccagcctcacttctgcctctggtgaccacaggagagaagggggaagctggcaagtagacctgcagaggctcttcccatcgtctccttcaccttggtgcccacatctagttataatccccattaatccattttattaaatgagctgtaaaaatcagcctggggcccagctagtgacttctgctgggcaaatgaacacctggcctgatgccacaagctctactgcctgtgtgctcaggtgagaaggcagaggtcatgaatccagccacagaatgccctagggaggaggactgaattcccagggggagacctgctaagcctttcaaatgggctgtgcctgactggactctcagcctagctctctggaaccctcaaccacttgtcaactgtgccaagacaaaccctcctagacacaaatcgagtatctagcttggctttctgcactgagcagctgactaccagaggcatctgaggcctccatccgttgattgtcgtggagaagactttgttggggaaaataaacccacccttcctgattaaacattttctccttggccttgttgtagggagaggacctgtaggtacttccagaaactagaatcataggatcttccaaacttcctgtctctaagtacaggagctggaatctttccaccaagtacttatagattcaatcttttgcttagtccatttagcttagggtggaaatttctcaaggcaattactgttttgcagccctttgcataacttgcatagctccttgtagtttagtgaatgacactgaataaaacattctgacaaaatttttaaaaaaaattataaatactcttgaaaggagtaatgataagaggtaaaaaatgtaataactagacatattaaaggagaaaattaggagaaaaactcattagcaatgaaaaatggctgggtgcagtagctcatacctgtaatcccagcactttgggaaaccaaggtgggtggatcacctgaggccaggagttcaagaccagcctggccaacatggtgaaaccctgtctttactaaaattacaaaaattagccaggcgtggcagcatgcgcttataatcccagctactcaggaggctgaggcaggagaattgcttgaacctgagaggtggaggttacagtgagctgagattgtgcgactgcacactcaagcctgggtgacagagtgagactctgtctcaaaaaaaaaaaaaaaaaaaaaaaaacagaaaaagaaaaagaaaaatgaccaccaaaatataaaccttgattgaattatatgtaaaacatatttagagaactgggatagatgtgaggaaattatacaggcacagtgagatgaaacatgaaaggtaaggtctgacatatttaatagtgatttcagaataacaaatggagaattgagaagagatgatattcaagtagaagttagcttgaaatattccagaattggttaaagccgttaatttatggattagtgagaaaaagtaccatgactagagtaaaaaaaaaataaaaagaggaaatccttgtccaggcccatcctgaaattgtggaatactgaaagagaaatcatatataaagcacccagaatgtaaaggcatggcccttaccaaggaatgaatgctaaactgattactgacttctcatttgcagtgttagagaataaatgaatcttatgtaaaatagagtggtttaatggaattagtaagtgatatgatcctgggatgatcaggagtatttggagctattaagtttgaactttaaatgaaccatttatgttaaaattttaaggattataataaaaggaagagttacagtaaatgtaaatgacctgtatttaccatgtaagacaggttctcagattggattgaacataatctgggtgattatttttactaagaaatacaaataaaacacactcacaaaaggtcgaatataaaaggatgggaaaagtacttgccaggcaaatataaaccaaaagaaaaccaagatagcttatattagacatagtagtctttaatggataaagaagagttttatataatgagaaaagattcagtacccaggaagatatctaaacttgtgtgcacacaggctcaaaatatataaagcacaaattgaaagaattacggacagaaagaagcaaattcactattcgtgttccattttaacatgtgttttagtgactataaatcaggtaaactgagtttataaaaatattgaggatttgaaacaaaactactaatttaataacaagcataattaacagaaagaagcaaattcactatttgtgttccattttaacatgtattttagtgattataaatcaggtaaactgagtttataaaaatattgaggatttgaaacacaaaaccactaatagcaagcatgtaatctgacaaaacattaagtcataatggcagttaaaatatttagaaatgataattaagtgatacatattaaaacttgcaggatacacttttaagtgtaactccatggctaaatgtacatttcaaggagtaataaaaacatgagaataaacaaattatacaaggaagaaagtagtgaataaatgaaattagtgaaatagaaaacacagtgacattccatcaaaaccctaagttagtaatttgaaaaatgttttaaataagcaaatgcttggaaagctagatcacaaaaaaggaaatggtgtctatgtacagttttagaatgaaatgagaaacaatggacatgaaaaagatcaaaagacaattccatgaggaatattttatgctaacatatttgaaattagaataaattcctagaaaatataacctggcaaatttgtcttgagagaaaatcaagacaaatagcctataaccaatacatttagttggttttaaaaactctgcctataaaacaaaactcttcttttcaaacaacaatagcaacgataatagcagcaaaaataattacagcagcagaactcaaaccaacaacaaaagaacctgtaaacccgttaccagggatttctgttgattatttaagtggcaaatattcctaactttcagcacacttccagattatagaaaggactactccataactcattttatgagcagagaataatcttcctagggaaaccaggtgcaaaccaagcaagaaaaaaaaaaaaaggctaattgattcccaatataaaatagtaatttccagaatgatttaaaatactattgataatcaccaaattggctttattttaggaatacaaggatggattaacattatgttagtgatagactaagatacttgtttaatagatcaaagagaaagacaaattttaatagatatagaaaaagatggatacaattcattgtaatttataacttagcaaatttgaaatagaacttaaattgataaggagatatgtatgatacagtatttaatggtgaaatgttgaagcattctctttgatgtgaggaacattgtaaaaatactgcttctgttcaggcaaaaaggcaaacatgctttaaaaaaaatttgtatttatttatatattttgaaatttcagtagcttttggggtacaggtggtttttggttacatggatgaattgtatagtggtgaagtctgagcttttagtgcccctgtcacctgagaagtgtacattgtacccaatgtgtacacaatgtgttttttgtctcttgttccctctctgccttctgattccctgtagtccattatatcactctgtgtgcctttgtgtacctatagttttgtttccacttataaatgagaacacacagtatttggtttcccattcctgagttacttcacttagaataatggcctccagctccatccaagttgctgcaaaagacattatttcattctttttatcgctgagtagtattccatggtgtatatataccatgttttctttatccactcatcagtcagtggacagttagattggttccatatcttaagcatgctatttttaatcctcattatagtaggtgtgttatattagtggaataagacaagacatacaatataagaggattggaagaaactgaactgaaatatgattgtgcagaaaacacaaaatggtgtacagacaaatttatagaaaatataagaacattctagaaggttgtgagacataaggtacaaaaaccttctagcataatttcaaaaaattttcatttgtagctttaacaaagatgtgaggtacttagaaatttaaccgtaatgtgtatcacctttatgttgaaaattgttataattgactgaaaagcataatagaagacttacatatgttgagagatttactgtttatggaaggggagacttagtatcataatgatgtcaatcttctgcatactgatcaataattcaatcaaaaatagaaaccgaggccaggctcactagctctctctcattatcccagcactttgggaagccgaggcaggggaatcacttgagctcaggagtttgagaccagcctgaacaacatggcaaaaccctgtctctagaaaaattagctgggcaagtgacgcatgtctgtagtcccagtgacttgggaggctgaggtgggaggatcgcttgcagggaggtcaaggctgcagtgagctgtgatcacaccacggcactccagcctgggtgaccaagtgagactctgtctcaaaaaggaaaaagaaaaaaaaaagaaagtgatagcatgtgcacttgtgtgtaatttgacaagatgaatctaaaactgatgtgaaagagcaaatgaccaataatagccaaacagttttgaagaagaataagaaaacagggacctaatcttgacattattttcatgtgtccctttggctataatcagtcagtgatagacaaagggacatatggaaataatggagaatttctgaatgaaggcatccttatgtagaagctgagagagagtgggtattacaagttatcaaagggggaataagaaattatttaatgaatggttttaggacagtttagcacttatatggaaaataataaaaattagctacttagaccatacataagaataaattacaggtgcaataaaggtctaaatgtgaaaagtaagtttttaaaattttgtttgaaaataaacgtctttgggggctgggcacagtggctcaagtctgtaatcccagcactttgggaggccgaggcgggcagatcacgaggtcaggagatcaagaccatcctggctaacacagtgaaaccctgtctctactaaatacaaaaaattagctgggcgtggtggcgggcgcctgtagtcccagctactttggaggctgaggcaggagaatggtgtgaacccgggaggcagagcttgcagtgagttgagattgttccactgcactccatcctgggcgacagagcgagactccgactcaaaaaaaaaaaaaaaaaaaaaaaaaagaaaataaacatctttacaacctcaagataggaatgaatttcttaagaaagctatagagagcaaagccgtatgagaacagactgataaatttgattacattaaaaataaaagctatttgtggtaaccaatatatggaattgaactgtgtctatcaatggatgagtgtataaagaaattgtggtatatgtatacaatggaatattattccagccataaaaaaatgaaattctgtcatttgcggcagcatggatggaactggaggttattttgtaaagtgatataaaatgagaacaggaagacaaatatgttttcactcgtgggggctaaagaaaggtctcatggaagtagagaatagaatggtggttatcagagactgggaaaggaactggggaggggaggaatgaagtgaaattaaggagtacaaaaatacagttagatagaaggcatagttctttctagtatttgtttgtttgtttgttttttgagatggagtctcactctgtcacccaggctggagtgcagtggtgcaatctcagctcactgcaacctctgcctcccaggttcaagcaattcttctgcctcagcctcccaagtagctgggagtataggcatccgccaccacgcccggctgattttatttttattggagacggggttttgccatgttgaccaggcttggtctcgcactcctggcctcaggtgatccacctgcctctgcctcccaaattgctgggattacaagtgtgagccacagtgcccatcctctttctagtatttgatagtacagtagggaaattatagttaacaataatttatatttcaaaatagctaaaagagaagatttgtaatgttcccaggacaaagaaaacataaatatttgaggtgatggatatgtcaggtaccttgattcgactatcattcagtgtatacatgtatcaaaatagcacatgtatccccagaataagcatagttgttacatatccataaaaaaaaaaatgaaaaaaagtctccatactttgacaccataaatattgtgaaaagacaagtatagactaaggtgtgttatacatgtacagacagttcctgacttaatggtttgacttactttataatggtttattggggtattaaatgcattttgacttactgtgggtttattgagatgtaacttcatcataagtcaagaaacatctataattgatgaaagtttagtccatagaatctatggagaaaatataaaaataaataaaagcaagactaaacagcctaactgaaaaatggcaaagataaaatgtacagaaaattacttctcatttacacaaggagacttgtacaagacatataatttaatgtcaatgaataggacaatcagtaaagaatctagtatatctaaacagcagttagtatgaatgaaataataaaatacaagcattaaggcaggtaaatctaaaaatatgctgagtaaagagtgtgagtttaaggatatatacagtgttcctgttctctggaatatgtttaaactggggtagtgactccattttttatctttacttccttgtatcattatcaaagtctcttagaaacatagcttcttatgatgttttttcttgttatcttccgcccgtactttactatttgttgtatttcctgttgtatcctttgacttacctgtgctctgaaatgtgtttgagtaatctgcttttttacagctgcccaaaactcctttgtccctccccgcctatgggatgcccatcgctgcccacactagaacatagttcattctcttaggatattttgtgttttttggacctgaagtggaacagcttgtatttgtacttaactgaattgattttgggactagatctagagtgactctatctaataagcatttattgaccatttctgtgtggtttacattatgttatgaacaaaataggaagagaatataattatccttacgtggatggaatcttagatccagtaggccagttagtcctaaaaaaagaaaagtggttttgccttctctcttttattccaattgagtcttagttttttcattcatttactcaagtagcattttgaatacaggtaatattttgcttttcatagttagagatatataatatagatattgtttatgtttttcagaatttaaacaagcaagcatatgatttggcaaaggctttactgaagaggacagctcaagctattgagccatatattaccaatgtaagtcttacttgtaattggttgtcagaaggattaaactgaaaatttaaagacttgctagaagcaaaatttcatcagatagtatatagttttaaaaacaacaaatttgtgttgttttaacccttaagtaatatattttctttctccttcttaaaattattcttgctttatattttttggaaggcttgctctcatcctatttgttcttttatcttctttcaaattgcctgagaacttaaacagttttattttggttagcaagatattctgtttgtttctactgatagaaatagagttaaatgtaattagataaaacatatggaacttttcattattcagagacgttgcttacaggtttttggagcttaaattgatttgtacaagaagaagatatgaactaatattaagacctagaaattgaaggcaagtatgaatggcagtagtgatttagtaaaagttgcttatctattgctattcctggggtagattccatataaatctatcttttctggaaaaaaggaacaattgtaataaaatgagacctttcagtatcaccccaaatctacttacttatggttgactatcttgtatttatttttagaagaaatattttttagctgctaggttcactgacagaagtttatggtaagttttattttctctccacagttcttttgagttctacagatttaggtggcagtattcatattatattctgtgtgaatggtgcctcctggaatacaaatgtagagtacagtgttaatggtggcccttggaattgtgtaacagttcagtccctccacctgcttttcagtttcactcacctccagacaagtaaaggatataaatttgcattcctgagtaaagtaagaaagaaagcctttaataattacttatgcattctcctaaaatttgagggagagtttttcttgtagtatacacaaatttaaagtcagtgtatgaaatatatcatgaaaagatgtactttgaaaactaactacttcataaaacagtaacttaataaattccagcttttgtttctggcttatagccttagagaatcccaagcatacgatgatttggaaaaattaatttaatttgtaagaaattgttttgaagggtaaactttcagaagctgtggaatcaaatctgtaatctatcttaattgctccaagattttcagggaacttccaatactggtttctgcagttttgtaagttacgggtactggctgaaataaattggttggattgagttttttcatcattggcttagtggcacttgaagtgtgtagacctagacttaaaacattctgtaattatccttttcccttgcttcaagtacttctaaatgactatttccatgggccattagagcacactaggtgagctcctcctggtggccatttatttaaactcatattgccaagccagtttttttttttctttttttttggaggggaggggggacacatcttattttgatttctttttctggcataaaaataagaaaagaacgctatactgtattgatatctctactgttattggggaaaatcaatatttgattggggcaattaaaggaaaaaacccacaataaatgatgatacttgttagagttagatgattaggttcgttatactgttctctcaaattttgtatgtttgaaaatgtttataatggaagttaaataaagaaaaaaaggctgaggaaatatttttaacaatcccagaatacatcaaggtaaaaacatttctttatcacttataccttgtgttaatttcctgttgttcttgcttgcagaaatagaatccttcccccatgaactccccaaactttcatattatgtctttatcaaaagctggggagcaggggccagagtgttctgagtacacattgaattatatactttgtctcagtacgttgtccactattttcttatttctccctgttttcttgttccttgccttatttgaaggttagctagaaaataagaattgctttttccctccctttagttcctttttgtctacttatgtttccatttcagacctttataattacatgtaaaatcactttctagtggacttaatcgtcttgtagtagggtaaaattagttcagtcttagaaatcattcttagcccttttggacttacagttaaaacagctattatttactcatcctcctagttgagaattaacaattaaaaataggagtaagatactgagataataaccccacttctctcttctgtttttctttttcattcacacatacagacacattcttttttttttttattcgatagtatttcttacatatcaagacttaagaaatcactgtggtggtataggttatttatgtattaaaatttgttgttgttgttgtttgagacagagtcttgctctgtcacccaggctggagttcagtggtgtgatcttgttacactgcaacctctgcctctgaggctcaagtgatcctctcacttcagcctcctgagtagctgggactacaggaatgaaacaccatgtctggtgaatttttccttttttaaaaaactttttgtagagacagggtttcaccatgttgcccaggctgttcttgaattgctgagctcaagcagtccgcctgccttggcctctcaaagtgctaagattataggcgtgaaccaccatgcccagcctaggttatttttttttaaatagaatttgttgtaacacaacaatccaggaagctaaacagtacatatatatttgtttaaaaggtaagatggaatatcaagaacaaaaagtacatggtgataattctaaaaatttcctacacgcatcacttcttaatgatgttatttttcaccagttctttttttatcacaaattttaggatatggcaaaaaattattttgttggactgaaaaaagtacatccaatccttgttggaataggtaaaatttggttaaattgcttaattccactgagcctctgtttttgcacctgcaatgcttgggtggtggtggagaatgtgttatttaatgtgaaatattttgtaattaaaattagccatgtaaatgtaaggtagaatttattactgactggtgacatctttcattaggagacatttgctgtacaaaaaaattaatttgtagtatgtaattagctacgcttttgtaaatgaaagaatttttggaaggaaatattttaatcaaatctaaatctacctccactaaattttcacctcttaggaaggacttggattgttttacccatatttgtatcatactgtcttttgcatattttttattcatttaccaaacatatattctatgcctcctctgtgtcaggcactgtgctaggtaggcttttacacattggagaagaccaacttggtcattgcctttttggagattataaaagtgttcaatacatgtgtttttttatggaatttgtgagaaattaaaccagggaatgatttttttcccttaatttttcaaataagtttttcccagactgttagaagaagatgatgatggtttgaccacttgggtggtgagattgggaaggattattgttctttattaaggaatatactatttattaagtaaatagtacttgttttactattttttaagcaggagaaaatttgtgaatggaagcaaaaaagccactttattttcagcctgaataagaaattaacctttgatgtcatgaaattctcttcccataaaattgataaataggaaggacaaacaagttctttttaaaaccaaaaaagaaagaatagcaaaatagaatttgttcttctttcttcatggctaggtagtctggtctgattcatagacctaaaaaagtcacataaaaacaacccaagaagtaaaagtaagcagaaaagacatagaaatatgaaatcctccactctgtactttcagtatagaaagctaaagcctaattaagccagttgtgtgttaactgtcacagaagagattagggcagcttgtgtggtataaagaatccttgactccttctccgctgagactcaggaaaccattgaggatacatggcagggtatgcttttggttaattttttatgtttttggaagattttatatagaaagaaacttgacagttatgccatgcatctttgccaatttcagtagtaatatgataaatgatctgagtgtggaaactagttagagctagctatatggtagggaaaaattgtttaaatttggattttccttgtgtttgtgtgtgcttttaattggattttaattagtgttgtaaaccgtgtagatatgtacacatcagaatgtaaaagaagacaaaggattaggaagaggtagtttttcatcaaaaataaaaaattacatatttcaaacatagaattgccttctatgaaaatgtaagaaggctgtatctatgggatgatgttttcttccatatgtactaaggtgaacaagctattatccctcacccttggggagattaagacattgtattagggtcttctagagaaacagccaatattgagtgagtgtatgtatatacagacacacatatacatatatgtgtgtatattcacacatagtgtatgtatacacacacacagagacacatgtatatgtatgagagggaatttattaggggaattgacttatgagattacagagtctgagaagtccgagagtaggctgtctgcaagctggagaaccagggaagccaatggtgttactctcagaggcagaaggcaaggcttgagaacctagcaggggactgggctattggtgcaatttctggagtccaaaggcaggaaaacctggagttctgctgtccaaggataggagatgaatgtcccagcccagaggagagtgaattcactttcctttgcctttttgttctattgggccttccagcctatttggatgatgcctgcccatactgagggcagatctttccactcagtctacaagccaatctcctctgcaaacatcattgcagacacacccaagacacgttgctttaccagctatctaggtatcccttaatgcagtcaagttgacacataaaattaaccatccagaaatatgcacaaataatataggatagaatataatcagtattataatggggagcagagtatatttgaaaagtagaatgtttattgaaatgtttcagtctgttttattgtatacaagatggattccatgttttatctttcatgtagcctatattggtttcccatataatgttagaaaatattttgatatgcctagtttgactttgtataaaataatgatgaatttggtcaaataagattttaaaacattcaacttgtctctggtttttctactaatgataggctttctttctcctcaaaagttttttaatcaggttctgatgcttgggaaaacatctatcagcgatttgtcagagcatgtctttgacttaattttggagctctacaatattgatagtcatttgctgctctctgttttaccccagcttgaatttaaattaaaggtaacttgtaaaaataatatgattctaccaaccaagttattagcaaagagcattatttatagctttttaatttttacagtagttttaactgaatgtaagagatgagggggaagtattactattatttcttcacgtatttgtgccgtgtctgtttgtgaatctttagtgcctggcaggtgcctagcagatagtaactgtttaataaatgattagcaagatggtattttcctccagacattttccagataaattctaggatttgactaacttttgaagtcttagctgtacatcaagcttatgttttcaaggcacagtttatagtagttcctttgaccactgaggccataaaaatagtttagagttttttatccacatagtgtgaaatgctttccctttatgcatattatctcatgttgcctatgttgaaagtttgtttgctttttatatagttgtgtgaattttttatttttttgagacaggatttttttttgttttgttgcccaggctggagtgcagtggtgtgatcttggctcactgcaacctgtgcctctcgggatcaagctactcttccacctcagcctcccaagtagctgggactacaggcgtgtgccaccacccctgctaatttttgtattttttggtagagacagggtttcaccatgttggccaggctgatttcaaactcctgacctcaagtaatccacctgcctcggcctcccaatgttgacattacaggcataaaccaccacccctgaccgagtgaaattttttggtagcatgttcctaactgttttgacattaaattatgctgtaaaattgagcagaattggacaatatagttttctttttcaaatcattacaataaaattaagtaaagctggttataattattaatctttgtggacccagaaaagttcttaaatgatgtttgtgtctaaaatttttgattttctttcaaaaacaaaacagtccacattggtaatgtgaacaccccaagtagccagtaaataagtattcttcttatattctggagtagtttttggtatatttctcaaatgagccattcaattaactggccttcctgtcccctttttaatgtggttagtgatttgggtgaggcagcaggtagccacacctctaattatttgttggtttatatgattttctgaagtaaaaatattgagtaaatgctatgcatgttcctacacactatgagaaatataaaaataaggaaattatcatccctgctttcagcaaacttaacatctagtatgagaggaagaggaaaaaaaatccagatctaatatgaggccagatattataagtgtcataagagatacaaacagcgtacaattgaagcaaaggaaacagcatgcagaagcatatagaggtaggaaggttccgggtgaatttgtggaacacaaagaattataattggaagatagcataaagtaagtttaaatcactcctggctgcatattagaatctttgcttgttaagccttaaagaaatagctgtccaggcactgaaccagactagctgattccgagttttggggaatagaggtttttttttttttgttcttcttattttaattttttttttttaagttttgagatgattctaatgtacagccaggcttgagatataattacttagacgaataaagaaagaaataatagagatgagttaggtcatattgtcggggctcttggcatggcaggttgtggcattggtttaaaatttaaaaacaatttgtgtagtgacatttccatagcaccttgaatatcagtgccttttgatatacccaattcccacactttatgttcaagtctagtattgtgactggctcattcacttatccattgagtcatttgttggaagtgccaaaatcaatagtaaaattgagttcacatccttagggtgcccccaatataatatataaaacaaatttgagttttcacaggtttaaggcctctttttactgttgagctccttttagaaatctggtctgtgtagatgaagtgtcttactgggagactgtagcacatactaatagagctaaaaagtttattcacacagagttttctgttttctgtaggcctggcctctgtcagtgtctgttctgaaaaaccacacatagtttttcaagggtcctgggtaggttttataagagttcattttttattttaactctgaatagaaataaactttaattgtaggaggggcctctaacattggaacaaactttaaagatgtattttcatgaaaggtacttctttaatggaatttgagataattagagcatttatgatgacatttaattttgtgaaaagtatagtgagcatttttatgtaatttttcatttagagttcatgaaagattttctgtggaattggagcatcagggaaattatggcaaagaatgggcagccttattctgaatatctactgcatggttttaaagctgtgattgtgttttattttagagcaatgataatgaggagcgcctacaagttgttaaactactggcaaaaatgtttggggcaaaggattcagaattggcttctcaaaacaagccactttggcagtgctacttgggcaggtatatgattttggtttcccatttaaaagtaatacattattctactgaccgtttttttaagaaacattatccacatttaaactgtgttctctggaatcataaaaatgaaggattttttatgttgaaagttttgaaagttgttaatgactggctatatttatatttactctttttagtctttatcctcagtaatttttaaaagataatacattttaaagctatctcttatggtattatgaccatgaagttaatattattactttaaggcagtgattaattccaactgaaaatacgtctttgggagatatagcctctctacaaattaattacaattaattaggttgtttggagatattgacaggataagagtattcacagagtgaataaagaaatgactatttatatttctcttcctaacttccttctgtattactcagttaaaggaaatgatggcctggattccttgcatggtttgaatgatgcataaaatccctgaaatggttgcagaattttgagtgtgtttgtgtatgtcacttttctgtgagaggtattcatccctgaccttgaaatattaaaagcccgacaagtgccttggccgaaacccgctctgactcagaaaaaaagagaatttttcccctcaaattattctcataacaaataatgcagttaagtcataaacaaacaagatctggccgggcgcggtggctcatgcctgtaatcctagcactttgggaggccgaggcaggtggatcacaaggtcaggagatcgagaccatcctggctaacacggtgaaacccagtctctattaaaaatacaaaaaattagccaggcgtggtggcaggcacctgtagtcccagctacatgggaggctgaggcaggaggatggcctgaacccgggaggtggagcttgcagtgagctgagatggcaccactgcattccagcctgggcgacagagcgagactcttgtctccaaaaaaaaaaaaaaaaaaaaaagatttaaaggccctgattttatattctttgtgttgaaatatttgcaatggtatgaccactttctttacattttaatgaaaactgtcagtgattactgtaaatttaatattttggtctcatttttctgatttgttaaaagaggatataagttgtgataagtgtttgttaagcttcagatctccagtctgatttcttgattcttatttagctcaataattacgttcagtcagtcaagttaagccaacttttttcttttaaatacaatggaaagtttttagacagtaggaaagaatatcagtttaaattatgcaacttaatttaaagtttaatattttaaaacaaaaatacttttactgtatatatatttattatatctttaaattaagacttggattagctgggatgtattttattggtttttagctggagaaatcctaatgtaaatgtatatgtcacctttctattatgttgtaatttttccttttaatattaataacataaaacttacacagtattaaataataccaactttaaggagttagtcttttaaaagacgtcttagtatatttatttttaattgttgtaaggtgcatgtttacctgagaaatgataacgtatataggattgagtacctgaattcaaaacactcaggaagctgtatgggaccagaggctagattttataacttttgggaggggaggtatacttcatagagcatatgcttttttttttctaatttttatgagtaatttggtgctggttttgaagactttttcccactcctttataatgctaactttagtttcttaggtgttgaatgatgtaagatttgggagcctttagatttcatagaattaagacatatgaaaatattgaatggaaaaatcttggattcactttaatgttcttgatacttaatttttttaaattactattttacattctgtgataaagtaatgtatacagacggaacatcagtggttgagagacagctaaacatcatgtgcttcctgatggaagaacacagtgccatctatggtattttggtagtctggcaaaaaaaaaaaattgacccaaatataatcaagtttttagatctaactaccagtttacaggatttagaagagagaggagcctgttaattcacatcagaatgatacaattagcgaaatctaaattatggaataaaaccatacacatatacagcagttgctctagcaaattacaggaaaaagagttggagggaaaacaaaagatttgaggcttaagtgacatatcaaccaaagaattttaactttttagggatacatacatatttacagatgtaatgtaaaaagtggccttgccgttagtggcagtgtaataatggtgatgattaattggatagtagtaatttgggtacacttttagattcatgtaatatactgtagggtttagtgtgagatctgccatacattagtgaatgccctatatttaaaagggaatactttagggaaagttttctttcaaacatagtttgagatttatgatgtttctatgaactatatatgcacacttgcataaatagatgtatttgagagtataacgttgataggaacttttttatcattcttatatttgagccaaatgtatatggtttattcaggttccttaaaatcacatagttctcacaggagattgctctagtttgtatagagtttccagagcattcagacatacatgtatatcagaaactttgtaaaatggtttggttctactttgcattttccttcataaactgttttttctttaattagataaatgtaaattgggtacagatttaacacatgtctgtttctcttattttgaagctcactctgtgcttttatattttatcaggtttaatgatatccatgtaccaatccgcctggaatgtgtgaaatttgctagccattgtctcatgaaccatcctgatttagcaaaagacttaacaggtactatatatatgtaacagcaaatattcttacgtgctcttcagtggaaaaaaataagtttcatagggggaaaaaaaaccccttttttcgggggtggtaggtgaagtcttgttttagtttaaggtcatggaagttgttctctgaagctagatttttttttttttttttaaaatagagacaaggtctcgctatgttgcccaagcttgcttagaactcctgaactcaagctgtccttctgccttggttaaattagtttaccatgactcacctaagttcttaaaatattgaagaacattagtcttataatctagtcaaagtcaagacctgttcaaatccaaatgtctaaaataagtttagaattgtccttaaactaagaaactagtaattgttcctggagacagacattttcatagatgcttccaacctatgtaggaactatgctgtagaaattctagcttcaggccgagcacaggccaaggtgggcagatcacctgaggtcaggagatcaagaccatgctgaccaatatgaaaccccgtctcgactaaaaatacaaaaattagctgggtgtgatggcatgcgcctataatcccagctactcaggaggctgaggcaggagaattgcttgaacctgggaggcagaggttgcagtgagctgagattgtgccattgcactccagcctggtcaacaagagcgaaactctttatctcaaaaaaaaaaaataaataaataaataaatgaataaaacagcagatattttaccagtttcatcctttttgggagacatcccacttggagctttctgatttcctactcaaatttgcagtgcttagacagcttgctctgagcttctgctctacagcattgaccttagggccatccattcttcctcccatctttgctctccccttccatcctcctcccttctttttccctcctttcctcttcgtctgtgagtgtgtgtgtgtgtgtgtgtgtgtgtgtctgtttctacacctcccctttctccttccctttttctctggatgttcctttttctttagcatccttttcttgtgttgctaatacagtattttctctgagagtgtcaatggtaggtagttttttggggaatttttctttttcttccaaaatgtctgtatctgctatttgtttttttcaccttatatttgcttttgtctttttttccatgttaaaggctttcctcaaatgattggcaatccgaggccgtctgctcatgattaagagtgggggggctaaatcaaaagctgtttggaaagccctgagtatatgctttcctcaaatgattggcaatctgtggctgtctgctcatgattaagagtggggggctgaataaaaagctgtaaactatttggaacactctgagtacatggttgggtctgtcaactctgaacttcacttttgggtgatcagagtgagttgtttgttggggagcccttagtttagatacttcctcttcatcctgtcaaatttctaatagaagagtatcttatctagaagttaaaggtgagttactaatgtgtttgggaaaagaatgatgggtttctgcattcacatttcagattagttgtcacataatccccttttgggtatggtatccatgccctcaaccgtttggggtcccccagtttagagctactgttttatatttttattatagtatttatctccagacttcttttggtgtggaataggggcaatctccttgatggatttctcaaacagccttcacccagtccttccttctcttccttgttttaagatccagaagttcttgttgctagttcctatgccttttgaagagtgtagtgtatattgagttggttgcttagttgtgatttttaaattgttttttaagagacagggtcttactctgttgcccaggctgattttgaattttttttattgaaatatttaaatcatgtttttcagttattaagtaaaaccagacccctgcttttttgctgttgataatgtgtagcagtgtgcaccaatttgatttgtacatggctaaatagaatttctctttcactgaatttgctgtcatgttaggttacataggccgcaaaggatttatactgactgagtaggagagaggcagtgctggaaatatcctgccaacgtatacgtttccttcttaggctcatattggcttcccatctcctgtttcccagtagccttagagtcagtcatttcttgctttttaacttctactcactgttgttacagatgagggcttgcggtatctcattctatagaagattctttctttctcccctagctgaaatatgatggcaggtttcagaggttttcactgctagataaagtgataaaagtataagagtaataaagcaatccttgcttttgtttgaaagagtgaggcttgaggctgggcacggtggctcatgcctgtaatccctgcactttgggaggccgaggcgggcagattgcttgaggtcaggagtttgagaccagcccagccaacatggtgaaaccccacctctactaaaaaatacaaaaattagccgggtgtggtggtgcacacctgtaatcgcagctacccgggaggctgagacaggagaattgcttgaacctgggaggcagaggttgcagtaagccgagagatcgcgccactgcaccccagcctgggcgatagagcaagactcagtctcaaaaaaaaaaagtgaggctttgatttttttttttagtagtttcaatcacatcttcaattattttcttttaaaccccatataccctgttccattttacgtttctccagcttcattcctgactagcaggatcatttcactttatccgtgtgaaccttatactgtagtgcttctcaaccttatcagacccagtacctccctttttaagcaaataatttgtaattctccctttgagatccttaaataaaatgaatagataaaacaatccacttaaaaagttaaaaaattaattgccctatttgtaatatacaggagaaacaaaagggaagtcatttataataaagtagtatatattgtaatatttaaatgtttggatatgacatacagagataacatgcctccacaagtttctcacttaattattctctgccacaggggtatatggaaagctctgtgaatcctaattgataaggtatttggatgactacctgaacagctaactcagatttatccatattttagagaaaatatcagagtctgttctacagtttccttttttttaacttaaaaaaagtgtaattagcttaaaatatacagatcctgagtgttcagtttgatgtttgaagagagtgaatttccatgatgccaaaaagtccccctgtatccccttccagttagttctctcaccattttctggtttctatttctgtaggttagttttgcctgtttctgaatttcatatatgttgaatcatacaatgtgtactattctttttgagggtggggaatggagagagatctggctgctttcacataacatgtttttgaaatttatcctgttttgttaatttattctttattattattccgttgtatgaatataccataatttgtttacccacttcttttgatggttatctgggttgtttctgatttggggctattaatagtgattactgtgaatagtcttatacaagtatttctgtgggcttatgttcttatttctttttgaaaacagtaattaaattgctggtcatagtgtagatacatgtttataagagacagtgaaaacagtctccatattagttatactgttttacatttgtaccagcaatgaatgagagttccagtcatttagcgtccttgacaacattttgtgttttcagtctttttgtttttaaccattcttataggttcttcaactattttaaatgttttcagtgttcttcctggaaataagcttgtgtattgttttctttcccatttgggtttcatccttttcctttgtcctgtgacatttacttgttgtccatctgccaaaattttgttgacacatctcttgcctgtgatctcttgttgtgatctcttctcttgttatttgtcccttttaaaaaactttctttttttttttgaggcagtctcgccctgtcacccagactggagtacagtggcacgatctcagctcacagcaacctccacctcctgggttcaagcgattctcctgcctcagcctcgcgagtagctgggactacagctgtgtgccaccacacttggctaatttttttgtatttttagtagagacgaggtttcaccgtgttggccaggctggtctcctggcctcaagtgatccacctacctcatcctcccaaagtgctgggattacaggtgtgagctaccacgcctggcctttaaaattttttttttttttttttttttgagatggagctctgcccttgttgcccaggctgaagtgcaatgatgcgatctccgctcaccgcagcctctccctactgggttcaagtgattctcctgtctcagcctcccaagtagctgggatcacaggcatgtgccaccacccctggataattttgtatttttaatagagaaggggcttatccgtgttggtcaggctggtcttgaactcctgacctcaagtgatctgcccgcctcggcctcccaaagtgctgggattacaggcatgagccaccacacctggccaggttagtgaattcttaatcaagttatcaatctaccaaatggagaggaggctgttattactcaattggatgtcaaggctcttttttgactgaagaactaatcttctttcttccttccctttctttctgggctcttaattttcttgaaacttctatgtaggtattgttttgctagggcttattttcaagggtatcatgcagtgttttaaaaatattttagttattaaaatttccactgtaataaaatgttatctttcagagtatcttaaagtgaggtcacatgaccctgaggaagctattagacatgatgttattgtgtcaatagttacagctgctaaaaaggatattcttctggtcaatgatcacttacttaattttgtgagagagagaacattagacaaacgagtaagtatgaataaataattattactaagttttcatttttaatacttgaagtttaacaatatttgaaaatatatttaaatatacatatttaaatataattagccttttttaggggtatggaggcattttaatatttaaaattacctttatgaggtttactttctgttacattaaattgtatcagtttttcttcattaaagatatttgttctaatcctgaagataagacagctcttaatggtagtcaatgtttatcctgtataccagtgttaatgataagggacttttgtaaaggcctgagatacaacttctcttatgttgttgactcttctttttctttcttctttcagggctgttgttatatgggtatgaattggtagttgtctagctggttgtattataatcaacatggaatagaaaatgaaagatgttttcaacttagcaaagctaaacccgatagagcaccatgcttctagcctattttctgtgtcctcaagccagcttttttgaatgagtacccactagctccactcattaatcagtgaacttgagaggactgtatcttgttatgtttgtgtttcatactgcatggaatatattaggcactcaggaaatactttaatgaatgttcattctgttcccctcctgattgccataatggcatctaagcctcatttaggcataagagtaattttggtgaaggatgagactttttgacttatttaagtgctaattatcaaagaaagtgggaggcctgcctattggttgttggaatatctttgactaggtaaattctttaaaactttgtaggccaggtgcagtagctcacatctgtaatcccagcactttgggaggctgagacgggtagatcatgaggtcaggagatcaagaccattctggctaacatggcgaaatcccgtctctactaaaaatacaaaaatttagctggctgtggtggcgggcgcctgtagtcccagctactcgggaggctgaggcaggagaatggcatgaacctgggaggcagagcttccagtgagctgagattgtgccactgcactgcagcctgggtgacaagagtgagactccgtctcaaaaaaaacattgtaacgggttgatcatgccatctcccttgtttaatactctcgttgataatgctggttgtgcgtggaggataaatgggcaagaagcacatggttttcccttcaaatctataggtatccagaacaatttattttaaccgataaatttagactaatctttattgaatatttcgttgtggtattaattagtgaaaagggccaaaaggcatgaagagggaaaggatatttgcattgttcataggatagtagccttctaaataccttttttctcagctagacttagaatttgagctgtttttgtgtattgttgggatcataatgtatatttttgatcatcatgttatattgtatggttgcttggttcattcatataaaaattgagcactgaaaaataattgactatatacatgttcttggtaatattagaatatgatgtatctttaaattctctttgaagaagagggaattaagagttagatacaacatggggagttagagatacaaactttttataaacaaattgaagtcttacttattttttgagacaaagtctccctttgtcacccaggctggagtgcagtggtgccatcacggctcattgcatccttgacctgggttccaacagtcctcccacctcagcctcctgagtaggtggtactacaggcacatcccactatgcctggccaattttttttttattagagacagggtctcactatgttgcctaggctggtctcgaattcctggtctcaagccatcctcccacctcggcctcccaaagtgttaggattacaagcatgagccaccatgactggcctgaaatcttataagacctgtagaagtcttttatttcaatatgtagttggtggatgaatgagataagaactattcttaatatactgtaattaagtgaaagaaaaaccaaggaataatttgttgctatgaatgacagaccatagcaaaagaaaaaggaccacgaaggaaaaaattaataatctctgcagattcatgatgttttcaacattaccagcttccttttgattacagtgctgtgtttatgtaaaattaaagaatgaacttattctaagataattaatgccagatgcactgtaacaaatatacacttattttaaaaaaagttgaatacatttcccttatacttcaactcagtcccagatgtacagaatggaccactgataagtatttttacattcagcatttgataaagccaatatcatatatgcctttaatacatcttaattactattatttgtaatagtgtaagtatgctcaatatagaccacaattagaaaaaaattatgagggatgggggtttatccatttaattctgtctttgtcttttaatgtttggtttcttgagctggctgcagtggctcacgcctgtaatcccagcactttaggaggctgaggtgggaagattgcttgaggccaggagttcgagaccagcctgggcaacatagaccctgtttctacaaaaaacaaaaataaaaaattagctaggtgtggcattgtatgcctgtagtcccagctactctggaggctgaggtaggaggattgcttgagcccagttgttcatgactttggtgagctgtgattgcaccacttcactccaacttgggcaacagagatcctgtctctaaaaatgcatgaacaaaaattttggtagcttgtttttcctcaccaattttaagtcacagtatgtagagtatgattagcttttgttttcaggcatagatgataggtttaagacattaaagcattaaagttctttacacatgttgatttttctcccatactttacatggtagaaatatttatgtgatagttgtgtttttttttaataaatgtagtaattataaattgatatttagtatctgagacttaaaaaaatgtataaagggaaggaaaacacaaaactaggaaactagactttccttaatttatataatggaagcctttttacattataaataaaactttttgtttttaagtggagagtacgcaaagaagccatgatgggacttgcccaaatttataagaaatatgctttacagtcagcagctggaaaagatgctgcaaaacagatagcatggatcaaagacaaattgctacatatatattatcaaaatagtattgatgatcggtaagttaaggacactataaatatttggtgactttgaatgttatataacttgatttattgttttatgcaaactattttctttatgaccttacactccttcctcagtttttagtgcaaggtaatggtagtgagtgactgggctcattcccacccaagccataaatgaagcagtaatgtacatataactttagggatgggtacaggttttacgttccattttcatatactgtatttgaacagtcatatctaaaaataggtatgtgtaatagttataattttagttcataggtaattgtgttacaaggatcttcattaatttttttcaaagaaaactttaaaaagctgttgaattttacacatttaaaaacaatttctactgaaggctaaaaaacagtttataaatttatataaaaaacacattatctgaatataatcttaatattttttccattccaggctaagattagatcttgtatggactgcagtcatttattagttaatagagctctaaatcctgcttatagtctgaaatgatttgataggttattagtggagaccaaatgattttgcctgtagcagatcagaatgagaaaattaagaagcaggtcacactaaaattttaagaggcatagatactaaaaactggattatctatgaaactttatagttgtttttataaaattgaagttgtacttcttgagggtatggcatcagtgcacaaagaattacattatgattttgtaggacttttttttagtacttttagccaggtctgttttcatgatgatgcctatgaaaatgcaaaagaatcttaagagtttctttagttttgacttagaaatttagaacttggcatttgaaaggacctggcatattttaaaactctgtattatacagataaagaaaaaatccctggtacataatgtgcccaacatcctgaagatggtagttgtcttagctgggtgtagggctgttttcagtacatccagctaaatcctgttttggtccccttctatctacagatagaaggttttgatttggaaatctcatttccacttagagcggcaggaacttctttaatatatgttctttacatagttttagaattttatatacaactttagaacattagaaaaaaatcaatacaatgccttctctgcttttttgtagactacttgttgaacggatctttgctcaatacatggttcctcacaatttagaaactacagaacggatgaaatgcttatattacttgtatgccacactggatttaaatgctgtgaagtatgtttcaaatatcaaattctgttcttttcatcctttgcaatatattggattttatggaaaagaaactacaaacacctgtattttaaaatgtaatctatgtagtgtaaacattgtttaaagggttatgtcgtagtacttggctattttttcagaaagtaccactttaaacatgagactaagccattacaagcaattgaaaaatagagctgattgacatgaaatcttttaggatttgagttttctattcatattgttggtgtctcaagaaacgttgatgtacctattcttttttatttgttttccttaaggcattagaaacattcatattatgaaaatactacctttttattctcacttggtgtactgatgtgcattacggtggagagcagtaggctgcagattttgtgctgcatagcctgagcagcaccgtgttatagtttgacataagagtaagcacaaatatatttttattaccgcatgtcattcagaaagtacttttgggtgtttaggtaaggtggcattggtgtgttagacatggaaaagacattgctagtctaattgaatcatactaagggttaggaaattgaagtcttagagatttgctttaggttttaggaaatgtagacccttagtattccagcaaatgtagtttacaaatattaagggttaaatgttgagaaatttgagagatctaaggggctgtatgtaattttcatttgtaccactgtttaatgagacttttaacttcatttcttccatggaaataattatattttctgtttatgttttatacagaaatagtgaggacaaggttgtagaggggagaaatacacatttttttttcctacctgctgtatttcaggcactggaatttgtattatgtataactgcttttgtgctacagtggaaaagtaggttgcagagagatctgattgcccacaaagcttaaaatatttactgtccggccttttacagaaaaagcttggcaaccctggtttaagtgatatttttcctgttttacatatgatgaaataaatcacacaaatgttaagttccacagaatcacacaaggaataagagggagccaggattcgcactcaatcctgcttggttccaaagcttgttctttttccactacacgtagtaaaatacattactctcatatttacttttattacttgtaaacttttctctggaattgaaatacatcctaaaattgttggtttgtcatagcctaattggtggctctttttctcatggcaaaattaattgatggcctcttaaattggatgaaatatggtatttatatcatatttgaaactacctattggaaatcatagtaaatctagacttctctactcagcccaactgtcattcaagagtaaaaatgaaatgtcacttttaagcaaaaatgaagaatttgccagtcctacttgaaaaaattactaaagaataaccttattttggtaagaaaggaaattaaatctataaagaagtaataagattcaagaatttgaaacacttctataaatataaataataaaggactgtaaaaacagtaataatacagttttatttgcaaggggtgggagtgtggattaaaaagtaggtagcatgtaggccaatatttagccagtaccatacaccactgcagtactatgtgagatttcctgagtgtccctggaatcctccttcctatggtcctaccatgcctgggcagggctggaatgtctccaggaccttcttgcactgcccatgattctgactggttgatgcctgatgcctttgtgaaaaattttgactgcaggtgggtcctatcagataacagcatgtaaggtaataggtaagtaatgagtatgaaggtgttccaaggttcttttgtcatgttagtgagggcagacatcttgactaactatgttataagtgggcatttaacagtcacctctgaaagcagttaaaatgtatagcttccaaacacagaggaacaaaaaataattaatgaaaactttaataccagaaacaaaatagaaaacaagaaaaataacaataaatacacaaagtatagttgttataaaactaaacatgtcagatatcacttatcacttaaatgataagtatatttgattgaattcaaaagtgaaacagtgccattcacaagagatatattgaaaaataatgccattgaaaagttaaaagtaaattccaatctggaccagtactcaaaaggaaaggctttgattctacaaaaatggttggtgaatgaatggatatttatttgttttaagataaaatatttagggtacatatatatcattttttagatgattttcattttaaccagctttttataattagctgaccaactattatacttaccagtattttagtactttatatttatctgtggttgttttctccaaaatccattacctttttaattatgtaataataaagaaatcacgtatatatgttatgaagcatagtaataaagtaaaaatacctatgaatctattacccaacttgtaaacttttctcccattcatcttcctcccagaggtaacctctacccttgtttcttgtttcctttaaaaattttttttaacatatacatgtatatgtatgtgtatatatgtgtatccctcagtaatatatttttgcttgtttttgaactttatgaaagaaacaattgtgtatacagtgttgtgtgtctttttttctattctatttccaagattcagtcataatattatacatagctgtacctcattcatttcactgtgctatagaattgcactatttcattaatccatgatcttattccattattttgatatgagaaatttgagtcaatgcagaaaatggatgtctgcattacttccttttttatttttttactatttcaaataatgctgctgtaaatacttttcaatttaatatacacatgcaagagtttctctgaggtatgaatatgagttattctcaaatttagctacttattgaaatcaccctgggaggtttaaacaattgacaactaagtccctccttcagagatagttacttcatttgtccggagtgtagtctgggcagtctgatttttagaaaagcctttcaggagattttaatgggcaaccaaggttcataatcactagtatatagctaggagtggagtttctatgtgccttttcatcattgtaaactagtgtcaaattgttttccaacatgattatactagtttatactcctaccagtggtttatggatttctacgtcctcctgtgtattatcagacatttaaatttttcctaatcttatgagtatcaaattttcttatctttaattttcctgaatgcaggtaatattgatcttttatagttttatggtccattaatgttctgatttcaccacactccccactactacgtattgcaacacctgttcctctttatgcatttaaattacattctagtcctgaagtcatttgaatatatgactttgacttaatttgaaagggacttaaaaatagctgcttgtcaggcatgttcctggtaagaacttgtttggttagaattcctcttatttgttgaaagagccatatattttattctctgactacttttctttggggaagacaaagtatttcttagatttcagactttttatgtgaatcagtttttgaataagctcctaagtaaactaaatatcttgattattgaaaaagagaacagtgtgtacttccacctctcacaagttccccagaactcctattagcgacagtagtagaagatggtatcggggtctttgttgtgatcttctcttttattaaacaagtttgcgtccaaatagctttttttttttttttttttttttttttgagatagagtccgatgggtgacttgtcagttgggagctaaaggttagaggacaggtcctcttcaacatttggacaggccactgactaaaacctgatggtagctgtctttttctttgagttgctgcaaacttgtggtttggtaacaaggagatttgtgggaactaattgtctatttaaaatgtcaggtaacaaatataagaatatccaggctgtaactggagttcttacatttgcttagcaacagaactgcaattcagactaatattaaatagagatttttcctattgtaatactgcttttcctagtataacttttttcccttttttagagaattatttataaaggcaataaacaggcacagattgccttgctggttaatacaattttattaaaatacttgaaaggatagttcctataaacatgttataatacaagttcttagagatggtcacttttttattttatttaagctatagccataacaggtttataatgggctttaaaatagcttgacatttcatctttaatgagtaatttcccttttattttaagtgaaagtaagcttcaaaatctaggcctttcagaagttagaatgattgagcatataggaaagagagaatacattgactttggagttcagaagtaattttacaaatgactaccccgtttctttgaaaattattttaatcttacaactcttgttagatttttagtcctctggagtatgaacattttgctttcaatgtttatattcttgaactgtgcttatgaaaatttatacaacttagtaactttaaattagtaaagtatagctatttaaaatataacttctaagatgaaaatgtcctaataatgttgcttttgccagtaccattttgacgtgactactataaaggaattcaggtgtcccaaatttgaactggtttatctcctttaaaaaatccaaaggcatttttcaaacatattgttaaagggcagaattaaaatattaaacgatgttctttgtctattaaaagaaaaagagtttcttatatgcctctgtgttactgctttttggcagtgcttcatatgtatggtaatagaggttaatagaagtgtagaataattgaaaacaaactgatgaaaagttttccttgtttttggagatttccttaaaaatttttaattgtgtggctctaatctgtaaccaagtgtttcattaattattctctatatgttaatattatttatatattataatatattaaacgacattataatacaatattgttgcttatatatcgagtacctgtatgatttttttagatttaaatttctgcctgagaacaatacaactattaagagaacatcagagtttttgacatataaaaatattcacttataaataattccagactgtttacaatttaaataagatttgtcttaagaaaaagtatccccattctctcataactaattcttctttttatgtttttgattccatttcatccttcctgctacaacaccttacgctgtcagttattcctttatttctcaaatttataatttctccagttaattcctaccctaattcgaccactgattatttcttttgatcttgctgtgttatatttgattccattctttccctctacacattatcagttgcttagtcctgtgaatttcatctcatctctgtcatctccttttataatttgaaccttaaattatatagtagtaatattctagaaagatttttattctgttttgttatttaaatgtgtatgtttgtgtttttcagagcattgaatgaaatgtggaaatgtcaaaatctgctccgacatcaagtaaaggatttgcttgacttgattaagcaacccaaagtaagtaagaattttttccttcaatgttttttaaaacacatgtattttaattactatttaccattgctgctatgtgttaaacaattctttctgtttgcaaaagttctgattgtagaagttaggattccttgtttagaaaactctgaatttttaagaaacttattagatagaaagtgataaatgtttatatctgcaaaaggtaatacccaacattacagagagtgtgggtctgtgtactcaaagttttttggtagctttaaaataaaggtgtaacaataactcagcattattgaaagcatagaaaatcgaaagaaattgcactttatgttgccactctaagatgttccctacttttttgtatatgcttgtggttttagaaagtttcaataattatgtaattaaagttaggtatcttgatgtttttacttaatatttatgaagattttaatgtactacctagtatttataatgtaatgatggtattcatccattggatgtatcatattttatcttttatcaatcatttagaatgattctagggttttttttttttcattgaaatgctgtatgtagacatgtaaaaggcataattcatctaaaaagcagtgcgcctggtcattttaaattgccttcagggaaaacaagagtattcttttttctttttcagtttagagtgctttttctcaatctcccttccacacatacacttcataggacagaggtcaatggagcagtgttgttttcatctaaggggtgaaaactttcaccttttccctaggcataaattcaccaattgctctacaaatcaaaaaactcacaccatttgagtggtttatagtgaccctctcactatttttttaaaccttcagatcactagtaataagacattttgtaccaccttttttgcctaattgaagctcacatttgagtagtatttttgttttataggttaacaatgacctctttgtgttttattgaacataaccttttttctgtgattattgagtttatcgaacctgttaaaatatgttttccttgaaaataaatgacttaaaactgagtgattttgctgtcctttttcttaaaccctgttaaattagtatgtttagccaataagcatgtttcagttagtgtcataatgtaagttagtgtgttttcattaataatctctggataaagtgcctctctttgctacttggagctctgtatatttacctccttctggccagagatgtaagagtgtttattaaaattttaagatgttcttacttacatgtatataaaattatttgtgtttaggcattatggaaatcataataacatccaggtagtatgttaagtgtataaatcatatgttgaacagcatgatgtgtgagattgtaatcaaatataactttgtttttgattctcactgttcctctaaaatttatgtatttagttggagcttcttcattttgcctgttgttaaaaattgggagggtcttagactttcctgctgagtcatacatgaaatcactagatacagtctcaattcagctagaatgttttagttcttttctacagtgtggaattttctttttgcttgtcttaaaataattacccagttatccacagtaaagatggagttctcattcatgtgtgatggttttgaaaaagtaacagaatggaggaggatagcccagcaccgctttgttccccccaaataaaacagcaacaatagaaatcttacatgtttctagacagctgttagatgctttaaattccaaatagttgggaattaattcttgaactttattacgctttaactctcagttcctcttagcaagctcattctcaatagggatggtctttttgtgtatttatttgatttattgctttcagttcaatgtttatttagctcagtactttaaatacacttgctcaatgactttttttgtttctggtttttaaaataacactactctgatgcagtgaataattagcactctaagaaacgtcttttatacatgactttacatgcagtagtacatgaatgtattacatatggtataatgtaatgaattaattcactgaaataacacttccctgatgcaacccgtaactaacactcttagaaacgtcttttttacgtgtcagtcacatcttaattgtctttctccagtgtcttccccataagcttcatgaccatgccttataattctcaggtctaaacattgtaggagttttccctgttctttcagctctaaaaaaaaaaaacaaaaccccaaaatacgtacctgttacaaaatgtagtgcagctgtctgatttctgtttggaggctaacacaacagggtgagggaagacatgattaaagtagagaaggagtttacttctacctcctgtccagtttatctagagtttaataaaaatagatgaagaaggtgacagtagtggtaagagcatgggtctgcagcatttagtgggttatgcttgtctaattttttgcagagtatgatgaagttttcttgttagggaattttaattttgcatttttttgtgtgatttacagacagatgccagtgtcaaggccatattttcaaaagtgatggttattacaagtaagttattttaaaatctgtataaaaatgtaatttttattggaacattttttataattttaagtgtttcatgcagttttgttataggctatgataatataggaattttaaattttctttagtgtcttacatgagctagagctggagaaaggatttagtacataaatttatttttaagagtttattgaaatcatcatgtaaacttataaaaactgaatctgtgtttggttttgcttgctctaatgtgactgactgaagctaattcactccaagccaaaatataaaggatatacctaataactacatacgtaacagcttctttgaaaaaatattaatttgcttttttgctttaggtgatgttaagtaaaatggtatttcatttaacagtaaatgcaaaaggattatgtggaacatctcctttgttcagtggaaaagtagggaaaagttgctgtttttgcaggtcatttgcttttcctcccacctcagaggtcactgtgtatagcaaatggatagagggataatcagaaacacctggaggaatacttctgctgaacttccacttggtgataatgaagagatcttaagatggatctgagatgctaaatattccaagatgtgtatgaaagtaatgttaagacactgaagataacagtaaacctaactcactggtttttggattaagtaatgggaatattagaatgagtagaactttaagaccaaaatgttcttctgtcctgggaaaactactttccagtcccctgggtaacttgctaaagcaagttgttttgtgctagtccttttacaaaaaaattaatttgatgtttagaggtgagatcttgctcttttgcccagggctggagtgcagtggcacaatcataactcaaagctatcttgacctcctgggctcaagccatcctcctacctcagcctcctgagtagttgggattccatgcatgtattaacacacccagctaatttaaaaaatatattttttaagagactaggtcttcctatgttgcccaggctagtgctgaactgctggcctcaagtgctgggattacaggtgtgagccacggtgcctggcctatcacctttttatagtttggctatggatactgtctcctaaaagagatcattccctaagttctttttttttttccctatcagttttcttccagtgagttcaatatttcccagattctgttttcaaggaatgctggtatcctgcagttgttaataatattgtgagaaaaaggggtttcattgtcatatatgtttatagaatgctaaattgaaagagttttctttatcccttcttttccctacccccttttgctttttttttctgaaataataggccttattgtagcctttattatgatgcccatccattatgaaggggctgtaaaataacactttccaaaattatttgaaaaaataccttttcctgaacactgttaaactccactgaactactagtggtctttggaacacagattgcgaagtgctgcactagcagttttccagcttgccctcaggtgcttattatgtaaacttataaaaacattccatttatcttctataagtgatcatgtttatctgttgtactataatgtggttctctttccttgcagatttttttctattacagaaacaggaaaaggtcatacagaagtatttaggaggattaatatatttttagattcttaactatattaagtcatttaaatatctcaccaagacataaaatgggatttcagaattatatgtgaacttgaagactacatttactatgttcatattttggggttcactcgaatttctactactatttcgatagtccacagagttctctcttttttttttttttgagacagtctcactctgtcgcctaggctggagtgcagtggcgagatctcagctcactgcaacctccgcctcccgggttcaagcagttctctgcctcagcctcccgagtagctgggattacagtcacctgccaccacgccaggctaatttttgtattcttttagtagagacagggtttcaccatcttggccagggtggtcttgaactcctgacctcgtgatcctcctgcctcggcctcacaaagtgccaaagttccattttacaatttctgttattggagatgctatattctagtctggctctctgcaacagttaagaagccaggcaaaaaagataccacagtcaacgttttattagctttcataagtattttgatacatagacacattagcagaatagtataaaaatcatttttgattctgcaaagactcattctttcccatgcagtaatgacttacccagcagtaacacctggataggttgctcagtatatatcactgctagatacatgcatgtatatgtaaactctctgggttggtttaatgataaacagggaaatacaggaaaatagttcttaaaggtaaaacttagtgattaatctcttaaattataagagagcaatgtatgcaacaagctcaaggggacagtaataaaattggcattattcaggttgacatttgatgcctttaaatattacaagggattacttagaagtagccattttagactttccttgcatatatgtcccttcacaatgctcctgttttatatttctagaaaatatatttttatgtgtgaaaattgactgttgaaggtttttcacaatttattttgttaaactaaactgaatttgtacgtaaggattttaaggcaataaaaggaatgaaaaatattgacctattattattttaagaattaaaaaaaattgattttaattgaactttaatttattttaaggaaatttacctgatcctggtaaggctcaggatttcatgaagaaattcacacaggtgttagaagatgatgagaaaataagaaagcagttagaagtacttgttagtccaacatgctcctgcaagcaggctgaaggttgtgtggtaaggagagaaaagagctgatgtttgaaaaagcccccaaatcttctttattgtttctctcttttataaaagtaatttatattcattatattaaatttgaaaaatgtcacataaaaatgcagataaactataatttctctatagagacaattgttaatattgtggtgtatgtccttctaaaatgagatattatacatacagttttgtacattttactttttcattaattagtcttttatagtatttaatagctccatagcataccactgaatacatgtactataatttgttgagtagtccactaagttacacatttagattttttcctactttttgattactattaagaagaatataattaatatttttacacagtcttgattctttctttaggataaattctaagaagtacaattgcatgggctaacagctcatttttaaagcctttaatatgctttggcaaattgttctccagaactgaattaattttatgctaatcaccagtaatgagagtgaccattttctcacacacaacaatattggtcagtatcattgctggaaacaaaacccaagtaaaaacaaagaaaaacacaattattttgatagtatttatatttgttagtcactagtcatctgaccatttttttctccttgggattattggccattcatatttcttttgtaagttgtgtttataatatttgcctagttttatagaatggtatttatcttactgatttgtgagtttgtcatatggcatttgctaagttgcagataattttctgtcagttttagtttaccctttctttttgtttattatgttctttacataccatagtttctatctttaggtaagtcagtattttcctcatggtgtttggctttgctgtcttgcttatgaaatcctattctgttataagtcaatgaaaatatttattgttgtcagtgattcttaatctgttacctatgtaccttctgaaatgctttttagagaaagatgattcttgacttcaccccagatcaactaaatgagaatcttcagagttaaatacaggaatctatagttttaacaagctcttctgataattttacttcctcaagtttgtgcatccagtgactcttggttttattcatttgtatttttattcttttggaatatttttgatgtaatatatgagacagggaccttactttgtttttattccaaatgtctatccagtaatttcaatacagtgtattgactagtctaccttttccctgattacttgaaatattacctttttcatatgctaaatccttaattcagtctttttttctgggcttgttcaattcttacagtttgtttattccagcgtcagtactacatggttttaattattgttggttcttaatattttaacataatgatttgtttaaatgtacttttgtaatactgaaataatctgtattacagcgtgaaataactaagaagttgggcaaccccaaacagcctacaaatcctttcctggaaatgatcaagtttctcttggagaggatagcacctgtgcacatagataccgaatctatcaggtatttgtatataaaatactaagttctcattgctgttcattaatgtgtacattcaggaatcagtcattgttgagtgcctgctatatctagctacacatctgtgtgtattgtgtactcctctgtatatactcctctgcatatacctgtatttgtatatgcacacacacacacacagacacacacatatatatatatacactcatctgtacctgtatatttgttgttattcttgttatttatcttaattttaaggattggttcaaattgtgtgagaaattgtcaatctaagcctaattttatctgttaacggtataccagacactctttgtttttgttaacttgtatagtttaggtaatataaataaattttatttatacccttgggaaactaggtgaatctgttgcaaaggaacaaatgatacattttcacagataatttgagaactgaaaatgttgttttttaaaacaactctcatttaaagtttcagctttgatactacctgtgagaagttggaaacatttctttttatctctgcattcccttttgtgaaatgtgggaagaggtgtttttttatttttaaactttccctaaaatgttttcctctgactgaaaaaataaagtacttatacaatatatatagcgcatactgacttactagttagtcatcagtagtgttctttgaggggtatatattataatctaaaataaataatactaatgattttttcatcttatgctcaaaccctgttggagatgttttgttggggaaggcattgggcgtagcttttggtcattgaccccttgcaaatagagagaccctactttggttacctgtcagtcactttggactcctcttgtatcggttttcatttgaagaggtagttctgaggtttaaaaagcaagacaagaagtagaagcctctatatttgtaagaggaagactctgaatcagacaaatttattaagtaagtaatctcatgccttctctattcaaggcagtactctttaggtactggcaaagcatagtgtgctgttataccttctgtcagtagtggaataaagatttcaaatcaggagattatattgtagttcagtaagattattgcaaatagagttcacagtattgaaagaggatatctctaagggataatatttcacctaagaggggagaatgggtaagattctgtttttatagaagtgccattcttgccattgaggttaacataaattaagctaatttgatagtaaagaaaagggatatttagaaaatgattgccatctatttatagtgtaatgtggcatcatataaaactgttatgagatgatccttaaaaagccagatggggagcagattgtgaaagcctttaacattgagcttccttttactttatctgttgagaactatggatgattgagatgatggctaggaggagggaagtagaagagatagattgccaaggtgttttaattgtctatggctagtagtggaatggaaaggagacaacgtacttgaaggaaattttaaaacaacaacctaaaaaattgccagcttactgggtatggggaataaaggcaaggaagaaccagaaatattaggattcaagtccaaatgatgtggagaatagtagtaccttgaaaagaatgaaaggaactgtttttgaaggaggtgagagaggttgtgcttcctacttgtacatgacaaacaattaaaaaaaaatcaaggcctatcaagtttaatgtgaaactatgagaatggattaatctgctcagattgtatagaaagaagtaaaaagatcatagacagaactttggaaattttttttacagtagagaaattgtagaaatgtaagaagactaggttattgtaatgttttgagttaagatggaggaggttttcagaagtaaagtatattgtggacaaagagactgaaaaccaggaatagatcttggctttaggaatcagaaggtcatagtgatctagaaggtatgtcaaaacataaacaataagaacaagtagcagttagtgctttataatgtgcctggtgttattctaagaatttatgttttaactaacttctttctccaaggataggaactattattattcccattttacagataaagagcagtaaattgcacatagggtgagtaaccttctcactgctggagtgtggaaaacagcatttaaacctaggaagtctgtctctagagcccacttggttaaccactacactgtacagaaaaattctacttttagtcccctatagtagtcagtgaatgtccatttcatctgactcttcccaacagtgactgttaatcttttcaatatttgtcattttataggtgaatgaagagatgtaccctttaaaaaaaatttttgtgtttcaaatagaaaagttgagcaattattaataaggttgaactttttttttcatttatgtcttggctaattttatccctttggagaatgctttttatttttccatagggactcagtgaaattgtctttttcttattgattataagaatgctttataaaacaaggctgttcacccagttgaatcaccttttaaatctctttgcaattaataaatattacattgtataattaaatgtcagtcatttcctttgtggtttatttcagcctttggtatcatattaatagctctgcttttttacatttacatctgtaattagtctggaatttagtgtaaggtggacatagagacttagtctttttttttttttgagtaagtctcactctgttgcccaggctagagtgcagtggcttgatctcagctcactgcagcctccacctgctgtgatcaagcaattctcctgcctcagccttacaagtaactgggattacaggcatgtgccagcacatccagctaatttttgtatttttagtagaaatggggtttcaccgtgttgcccaggcttgtcttgaactcctggcctcaagtgatctgcccgccttggcctcccaaagtgctgggattacaggcatgagccactgtgccccggccttgacccagtcctttttacacttgatcctagccaaaaggctgagaagagatgacccagtctttttcaaaggcacatggtagatagttgtatgaactccatttacagaaaaattgattctcatttgatttgaggtgttcctttattatagcgtaaattcttacatggtttggatccttgctggattccctttggttctttagtcttctgaggttgtgatacattagaggaagttctttcatccctccttccgtaaaatttattggctgttcctaagcactaattaattcttccatatgagacttagtatgtacctgtggaatcttgtcccataccaaatgacatagagattctgtacattacaactttttagttatgtttttatattttgacttgttattgtgaatagatttcccctctctgtttttttaggtagtttttgctgatacagaaaagtgctattgatttttgagtgttttgttttactccactgaattcttagtattttaaaatagtttttcagttgattttctttgatctttcaggtaggtgctttcccatagattttcgtatacctggctgttagtagttcagttgtccttcctcagaaatccctttcctaattaccctggctatggaacttttcttcttgttgtggcctttttttgtagtccatcttgttctctgatgatctttttaatgtgtttgttaacttattttttacttgcttcacttcactgagagcttcatactctcagtcgtggaagaaaatgagtttacttttggaaatgtgatagttttcattcctgcgtatatctaggttaaaaaatcttggggctactgaaaatatggaaaggattcagattgaagatttgtatttggaatagttggagataagagaataagctgattagggaaaatgagcagaaaaagagaaaacaccctcagaaataccaactgttaaagagatgatcaatttaaggggaccctataatggggacagatatatttaactcctaacttgaccttaaatttgaatatataatattttcgtagaagcatatttactaaacattttaaggaacattgaataattgaattttcttgtattttggtatgttttctgtctctggtggtgttttttataaaaaggacaaatacatacccatcagtataaatgattattttagataattgtcaatgcattacaaatgtttatttatatttttagagatagggtctcactctgccacccaggctggagtgcagtggtgcatcatagctcactgtaaccttaagctactgtgcttaagtgatcctcccaaatagctgggacaacaggcacacactaccatgccaggctaattttttaaattttatgtagagacagggtctcgttatgttgctcaggctggtcttgaactcctggcctcaagtgaccctcctttttcagcctcctaagtggctgtgtttacaggagtgagccactgtgcctgggtacagatgtttattttaaaataacaagcttggccgggcgtggtggctcacatctgtaatcccagcactttgagaggcaaaggcgggcagatcacttcaggtcaggagtttgagaccagcctgaccaacatggtgaaaccccgtctctactaaaaatacaaaaattagctgggtttgttggcgcgcacctgtaatcccagctacttgggaggctgaggcaggagaattgtttgaacccaggaggcggaggttgcagtgaaccgagatcacgccactgcactccagcctgggtgacaaagtgaaacttcgtctcaaaaataaataaataaataaataaataaataaataaataaataaataaaataacataagcttgtttttattagaagaaagcttgaaaacatcatgtttccttttgatctattgtagttccttttctgatgttctaatgaggttttattgtatgtctgttacctaggattcttacaccttttaggaggaggcctaggtatatttctgactttgacagctgtgcgtgacacacagtaatatttggtaaatggtttggaagtgtttaatgtttcctttatcattttttatttctgtgtatattgttctacttactggactagtgatcagttttagataattaaaaataatttgtcatttatgtgtttgggctcagacctgccatggaaaagatgataaagatattgatagcattaataaagagcaaattgaataacattttgacctcatttgaatgggcaagggaaaagaattgtttttgaaaagaagcatctgaaaatactatagttgttttgcagtagtgttaaaaaccagctatatcaaatttgtatttggttcggatatgtatatatgtatgtgcacatatatgtaacacaggattatttttcttagacattgctagtaacatttgaaaaaatgacttttttggtcatattttagtgctcttattaaacaagtgaacaaatcaatagatggaacagcagatgatgaagatgagggtgttccaactgatcaagccatcagagcaggtcttgaactgcttaaggtaagtatctatttaaaattaagtgcctaattagatatctgtttaacatatacagtttatattatttgttcttgatgttttcttcttaagtttgtataatccaaagtaaaattttctcagttgttttagatgatttagaagttgtatatttattcttacatgtaatctgattattttggggtttaaatgctgtaatctagcctagtactaattatattaaaatagtggagtataattcagggtgtcattagtgagcaaagaaggtacaactctgctgtagaatgagccaaattctttctaaaactcttatttttttttgtttcataaaatattctgtcttttactgattgtaaaaatattaattcattattgacaactttagaatatataaaattataaaaaacataggttgatcatacataaacattagtttcttttgtttccttttaatcttcaacaaatgcatagttgggatcattgagatcaaactgaatatacaattttgtatccttaactattttcccttattaaagtataagcatttttctcggtgtttttcaagagtttttttttttaagagtgtctaaagcagatctggtttttggctgtcatctagtagctgtctgcctttgaccacattacttgcctcatttcctcatatgaaatcgagataataataaagtacttgtcttgcaaaggacgttaaagcttgtacatgaatttcttagcaccatgcctagctcatagtaaaaataataataaacatttttgaaatggtgattagcccatatttggggcatcatactatcctaccgaggtaggaggcaggactggactccagaggcggagctcagatacaggaccaaattgaggactagctaaaacaagggcgagatagaagcagctttccagaagacatgcccaccaatgtgccttgtcagtttaccattgctatggcaataccccggagttactgtccctttccttggcaatgacctgatgacccaaaagctactccccgttccctaggaatttctgcataaactgccccttagtctgtatataattaaaagtaggtataaatattactgtaaaactgccctgagctacaactctctgcaccctacctatggggtagtactgttctgcagaagcagtcatagaggtgtatgtaacacctccggagcagtaagactgctgcttcagtaaagctattttcttctgccctatcactggcttgcccttgaattctttccttggcaaagccaagaatccttgcgggctaatcctcactttgggactctcctttctctgtatcactagtattttcctattgttgaatattttgatttttctacttttattcttacaaacaacactaaggtgaatgtttctatgtaagatctcttggtaatatcttattttttagaaaactgggagagcattactgagttaaagagagtgaccactttcaaaattcttggagcaatatatatttaaattgctgtacagggaaattttaccgatatataatcccatcagtagtatgtgaaggtacccgtctttttaaccttcaaaatatggaatataatacatttttaaaagatttgcgaatctgataagcaaaaataatgttttaatttgcatatttaatactagtgaggtccatatgttaatcatttgtgttttccctatggtcatttttatcctttgctcatacatctactgacatctctatcttttgtttttttttaaactgatttaaataagctttttatttcctttgctttttcctgggacatatttgatatatgtacaaacatgtattctcttatatgtaaattatgaagtgtagtaaccaagtgaatacaagtgaaaagtaaatagagtgtcaaattaaattgaatattaaaaatactgttcaagttccctgagtagtcttttttcttgcctgcttacatccccttaccaggtatcattgtcctgaattttggatttattattctttcaatattctttatagttttatcatctatgtatgtatctctaaataacatgttgcttattttgattattttagaaacttataaatgtggcattatacttagtatatttttctgctgtgtgctgttttttttacattccacatttgattccttttgtttattttatgctttaaaaaaccctatcttatacagagggtttttgttgtttttattttttaaaatcttaaacacaacccatctgaaatttattttgaaagtgtgttgtgggggcaaggggtctaatttgattttctcccaatagctattcagttttcccaggactatttattttctgttgacttctttgtaatctcttacaatttatataatctaattttttatatattctagagtctacttaactgccttacattttctgtttcatgattattctaatgttcgtaccattgtgatttggacattggaactttatagacttttttactgtctggtcagtctagtttattctcctcttcttcagtctctgctaatgatgtttattgagaagatgagagatgttttgttaaattctctcttcatgtccccttttctcctctcattccccaccaaaaaacctgaacaataatcaaaatctaaattattttgattaaaattatattaacatgtaatttaattttggaagaaattacttcattatatcatacaatcttcctacagaggaacatttctgttacatagttgagtatgttttaaattttatttatagtgctctcagattttggtcaacataattttttttaatagactttgatttatagtatttctaatatgtaatattttggatttgtattataaagatgaaaaagttttacaaatcatttttatgattcattttataggtactctcatttacacatcccatctcatttcattctgctgaaacatttgaatcattactggcttgtctgaaaatggatgatgaaaaagtagcagaagctgcactacaaattttcaaaaacacaggaagcaaaattgaagaggattttccacacatcagatcgtgagttgagtttattttcaaaaatattctggacatcagaaacataattatttcttgatttatgcaataattgggaatctttcaagttttgaggaaaaactgtctaggttatcttaagtctgtaatgttcagtttagattctcctttcctgggagaaagctttgattggtattttagaagatgcatgagtgtgggggataaacatggcatgtctttctgatgcatcagttagatagtccctggtatattatggcatagaataaacaattcatatgaatttaaggtatgatgggaagtttcaaaggaatttcatcaggactatccataatattctttagtttcctctgtgatttagggctgaaacaaaaaaaagtcggaagcagtgctttaattgacacagggaagtcgagaagcatggaatacttaccttaacagcagtgcaattttgtctgtgttccagtatttcccataattgcaaattgagctgttatcctgggataatcatagttcaagattttataatcagaagaataaatcttcatttcttacatggcactgcttacttctctatgtatatctcttcttctagttcttggagagaagatggaataggtggttctgatactggcgtagtcataggtggttgctttcacctctacctcatcacttctggcttacccattagtctggttagttgtgattggggtaccatgcttttatatggagaagaattgcctatgggtcttttccttagaaagagactgggagtaaagctagctcgcaattagagtttcaggtataatttctgttattcctttctgttcatgtgtactttattctagaaactgctgataaatagaacaaaggcattattattattttctttttttctttttttttttgagatggagcctcactctgttgcccatgctggagtgtagtgtggtgtgatctcagctcactgcaaccttcacctcccaggttcaagcgattctcctgcctcagcttcctgagtagctgggattacaggcacacgcccccatgcccggctaattttttgtagagacagggttttgccatgttggccaggttggtcttgaactcctgacctcaggtgatatcacctgcccgcctcagcctcccaaagtgctgggattacagacatgagccagcgtgcctggccggcaattatttaaatggtaatagaaacctactaaaattttataacagtctctctggcaagagtaagaaaccttattatttggaactgacttgaagtcttactctgtcacccaggttagagtgctgtggcgcaatcttggctcattgcagcttctgcctcccaggttcaagcaattctcctgcctcagcctcctgagtagctggaattacaggcctgcaccaccacacctggctaatttttgtatttttaatagagacagggcttcaccatgttgaccaggctgggctccaactcctggcctcaagtgatctgcccgcttccgcctcccaaagtgctgggattacaggcatgaaccaccgcgcctggccttgacttctaatttttaagtaatcccagagcataagcttccctttggatggtgctatggctctcctagtcagatcagagatgagagtttggttgtatgtatgtgtatgtgtatgtgtgtatttgtcgcacacacatatgtagtacgtatacatacccactcattatgtataaactgtatataacagtataccatttgctgaatgcccacttactatactgtctcatttaaacattgtaacaattcagtgaagtgcggttattatcctagttttccaaatgaggaatctaatgttcaagtggtaaatggacccaggtcatacagctagcaagtgacagagccaggatttgaatttaggcctgtttggctccagtgcctatggtgcgatatccattacagcagtttcttttctaattagagcattgacaaagttcaaatttggcttattccctggaggttttattattttcattctagattgtttttccctagtaacttttatattttaaagaaacatggtttgatatatttgtagaaccacaagaacagggtcaaaaggtggacattttaaaatgtacatggagcattttaaaatgtattgctttaatatggaactgaagtatttaaaatatttgatttatatactgaatatatttcagatacttctcatgaggagaattaactcagctgatactgaattcctgcagtgtgcacacactgttgttgatgaaataactcataataatttcttccaggagataaactatgtatgtagatttaattttttaaattattaaattgggtgagttgattttgaggaaaaataatatagttaagagaatgttgattaaactgtcttcccttgaattcatcaaaataattaaaaagaacctaaagaaaaatgtatctaagtaaagctaccaccaactggacagaattggcaccagatgtgcccttaagactctattgaaagtgagagcactgacaagggatatgtattggcagtgtactgtaagtgtcctattatttgctaatttagagggaggatattgctatatggacacactttaagagaaagaaagaaaacctgattttagctgtactaggactaaaggagaggctttgtggtcatagtatttttctttaggtcaacctgtttaccaggaagagcaaagtttagtgatgaggtaagactaaggaaaatcatgaaggaaatatctttttaccaactttacgggaacagaagaaaattatacgcttaacccattaaacaaaaaatgaagatgagttatggggttccataacgatgagttatatgagttccattgtgtctcagcttgtctctcaggagtctgactcccctaaaagtagttagatgtgccaaaactgaggatcctgtcataacatgtgatgtacccatagctcaagtgactggttcttatccttgtaagagttttaacaaatttggagataaattacacagagaaaaaggacttactacctttagtcctaactctcattcctatgctacttagccaggtgatgaagcaactgtagcctgagttgggagctttgatgttaattttttaaagaagtgttcagtcatccgggagatgctaactatacttttgtttaaatagcaaagccagagagaatttttcttattcaaagatgaattaacagaatacagataagcaagttaacaaacacaaaacctatgtaaatatcttagcattccaaagtaactgataagcaatacttaaataactgtcttagttatttaagctgccaaggaaggtaaacagcaaatgacatgagagaaaaaagataacaaaaatgaagtaatacatgaaaaagagctaaggatattgactatagaatataatttaatataagtagcaaggagcagaataaacaatgtggaagatggaatcagtaagctagagatttggcttgaggaaatctgcatagaatatagagaaattggagagaaaaaatggagttaaagggaatgaattgcagatagtgaaaaaccataattgacatctttggagaagacagtagaataatgggaaatggaaaatattcaagaaaataataataaatttgttctgaatgatttaaaatatgaatctggaggtgaagactcatttttggaaaatatactggtgcagtttgctaaattttcagggattgcaaaagtgatttcacaaatatcaagaaaaactagttatatcggggaacctgccccgataatcatgtaggttcttttctatttttcctaagcggcggccggcttgagaaataaagggacagagtacaaaagagagaaattttaaagctgggcatccaggggagacatcacaaattggtaggatccgtgatgccccacaagccacaaaaaccagcaagtttttattagagattttcaaaaggggagggagtgtgtgaataggtgtgggtgacagacatcaagtacttaacagggtaatagaatatcacaaggcaagtggaggcaggatgagatcacaggaccacaggacagaggcaaaattaaaattgctaatgaagtttcgggcaccattgtcactgataacatctaatcaggagacagcgttttgagatcaaccggtctgaccaaaatttattaggcgggaatttcctcttcctaataagcctcacaggaccacaggactgaggcgaaattaaaattgctaatgaagttttgggcaccattgtcattgataacatcttatcaggagacagggttttgagatcaaccggtctgaccaaaatttattaggcaggaatttcctcttcctaataagcctaggagcgctatgggagactggagtctgttttagctctgcagcctcaaccataagagacaggcgcacctgggggggctgtttataagcctatacctccaggtgcgtattctctttctcagggatgttccatgctgagaaaaagaattcagcgatatttctcccatttgcttttgaaagaagagaaatacggctctgttatgcctggctcaccggcggtcagagtttaaggttatctctcttattccctgaacgattgttgttatcctgctcttttttcaaggtgcccacatttcatattgctcaaacacacatgctatataatttgtgtagttaacacaattatcacatggtcctgaggcgatatacatcctcctcagctgacaggattaagagattaaagtaaagacaggcataggaaatcacaagagtattgattggggaagtgataagtgtccatgaaatctttacaaattttatgtttagagattgcagtaaagacaggcataagaaattacaagagtattaatttggggaactaataaatgtccatgaaacctttacaatccatgttcttctgccatggcttcagctggtccctctgtttggggtccctgacttcctgcaacatagttaggtcagcgcagtggaaaataatgaagctggctgacttcttttcaaaccacacacaatttctgaagttaatgattcaacagctggagagttctgatggaaaaaacagtataactaaagaatttcctaggcagccctagctacttttaagtaggggcaaatgaaggatattcttaagtatacaggactcagtaaatgtaccaccccttttttatcatgaggttaccctgtctacatagttttatgcttttccgtctggaactcagttttgcttatgccctctaaatctagattttgtttcctttttgtttgtatatctctgatttgtctttgcctatcattttagtttaattatttaacttttagatatggctatgtaaatgtatttgaaaacctggatttttaagaatgatgtaaataagttcaagatgaggaaagacaaaaacctaacagactctagttataaaaaaattgaaacattattcgctaataaaaccaccagtgtagctctccctctccctctccctatccctctccctctccccacggtctccctctccctctctttccacggtctccctctgatgctgagccaaagctggactgtactgctgccatctcggctcactgcaacctccctgcctgattctcctgcctcagcctgccgagtgcctgcgattgcaggtgcgcgccgccacgcctgactggttttcgtatttttttggtggagacggggttttgctgtgttggccgggctggtctccagctcctaaccgcgagtgatccgccagcctcggcctcccgaggtgccgggattgcagacagagtctggttcactcagtgctcaatggtgcccaggctggaatgcagtggcgtgatcttggctcgctacaacctccacctcccagccgcctgccttggcctcccaaagtgccgagagtgcagcctctgcccggccaccaccccgtctgggaagtgaggagcgtctctgcctggccgcccatcgtctgggacgtgaggagcccctctgcctggctgcccagtctggatagtgaggagcgtctctgcccggctgccatcccatctaggaagtgaggagcgcctcttcccggccgccatcccatctaggaagtgaggagtgtctctgcctggcctcccatcctctgagatgtggggagcgcctctgccctgccgccccatctgggatgtgaggagcgcccctgcccggctgcgaccccgtctgggaggtgaggagtgtctctgcccagccaccccgtttgagaagtgaggagaccctctgcctggcaaccgccccatctgagaagtgaggagcccctccgcccggcagccgccccgtctgagaagtgaggagcgcctccgcccagcagccaccccgtctgggaagtgaggagtgtctccacccggcagccaccccatctgggagggaggtgggggtcagcccccgccaggccagccgccccatccgggagggaggtgggggggtcagccccccgcccggccagccgccccgtttgggagggaggtggggggggtcagccccccgcccggccagctgccccgtttgggaggtgaggggcgcttttgcccagccgcccctactgggaagtgaggggcccctctgcccggccagccgccccgtccgggagggaggtgggggggtcagccccctgcccggccagccgccctgtctgggagggaggttggggggtcagccccccgcccggccagccgccccgtccgggaggtgaggggtgcctttgcctggccgcccctactgggaagtgaggagcccttttgcccggccagccaccccgtccgggagggaggtgggggggtcagtcccccgcccggccagctgccccgtccgggagggaggtgggggggtcagccccccgcccggccagccgcctcgtccgggagggaggtgggggggtcagccccccgcccggccagccgccccgtccgggaggtgaggggcgcctctgcccggccgcccctactgggaagtgaggagcccctctgcccggccacgaccccatctgggaggtgtgcccagcggctcattggagatgggccatggtgacaatggcggttttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctgtgaccttacccccaaccctgtgctctctgaaacatgtgctgtgtccactcagggttacatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaataaataaatcaataaattaaaaaaaaaaaaaaagcaccaatgtaagttgtgtcttgagggagatatttcaaatctataagaaaccaggaattctaattcttttaattgttcagagtatagaaaagaaagcactcattttctttacagccaggataactaacatgaatactaaaacctagtaaaagatatcctccccacccacccccccaaaaaaaaacgctaagacaaatcttactaatatgtgatttttgtataagcaagatagtagcaaaaagagaatttaaataataaagcgagaatatattatggccaaacatggttaattttaggagtatacagagagcgttggtacaatattagtaagcctactatttatgtttacaatttattatataagtagggaaaagggtatacaatagatcatttttgatagatgctgaaagggcttctgaatttttttttttttgagacggagtctcgctctgtcgcccaggctggagggcagtggcatgatctcggctcactgcaagctccgcctcccgggttcacaccattctcctgcctcagcctcccgagtagctgggactacaggcgcccgccaccatgcccggctaattttttgtatttttaatagagacggggtttcgctgtgttagccaggatgctctcgatctcctgaccttgtgatccgcctgcctcggcctcccaaggtactgggattagaggtgtgagccaccacgcctggccaaaaaaatcagtctgtttctaattaaatctaataagataggaatccgtaccttcataacataattaatatctctcaaaccaataggcagcatcatgtaaaacaccagtagcattcccaataaaagcaggaacaaggtgagataccacactatctctgctattgtttaacattgttttggaagcattagctagtgtaattatgtaagaatataaaataagaaatacaagtgtgggaaaggaagaagctttcatttttcttggaaaatccaggagaatcaaccgaaaaactactcaaaatggggtagccaaaatgagtatgtaaaaatccaaagttttctgtatataaccaacaatcatttacattattatgggagtaaacatcagaagacctagaagtaaagtatacaagaaatttgcaatgctgtaataatggtggatggggggatataatacttaacaaatacattggtcaggaaaaggtacgttacctagtaaataattagcaagcagttttgaaaggaaaatagaccgcttactttgattttacatatattccagaagaatcaaagacaaattattgcattaagtgtataacatggatttggtttaagtatataacatgaattaaaatactagtaaccagtatatttttataacttccttgtttgtagaggaagggacacttataccaagtcatgaatgaaatattgatgggttggattattgttattattactattattattttgttgagatagggtcttgctctgttacctagactggagtgcagtggctcaatcatggcccactgcagcctcaacttcctgggctcaatcagtccccccacctcagcctcccaagttgttgtgtctacaggcatatgccaccatgcttgtctaaattttgtattttttgtagagacagggttttgccatgttgcccacgctggtcttgatctcctgggctcaggtgatctgcctagcttggcctcccaaagtgttgggattacaggcatgagccaccatgcctggcctggattgtattatttttaaaaaattcatttgttgcaaaaaaatctatgtgttaccccccactccctgccccaccatgtatggtatggttctaggtgtacagtacagttctaggtgtcgaggacattgtaataaagaggacaggctaagtctctctgcccttttattttagtgggggtgaggaaccactatttagataaaagccaaaatcatgaaataagttggaaacacaaatgatatgctggaaaactattttcagtatatattagttagaaaaggttaatacctgcaatgtataaagaccccccccccttttttttttgtttgagacagggtttcactctgtctcccaggctgtagtgtagtggcttgatctcttggctcactgcaacctctgcctcccaggttctagcagtttttgtgtctcagccacccaaatagctgggattacaggcgtgtgccaccacccctggcaatttttttttgtttgtgtttttagtagagactggattttgccatgtgggcggggctggtctctgtctcctggccttaagtaatctgtccgccttggcctcccaaagtgttggaattacaggtgtgagccactgtgcctggctgcaatgtattaaagattcttaatgaaggaataacaaatataaatctcatagtagaatactagcaaagagaatgaacaggaaatttataagcaggaagtcctgtcagccttccaaatcatgaaaagatgcttatgtaatcaaggaaatacaaatataagcaattatgtgatgcaaccagtattagttagcattccaacaatgctgtcttggtgggagtataaaatgatgctatgcttctaggttggtaacgtggtaatatatgcaaacttaaaatgtgtatagtttttggctctgcactttcaggaacttatcccagagataattagaaaagatgtgcacataatctgtcatatagttcagggttcagtcagagaaacaaactatactaggtataaagtcatgtactgcataatggtgcgttggttaacgatagaccagatgtatatggtagtctcttaagattatgatggagctgcactgcacaggggtacaacttttatctttattttttatttttatttatttatttattttattatttttttttaaaatttttttagtatttattgatcattcttgggtgtttcttggagagggggatttggcagggtcataggacaatagtggagagaaggtcagcagataaacatgtgaacaaaggtctctggttttcctaggcagaggaccctgcggccttccgcagtgtttgtgtccctgggtacttgagattagggagtggtgatgactcttaatgagcatgctgccttcaagcatctgtttaacaaagcacatcttgcaccgcccttaatccatttaaccctgagttgacacagcacatgtttcagagagcacggggttgggggtaaggttatagattaacagcatcccaaggcagaagaatttttcttagtacagaacaaaatggagtctcctatgtctacttctttctacacagacacagtaacaatctgatctctctttcttttccccacatttccctcttttctattcgacaaaaccaccattgtcatcatggcccgttctcaatgagctgttgggtacacctcccagacggcgtggtggctgggcagaggggctcctcacttcccagacgtggcagccgggcagaggcgacccccacctcccagacggggtggctgccgggcgggggcgccccccacctcccagacggggtggctgccgggcgggggaaccccccacctcccagacggggcggctgccgggcgagggctccccccacctcccagacggggtggctgccgggcgggggtgcccctcacttcccagacggagcggctgccgggcggaggggctcctcacttctcagatggggcggccgggcagaggtgctcctcagtttccagacggggtcgtggccgggcagaggcgctcctcacttcccagacggggtggcggccgggcagaggtgctcctcacctcccagatggggtggcggccgggtagagacgctcctcacctcccagacggggcagccgggcagaggtgctcctcacatcccagacggggcggccgggcagaggcgctccccacgtcccagatagtgggcggccaggcagagacgctcctcaattcttagacaggatgacggccgggaagaggcgctcctcacttcccagactgggtggcctggcagaggggctcctcacatcccagacaatgggcagccaggcagagacactcctcacttcctagacgggatgacggctgggaagaggcgctcctcacttcccagactgggtggccgggcagaggggctcctcacatcccagacaatgggcagccaggcagagatgctcctcacctcccagacggggtggcggccgggcagaggctgcaatctcagcactttgggaggccaaggcaggcggctgggaggtggaggttgtagcgagccgagatcacgccactgcactccagcctgggcaacattgagcactgagtgagcaagactccgtctgcaatcccggcaccttgggaggccgaggcgggcagatcacttgaggtcaggagctggagaccagcccagccaacacggcgaaaccccgtctccaccaaaaaatacaaaaaccagtcaggcgtggcggcgcacgcctgcaatcccaggcactgggcaggctgaggcaggagaatcaggcagggaggttgcagtgagccgagatcgcggcagtacagtccagcctcggcaacagagggagaccgtggaaagcgggagacggagacgatggagagggagagagagcaacttttatcttttacaccatattttttcagtaccttttctatgtttagatatacagatatttaccactgtgttataattgcatatagcattcagtacagtaacatgtagtacaagtttgtagtctaggagcaataggtcataccatataggtatgagtaggctataccatctaggtttatgtaagtttactctatgatgttctcacaacaatgaaatcatccagtgatgcatttctcagaatgtatccctattgttaagtgatgtatgactgtattttaaacaaattaatacagatgtttaaaggacaaaagagaaaaatgttgcattggtaattcagggatacaaattggtggaagcagctactacctctagagctggtgggataattgggaagaagtaatgttaagaggtggaggagccctgtcagtatcacccaacagactgccaaagtatggcatggcctggctgttgctggggagcagtgaaactactgctcagaacgccttaagaagctctagtgtcttgcagtggaagaaattaataggaaaccagctctttgcagatttacagcttcaggatctctgagcagattatgaaaggataggtttaaagctcagagagagtatgtaaacagccagcacagggatattcatggtattgttgttaaggtgtttttaaaaatttttaaatctaaaatgcttatcagtatgagattagttttggtatagccatacactatacatacactgagagctatgtgactgttaaaaagaatagtgcttagcaatatttgacaaatgaggttctacacacattgttggttgaaaaaaatgtttccaaatactgtgtattttatatccttacttattaatgtctgtataataatatgtctagagaaattttaggagtgttcaccaaaatgttgacaggattgtttcagggtagtgagatgctgagttttttctttagggtttcatgtatttttcagtttgaatgtatttttcattttctatattggtatgattgttatcaaggaaaaaacttgaacttgaaggtagaaagtcaatttaatgagggaataagaaattctttttaataggaaaagcagtcagcataggtggttatttattttcattgacttagtactgcagaattcttaaaattttttctttatgttcattgtttcagtttgttttcttttaaaataactgagtatgtaaaatattggatgagctaaaggtttcacataactatctttaaaaatctcagctaaagttgctgctagtgtgaacaataatttttctcttgattattggggaaagattataggtgtttgtgttatcaaatctgatttatgagaagataggtcttatctatgaagtttagttactgaagtaaccacagaataataatcttttatttcacaaagaaaccacagaccatagactaaaagattagtgttttagttatactaatttttttccacgttatattattgaaattttcaaacatatacagaagtagggagaatacaaatccccaggtattcaccaaccagctttaacaatgaataaacttacagccagctttattttttctgtgcctccacacactcccttgctcctcttatatttgaaggcaaatcccagatactgtcgtttcatctgtatatctttatcccaaacacagttaacactaataacttaatgtccaattggttttctcaaaaaatgtgtttttgttgttgttgtttgtgtcagggtcttggtctgttgcccagactggagtgcagtagtcagatcgtagctcactgcggccttgaacttctgggctcaagtgaccatcccacctcagcctctcagtagttggaaccacagacaccacatccagctaattttttttttttaaactttttgtagagatggagtctctcattatgttgcccagactggtctcaaattcctgggctcaagccacccttcctcctcaaaaattgtttgtttgattcaggatgcaagtaagatttatacattgtgattggttgctgtgtcttttaagtatcttgtttcttgtgggctttctctctagctctcactctgcttgcagcaggaatcaggttgtttctcttgaagagtttcccatagactgatttttgctaattttatcccttagacataatttgataggttcttctttgttgttgtttgttttgatttttttaacagggtcttgctctgttgcccaggctagagtgcagtggtgcgatcacagctcactgcagcctcgacctcctggttcaagcaatcctcccacctagcctcctaagtagctgggactacaggcgcatgtcaccatgcctggctaatttttatgttgttttgtagagacagagtttcaccttgttgcccagtcggtctcgaactcttgggctccagcaatctgtccacctcagcctcccacagttctgggattacaggtgtgagccactgtgcctggccatatttctttattttctctaaaatgatggctgaatccagagacctcattggattctggttcaacttttttatttttacaggactattttataagatttgtatgctttcctgtcaggaggctcataatagctggccatctctctatttatgatgtttgcagctgttgatattagtagtcagtcttgatattcttattgtcattcttcttcatttcctagctgaatacttttgtaaaaagcaaattcttatcgattctttggtttcccagtgttatatttgtttaggaaaggcagaataaatgcttgattttttgaatgttatttagtagtattcaaaataaagaggactagtgtcctccaaaggtgaccagttgagtgtcgtttttaaaaaaatcataacgggtttacgcatatttgtgtttcagtcagttatggtgatcacatgcattgatgcccagattatcccgtgtataatcttggaagcctcttcaagttagtccctgagtcctttgaaacaatcccaataatctctgtaatttctttgctatcttgtatgacaggatattccaggactatcttgcacttgttctgccccagacctggaattggccaattctccgaggggctctggttccttttaatgggaatggtattaagaaattacaacatgagtcctgtgggtactaattgctaatgtataagtcatgactctatgataattcagtagacatagcttttttgaaagatgaaattcatgtttgtttatacggatacttacagttcaaattcaggattacatggtttttactgaacttcaattttacatttatatctcttttttccctcatggcacaggataacaacactataatattacataataactcaattgctttatctcataatacatccatagcagtctcatgatagcagtagcaccaccaatatgattcctaaaagtagtcttttacttttttagctagttcttttttttatttagcatgtatcatattagagatctgcagtcaaattcccattttaaagttatttggaataataattctttgggtggttatgctagcacatggatacatacccttgttcatttgtttcattctttttgagaggtcgctcttttaaaatttaattttgttttttaattatatgaaatgttaaatggctttaaacatatctaaaggaagcaagataaatttcaggaagtccaatcctcaatcctctaacctattcctttcttccctgtagataaacttaaaaaaaaaaaaaaaagcccccttccgtgcacatacctgtctgcatatgtatgcacatttgataaaatgaataagataaactatatacacttttcttcaccttttttctctctaatggcatgcactggcaattatctcatataaatatagagagatccccatttattgtgtggctgtatcataatttatttaaccagttcattatttatggacattgggttgttttcagtattacagtctttcagtgaatagctttgtatttgcgccttttgtgttttttgacagttatctttgggagcagttcttagaaatagaagagtaaatgcatgtacaattttgctaggtattactgtgttcctatccataatggttacaccactttgcattctcactagcagtatgtaagagtgtctgcttccccacagccttgccagtagacgatgttgttatgaaatatgtctcttcctaactctggtcatcttccttgttctgcaggcttttgtgtctgagaatagtgtagccatttgtgcttttctttggtcctagtgtttgtaaggcatatatttttcctttccatttttagtcttcctgggacttcatatttaaagtgagtttcttggctggccatggtggctcacacttgtaaatctccgtgctttgagaatatgaggcgggaggatcacttgagcccaggagtttcaggctccagtgagctatgattgtaccactgcattccagcctgggcaatagagcaacacccttaaagaaaaagtttatttatttatttatttttaaataaatgtcctagttgtctttctgttgttgttttttgtttccttgtttgcttttatattggttgttttgaatccaatttgacaaactgtttcaatgggagtgcttagagcatttacacttactgtaattattgatatggtggggtttaaagctaccatcttgatagttttcctcttctattctttatgtctgctttccttgagattaatcaagtattatgattttatctttactattggtttatctacatccaataaaattatactaatgtgtaaaagctttacagcactatacttccatgcccatttcctccagtcttttaagttttgttgtcttatgttttgtttttatatgttataagctccataatatgttcttgatatttttactctagtgtatctcgaattaataatgacaaatttcttttacacacataataaccatttctgtcacttttcatttgttggatgtctatccatattttcatctggtatcatttttcttctggaagaactctttttaatatttcttgatgtatagttctctttatagtgaattttatagtgaattttttggtctgaaaaagtctttatttttccctcatttttaaaagataattttgcttggaatataattttaggtttacagtgattttcatttaatgtttaaaagatgtcactccattatcttccggattgcagattctgatgaaaagtgttctatcaatccttgttcctctgtttttgcactgcttttaagatttttctgtttttcactaatttttatccaaatgaataataatatgccttgaaatggtttatcttttttctgcttgaggtttattgagattcttggatctctaaggttattttaatcagatttggaaaaaaattggccattattattttgaatactttttttttttatctattctctccatctgccttgttgttttctggggctccaattacaagtatttttgactacttgatactgtcttatagatcacagctgctgtcttactatttttttcttgcccttttttctctctcattttattttgatagtttctattgctgtgtcttcaagttcactgatacttttctcttgcagtgtataatctgcttttaattccatcagtttattttccatttctattgtatttcttatatttagtaattctatttgtgttctttttttatatttttatatctttttttatattttatatttttcatttctagcactgcattcctgatttattctaacttcttgagtctatgtagcatagtgttttttgtaacagctcttttaatgtctaccctaattctatcacttatgtcatttttgggtctgtttctattgagtaatttttgtccaggttgtatattataagggctttctactatgtctagtaggaatgagtaattaaccgccctgtttgtgttgagggaattttttgtcttactgctttccatggtccttttcctggtctcaggtagtttttcctcctaacacgattgaggatcattatccagccaaagactcagggatagcctctgcagattagcagagctcatgctgcctttccctttgtaactccttcctttctggtattgtgctctagaaatcagagcttccttggcctccctgaactctcatctttatctccctcaacccaggctctatttgggtcatttgtactacagcctagaaactatttaatacttccatgcgataagctgggcagtaaagctcttctagtttgtttctcatttatcagggatcacatttctctgctacctgttccctagtgtctgaaacctttagcatatttatctcttctgggcatttaaggcaggagagtaaatagtcttagttacaccattgtaatctgaagcagaagtcctcttgttatagttttttaaaaaaatgtgtgaaggtaaacagtttttcatgcattttagggtaatttatatgtcttcttttttaaaaaaattaaacgttgagttctgagatacatgtgcagaacgtggaggtttgttacataggtatacatgtgccatgatggtttactgcacccatcaacctgtcatctaggttttaagccctacatgcattaggtatttgtcctaatgctctccctccccttgccccccaccccacaacaggccctggtgtgtgatgttcccctccctgtgtccatgtgttctcattgttcaacttccacttatgagtgagaacatgtgttgtttggttttctattcctgtgttagtttgctgagaatgatggtttccagcttcatccatgtccctgcaaaggacatgaactcattcttttttatggttgcatagtattccatggtgtatatgtgccacattttctttatccagtctatcagtgatgggcatttggattggttccaagtctttgctattgtgaatagtgctgcagtaaacatatgtgtgcatatgtctttatagtagaatgatttataatcctttgggtatatacctagtaatgggattgctgggtcaagtggtatttctagttccagatccttgaggaatcgcgacactgtcttccacaatggttgaattaatttatgctcccaccaacagtgtaaaaacgttcctatttgtccacatcctctccagcatctgttgtttcctgactttttaatgatcgcaattctaactgatgtgagatggtatctcattgtggttttgatttgcatttctctaatgaccagtgatgatgggctttttttcatatgtttgttggccatataaatgtcttcttttgagaagtgtctgttcatcttcacccagtttttgatggagttgtttttttcttgtaaattcgtttaagtttcttgtagattctggatattagccctttgtcagatgaatagagtgcagaaactttctcctgttctgtaggctacttactgttcactctgatgataagtttcttttgctctgcagaagctctttagtttaattagatcccatttgtcaattttggcttttgttgccattgcttttggtgttttagtcatgaagtctttgcccatgcctatgtcctgaatggttttacctaggttttcttctaaggttttttatggttttaggttttccatttaagtctttaatccatcttgagttaatttttgtataaggtgtaaggaaggggtcaagtttcagttttctgcatatggctggccagttttcccagcaacctttattaaatacggaatcctttccccattgcttgtttttgtcaggtttgtcaaagatcagatggttgtagatgtgtaatgttatttctgtggcctctgttctgttccattggtctatttatctgttttggtgccagtaccatgcttttttggttactgtagccttgtagtatagtttgaagtcaggtagcatgatatctccagctttgttctttttgcttaggattgtcttggctatatgggctcttttttggttccatatgaaatttaaagtagttttttctagttttgtgaagaaagtcagtggtggcttgatgggaatagcattgaatctataaattattttgggcagtatggccattttcacgacattggttcttcctatccatgagcatggaatgtttttccatttgtttgtatcctctcttttttcattaagcagtggtttgtagttcttcttgaagaggtccttcccatcccttgtaagttgtattcctaggtattttattttctttgtagcaattgtgaatgggagctcactcatgatttggctctctgtttgtcttttattggtgtataggaatgcttgtgatttttgcacattgattttgtatcctgagactttgttgaaattgtttctcagcttaaggagtcttttggctgagacgacagggttttctgaatatacaatcgtgttatctgcaaacagtgactatttgacttcctctcttcctacttgaatactctttgtttctttctcttgcctgattgccctggccagaacttccaatactatgttgaataggagtggtgagagagggcatccttgtcttgtgccggttttcaaagggaatgcttccagcttttgcccattcagtataatattaaagaatgttttacctttttctgtcttgcctgtttttctgtgtttttgttggtctcttcattctccatttttaggcctttacatgttaggaatatatttcttttaatgatacttcacctttggtatcttttgtgagactctactcttagtgtgataagcactgggttggtatcaggcaatgaggaagatatggaagtttcttttgctttgagatgtttgtataatagtttaagagctcctttattcggtattcgttttaaatgtttgagttatgaaataatacgatgcatgaatgttcttccaggtggctatatgacttactcagtacctccctcagaactctgctcacatgtttctttatcagggagatcttctgtttaaaattgtaattctcttatacctccctccctgtttcctatttctatcctccatctttaaaaatttttttctctgtagcagttctcacagtttaacataacatttattttgttaatttatcttgtccctaaaatgctagtagcatcaagttaaatattggagccttttaatagtccctggcatgtaatattgcttaataagcattgtttaatcagattttcctttttgtggtttgctctggcacaaaatgaaaggtgaattggaagaggcagagacttgagaaagaagagacagtgtcagtttcatacatgtgtaaggtggcagaagtttagctggaatgatagcagtaagaataaaaagagagaggcctgttgggagcggcgttaacaggagagtgtgagtcaccagcctgttagtgtttgctattggtgaataaaaagtaaaaaacaccacatttgtatttggattacatttttaatataaatatttataaagcaaaatcataggcctttggaagtgagtttgagtaaatcttggtgactttttctgaccttgtaaatcattacttaaaaatacaaatattaaagtatctagcagaagtcttgttgatttttctggtttattgtttttctttgatttttttttaatagagccttgcttcctgttttacatcacaaatctaaaaaaggacccccccgtcaagccaaatatgccattcattgtatccatgcgatattttctagtaaagagacccagtttgcacagatatttgaggtaatgagaaaaaaattttcttgtttatttcatatgtcatagttacaaaacaaatattgatgattttatggaatgttcacatttggtgatgcatcattttgtaatatattttcagaatttgaatcagtaaaatcaacattgataagtgttaaaatatgaaaatatctgagtattcaaatgtttaatgataacagattcagaaatcaagcattgtttatttttgtacattggtttatatatttgtatttggagactattttttgttaacaggtaattacatataaaatcatagttacagatagtaggtaacagatgattattctttcatttgtaggatcaaaaaatttgaattctgtttgagaaactattgaagtgtaaggttttgtaaatcagtactaattgttaatataaagtaagtttatagttttatgactgacctaattttgtgtcagatataaagtgtcttttcaatatatattttatattattttatccacattctaaataacttttacccaggcattgcaattttattgctgcctattgtaattagaacctaacactaacactgttagtgcaaataaaagctaagcagaaaattcataaaatcctactttgtaattttagttcaagagccttgagtagagtcaaaacaatttagaaattattctgatgctccttgacataagtacttggacttaatatctttgttttagaaagttggtacttttgtcatattttcatgtattatgttaaagacctgaaggagaaagaaaagtagtatatcctccaaacaccatctttcctgtagatagcagataatttaatttttgtgtatttggggatggcggtattttctgtagtctgtgtttgtatatgagaatggcttcaataaattgatgttaatttataggaaagttttctttttggttgctctccttttcctctcaatagtgatgagagaaacactgatataagttgaatttcagagtagttttttcattttgatattgtatctgctgttttatctttacaagaacctctgtagtcctcctcctatgtagcatttggttggctggcttcctgagaaaaggtttcttagaaatatctggcatttttgaggttccactaatctagggcctggccattaattttgctttttagaaatgattttgttatggaaaattaccaaacttataatctaattgaaaaaactacactatgatatttttgtttataatatgaacaataggctggcaagatgtgcaatggaagtactgagggaagtcttcaagaatagcaagaagtaaactcatttaaatgtatttttgactaaatgaagcctcatattgccctaatttgttgggaaagaacagttttgtattggcctttcaagcctacaattcttggtgttcagtgtgggagaatagagcaccagtttttcattaaaatgtggcattaaaatgtctaatagaaaataaattcacttgtttcaacatcagaaggatgcaaaaaagaatatacggtgaaaagttcccccacccatgtatccccagccacttagtttcctttcccagaggcagagccattgttagtagtttctaaacgtacttttccagagatattttattcatatacaagtaagggcatgtaaatatgcacgtgcacacatgcatgcacatacacacgcatattttgtttccctctctctccttatgccaatggcatattttagtcacccttctgatttcaaaaattaaaacacacacacacacacacacacacacacacacacacacacaaacatatattttgttttctttttttttttctgagatagagtcttgctctgtcatccaggctggagtgtagtggcgtgatctctgctcactgcaacctccacctttcttgttcaagtgattttcctggcttagcctcctgagtagctgggactacaggcgtatgccccacgcctggctaatttttgtatttttagcggagacgggattccaccatgttggcctggctggtctcgaactcctgacctcaggtgatctgcctgccttggcctcccaaagtgctgggattacagatgtaatctgtaattgttaatgcccggccttaacaatatatttctgatatcattttatatgagtatttgaagagcttgttcattcttttatcatggtaaaatgcatattaatggttgggtttcctatcagaataacaaaaaatcattttatttgttatggtatttaatatttggtgctataatgaagatccccaaattcaagtgactagatgtagtaaaagcttatttcttgcttctgaaaagtctagtgggtgtttgaatgaccctctaatcagtggcttagggacacagactcattctgattagtgacttctctttaaatcccactggatccttggcatcaagccagccagtgagtagagcctgtggagaagacatattgctcatacctacctcagtgcatatgtggcatacttcattttactcccactctcttgaccagaactcattcatatatcctcacttaactgcacaggaagctgcaagtagagtcatccttatgcccaggaaattgaagtggatattggtgagccctagcagtctctaacacattcatgtatatggtcataaactatatgctatgaagtctgtgtcgaaatgtttctttaccctacctctaaactgaattgggcaaaactgaaaatgtttgaacctgatgccttctggacatagataacctatagaagtctaaatgtaatcttgagttactacttatactatgtatatttattgaaatttttgtagtttttataatttgaattacaaaataaattacaaaataaattttgtaatttgaaaatgaaatatgtaaacagtttatttgtatatgtgtagagttgaaatatattttcctcccctcattttcagcctctgcataagagcctagatccaagcaacctggaacatctcataacaccattggttactattggtcatattgctctccttgcacctgatcaatttgctgctcctttgaaatctttggtagctactttcattgtgaaagatcttctcatgaatgatcgggtaatttatattttttagattcatgttctttgtaatgttaacttttgcaattttatccaacaaggaaagaagtgaaatgatatcaataatacttccatttgactgccttgattttaggttttcctgtttaaaaaaaataagccttgtctccattataagcaaaaccatcttgaaacatctttttagttgagaataggcatatgacctcaaatacattccttgataaatataaaatataacctgatgctatctatttcagatttacaggggtttaatttttgacaggacatctatttttaaaaatatgcagattggtaaaccagctcatagtatggttgtcatgattatagttttacctttttctatataaacttgttcttttccctacattgggagagaacgaaaaaacattgggagaggaaataatgattttgttagtctccagttattttgtatctgctgtgacagcactgtactaggttctctggagaattaaaagaaacatgagataaagtttttcctccaaaaagtaaacataatataagtagtgatatctgggttaatctgccacctgattttttgttttcagtttgtcctgtcagttgtgtatttttctcttttcttatttttgattaaatatttttatttcattttaccagtctgttttacattttgctattattttagtagttttcctagaaattacaacatggactttggacttattaaaggccagtgtcagttggtctgctttgaactttcagtatagcacaaggaacttcaaaatactttaattccttttattccttggtgcttttttgtgctcttgttcacccagttctattactgctgttattttatgcagttaatgtttatttagatttgccaacatattttctccttttgtttttcattcctttctatgtaatgattttctttctatctaaagaactactttagtactttttttttagtttggatttccactaatgaattttctcagtttttgtttgtctggaaagatctttattttaccttaattttttaaaggatgctttctttgggttaagaattctagactggtgtattttcccccatcagtgatttgaatatattattctattttccattttcttttttcttgaagtttattgacagtcttgttcctctgaaggtcttctgtctgtttgctgtgaatgtttttgtcttttctgttttccattggtttccagttttactatgatgtgtctgggtatgctttcctttatagttattgtacttggggcttagagctcttcttgtatatatagcttaaagttttttacaaactttaaataatttttaggcattatctttacatatacgatttctgtttcatattctctttcctttcttactgcagttctattaacacactttaaacgtacattgtttttttgctgtgacctagctgtgtgacacacttttgtgtacttttctgccagcctcctcatgcttcagtttttgttttttttctgacctatctttgagttcactcgcttcagttttgtctagtcgtacctaaagctcatgctttgaattcttaatttcacatatatacacatacttcaattctgtaattctatagtttttaaacatagctctttgttttgctgcagaatttgcttgtcattaaatccttgaaaaatcttaattatgtgaagtttgtatctgttaggcttatcatcttgatctcttgtaacttttgtctattctcaaaattttggtcaaatcttaccttgtacatatattgcttttgattgagtgatagactttttgtatgaaaagttgttgagataatgtgaggcttcagatgtggttatattcttccagagttttacttttgtttctatcaggcagttaagctatcgtcagatcacttccatccaatgaaaatggaagtttggcttcagttttggacaagcttattatttttttctggtcaccttatgtctagagtatatttgtctgggatccacccagaagtccaggttgtttaacaaggcctttacttaatgggctcaggattcttaatcttgttcttctagctctgtgacaggaaagctttgctcaacttcttatccccctttcactttcagaatcattaatcgtctgtgtgaaaaaactaatctcagtgccagactcaaatctttgctttccctccttatttgaaactttgccctgcaaattctcactgctttggtagctgtctgttgccttcaaactgatttttaaaaaatattttgtttagcctttccgtttgtttcagtatgaaaattggttcaaaacaacctagtcacatcttgtcagaaacagaactgctcaccatttttaatccattaatttgtcttgttttattatatatttgatatgtacaaaggaatatatgtaacatttgtataacatgtttcataatacaatgaacacctatgaactcttagttccttagagttcttagagttttattactcttcaatcctttctacttcctccttgtccctaatatctactctcttgaatcttgggttaatctgtaacagcaacaaaatttaccacatacttgtttagttttgcttgttcttgaggtttctaagcattatatcataccctgtatagtcttggaggatttgcttttatcactccacatttgtttctaagaataatcttcgttactaaatctaactgtggttcattcatttgttactctataatttcactgtggaaaatatctcgtaatttatttattcttctagtagattgtggaatatttccatttctttactctttcggacagtgctgctatgaatgtttctattgaagccccctgctacatatgagcaagaatttctctaggttttattcctacgagtgaagttgatgaatcacggtatatagacatatttaacttttcactttttttaagtcattttttataatgtttgttaaaacttatttttctattaagaaatctgacaataatgttattatacactgttgggagaaaatatctaatagatacagtatctcattatagctcattatagtcccaatgtgcatttctgtggttactaattaagtttgtgtgtctagtcaccattcatgttgcctactttctgaaattcccttttgatgtattttaccttttattccccttggtgtttttttcccataggcaatctgtacctatattaatcttttatctggtacatgttatagtatcatcatgaagtgtgtaaaacctcatttatgtgtgtcttttcactcctttattgtgtcctttgatcctttgaacaaaagttattcctttttttttctttttgagatggagtctcactctgtcacccacactggagtgcagtggcgccatctcggctccctgcaacctccacttcccacattcaagccattctcctgtctcagcctcccgagtagctgggactacaggcgcccaccaccatgtccacctagtttttgtatttttagtagagatggggtttcaccatgttggccaggctggtctccaactcctgaactcacgtgatccacccagttcagcctcccaaagtgctgggattacaggcatgagccaccacgcgcctggcctgaacaaaagttattacttttaatgtagctgtatttatcattattctttggtagttaatactttttacatcttatttaagaaatcttttcctactctaatgtcatgaaaatagcctcccatatgttcttctaaaactttgaaggttttctttttttacacacacaaaaatcaatccatctggaattgatttactttttttttttgtatgctgtgatataaggatttcatttttgctgcatgttagggttaccaaatttcccagcactgtttattaaatatcttaccatctcctggtaatctgcagtgctaccactcatgtctcctatagagcctctgttcttttccactgatgcgtttgcccatccacaagatgtctttccttaatgttttatagttttctctaaaaagaaaaattttaaatttctctcacacaacttatgttaggcactaaataaagtttttaagattatgttttatgtttatgattgataaggtgaattatttggtaattctgattttatatccatctttcttgctaaattctaattttgtcaattataaagaatgccagctttgattattttctaatgcttgcatattttatttctgtatatttacttccattttaggtatttatcctttttcatcctaacttaccagtttttgaaagagatatattcacatattctgctgtgatgaagtattcaatcttctgattttaatcatgttggttctggtttattttgatgttattctgctagttgtgtaaatgttcatgaattttatattttatttggtgttgtaagataaaatatatcagtatcccatttaagtccatatcctcttcagtgcttttcatcttgactggtatatttttccatcccataattttcagatttcttatgttgtttgtttttattgtatcttttgtggctttattatttataaatctacctgatagtctctgttgtttctggtagtatctgatagtttcttatttatgtaaggtttttgttttcatttttctttgtatttgtaatagtttatactaatttagttttttcttgtgaattaaatagtgttatctttgagtaattctttcaacatggattgtaatttggaagctttctgtcttgaattctagtgttcattcttcagtactgttttttggatattagaattctgtgtttcaagtcacttgaaaattcagagcattgtttttttggcatctggtcttgcagctgagaaatctgaagttaatcttttattcctttttggtagtttctttatggaagcttttgggatcttgacatccttagttagaaatttcatcacaaggtgcctaatgtgattcctttttcattatttttacttcatactttgaaggcacttctcaatggaagaaatgagttataaactgtgtgtgaatctgtagctctttgtgtttgagggagtttgcctttttagatgttgggggctacctgttttgttaccagagggttacctgaggtgatattcaattcctgttctttgacctgagggtaaaaaatgggatctcaagtgttccaagattggttcagctcttttgccatcttattttaatttcctggttactactgtaaacacctacctgctagtacttgcacatgatcacctcaggattagtttggagttgtgctgaaaacaaaaacaaaacccctccagctcaagattttttttttttatacctttcttcttgtttaagagctacaccttttggctccatgtttttttaaaatcctagttcttgcattaaataattgaatctcaaaaggggctaaataagggagtgatgtgtaagaagttagagttagtcccaccacagacctagaaagaaccagtcgtgatggatctataagtgctgtacataggcgctagtgaaggtatgcctttcaacctttttttttttttaaagtaaatagggttagatgaagtactttagtcatatataacaaatgtcactgcagaaggtacagatttcattcattttctaagtgctaattgaaaagaattcatatttacattttaaagtccttgttttttttttttttctcgtttatttttagcttccagggaaaaagacaactaaactttgggttccagatgaagaagtatctcctgagacaatggtcaaagtgagtaatgtgcatagatctattgattttaatataatcaccacattgtaatatttgaggtattaaaatttctatttctattggaaagatattaaagtcactcaagtatttacatttattgtatgatgtcttatgtgctgtgagactatagggtaataatgagaaagctgggattttgtggacagctgcacataatctaatttgaggagaaaaaaaggtttgaaagctgtttccctgatggcaaaaggcagtgctagtttttatggactttcctctgttctgtaaagatgatagttcagattttaagcctattcatcttttccatgggatttaataaaactttttatttttaaaaaattcagcctataatttattgaattaggagttttataagattgctcatcattggtatagactcttgatttattaaaaccatctatggcctgtagtgtagacctcatgtcaatccactaccaagatatgaaggccaaaaatacatacattaaatattgttattttctagctgtaatttcttataaaccctttcagtctgtgtgtgtgtgtgtgtgtgtgtgtgtgtgtgtgtgtgtatttgtttatagttcgtattacgaactaccttttcacattgttctagctggaggttatgatactagttttgcagacttgtacaatagccccacctttacatcaatgaatgatgcttgatactttgagtctcagtataaacctgtttttctcggcattggtctcaagctgcagtttttgtatacttgaaagcagcactggactagaaggtaggccacttaccaacttaccagttggtaggcatacttaccaactggccaggaaagagatcttccgtctttgccgtgagccagacactatcgaagaccctcttagcatctgagccttagctctgtaaaaagctgagctaatatgtgaaagataatttgtacatcattttaaaaagaggtaatatgtacttcttcaaaagaattcttggaaacattaaaggaagtaatgggtgtaaaaatactttaaatacttcataatcataaaatgtagaacaaatatgagtggtatcattttttaggcagaaaagattaaatgtaatttgtagttgggaacttaacttttctgattagagaggttaagcatgattttactgtatgttctacaggatcaaatatatgttggggaaacattttaaaacagcaaagaacaaactagtctttagtcaaatcattcttttgccattttcttggatgtttgaaacatctttaaaacattcgagattatcttcatatatacagaaaagaattttttcttttcttaaaaagcatccattaaatacattttatttttaaaaaaagttgatacagaaattctttcaaaatgtaccagtgttttatttgtcgacttgtctcttaaatagattcaggctattaaaatgatggttcgatggctacttggaatgaaaaataatcacagtaaatcaggaacttctaccttaagattgctaacaacaatattgcatagtgatggagacttgacagaacaggggaaaattaggtatgcaattactatttcacagttctttggattgcataatatttcagctcttggtgtaactgttcaatggtgctgtttctttttcttttttttttaaattagaattgctttgtacatgtgcatatatttttactggaatatgcttttgtacagtggttattttacagtggcggtcacatgtctggtgcagggtactgttatacattgtaaatattttaaacaatagattcttacattttagaatatctcgtatgaaagtgtgagtgtaccagtcaataactgatgttttacattcttgttaaatatgtaaggggaaagaacagattgggtgaaaggcaacttattgaatctatttccagaagtataaataaatgcatactttaaagatgtacctgaagtaaattattgaaaatgagcacacttttttggtttttgttattttattttctttgaaagatgtagtaagtacagtgtagtgattgaaaactactggactctggagcctggatttcaaattctggttccaccacttactagtcaggtgaacttcagtaagttgctttaacttcttggtccctcagtttccttacccacgaagtagaggtaataattatgtgtacctggctcatctagctgttatgatataactaaataagttagtatacctaaagcatttaaaacactacttagcacataataattagaagcattgatgataatggtggttattatgtcagtgttagttaaaatttaacgtttgtcctctgtgtaaaccaagtgccatttggtgcccctccttggtaatacaaaataggagaatagctctgtgctccttaatatatctaaagactttaataagaaaacatacaaagatgactgccagctgccttctgcctttccatcttgtatgttttgcttatactgtattctccttgtatgttttgcttatactgtattctttgcatagaatgttaacagaagcacatccttctcaaacaaaacatataaaaaaaaacttggtaagctattcattctgtatctgtttactttcttttattctaattaatctattctgttttcatgtctctgttcccctaatttatatatgccaatgtttaggagttacaaataataagtatgttttcatttaaaatttttactgaatttgaaataattttgtattgatcagctcagcctggtaaagaaattttcctcagtgttaatacatttggccttataaatcaatttattaattatattattttatatttcttatttggccaattatattcagctatataaactttcatcagagaggcaaagttctttggtggtttacaacattcaggcagattgaagacacactacacaggttcaaactgaggttctaccatttatcagctgcttttatttatcagcaagttatttaacttctacgtgtcttagattcttcatctgtaaaatgaggataacaatagtatctccttatagagtttatgtaaggattatatgtattaaaatttcgaatgtaattggaataatacccagtatataatgtcacttatgctgtgttttgtggaacccatatgacattcaggaatatttaggggcagcctagagttggaataagaattttttctggtagagacataacaggtggagtcttgggagttggtaggtgggggtctctgtcctttccttaagtgggaagcttgcattcctatttaagcaaaagtgattttttgtgtttacaccttaaacttttatgtaagatttggtttcaagaaaagtttcctctgcttaataaagctaaaaacaacaaaacaaaaaaagtttacgaggttaaatagaaacctctggtccagatgggaaattttaaggatagataacacaggaagcatctgttatccatatctgtgaggaaaacatccaacaggtggtttatactttttgcactaagaactatgatttactgattaatagctacttggaatattgttgttgatgggatgagacacacctttgagacgaagtcctacaactttagaaacttactaatgttggctagcatccagtcaatatttttacatggccaactagattattaagtcttggaaaactaagactgtcttttattttaaataccccgcagtgctatatgtacacaatagacatagatttgttgcatggatgttgaataacaatcttttactatagagctacaaaggggttctatttaaggagttacaacttctccctccttatatttgttcaagatcccctttattttagctaatatatcactatattaggaaggattgtttagatgtatttactagtctggaattctatgaattgtgcttcattttagcagttgtctttccttgaacttaaaaagagcctcttggtaatatttgaaaagttgaattctagctaagaatagtaatgttttcctcaccacacctgctttcattcttcttctgtgcttagcacagtagttgtgtttgatttattagcaagctagaacatatttggtgcctcatctatatataaacatttctccaacaaaatccatagtagaatatgtaaaacctaacaactaaacatacagacagatttcttctacgcttgactaagacttgttttatttagaatgagggaattaaatgacttgagtgacactagcattgacttatgtttaaaagaagaattttgtagtattagacaacatcttccaaagttaaatgagcataatatggtgttcagtattgctaaattattttctgtattagcctgctcagactgctgtaataaaataccaggcttataaacaacagaaatttatatctcacagttctggaggctgggaaatccaagatcagggtgccagcatggttgggttctggtgagggccctctccagggttgcagactgctgacttcttgctgtgtcctcaaatggcagaagcggtaaacaagccctctcaggccactttttaaagacactaatcccattcatgagggtttcccacaatgacctaatcacctccccaaaggctccacctcctaatactatctcctaggtacttgcatttcaacataggaattttgggggacacaaacattcagatcacagcatttttttttaaacttttttgtgccagaatttttaataaaattagatgtacagaagattttgtacaaatattttaaatgctaatctatattcattctactcatttttcagtaaaccagatatgtcacgtctgagacttgctgctgggagtgctattgtgaagctggcacaagaaccctgttaccatgaaatcatcacattagaacaatatcagctatgtgcattagctatcaacgtaaggaaatggctgtgtacaactactttttgaaggtctttgacttttaggaaggaaaaacatccactgtgatacatagattaaaatcttgaatgtgtatggtttgtttgtttctgaaaaatttatgcatgagaaacatttcagagttctgaaactgtcatttgagttttgggttgctaacatagtacagttgatcttcttctttgtaatagttttgttctataatgttatcacaggcattcagttagcagatactgaacagttgctcttaggagaactcacagaatagattccttcaagcccctggccacaacattttcatcatccagttaatatacagccttgttttatgtatgtttctgtttaaagactatttattatatatagttgtctcaactgaactcacagccaacagcactgtaactcatacctgaacaaagcttatctagcacacacattttctctgtaaggaatatcagagccttcttgtgctttggaacgccagacagcagttcatcgctatgcttgtgctttgaaacaccagacagtacttcatcatgaaataacaaaaacatcaaccacaaaactgtgaaaaatgtggcactgaatagacctcaaaaaggacactgtttacgtatgaaagctgaaacaagaaggcacagtgttgccttctttgacattagctgggaatgtgcacatctggctacttacattttttgctgctttgtgtatttactttgcaaatgacccaaaaattgcttcaagtattaattttggtgttacaaataaattttaacgagtatgcagattcctaaatatagaatccacaaataaggaagactgactgtatgtattcagttcctgaaaggaaaacaacagtatcgaaatttatacttttataaagacatgacatagaactaatttcaggttagaagcattccttattactcagtgagttaagttttcagattataagcagtgaaactttcagattcctattacagttttatggatttcttgttagagtaactttatatttgggctgtaccgctttagaagtctttagcatcattgagaaaagtaaaagggactttcacattagtaaataaaatactttcagtatgagtttttcattaataatttcgttattttacacttagtttttctcttcttttccaagtagtcttaagaatttacttcagtgatcattgcaattcttcctccccaccctttattctagtacatatttttaaattgccacttatgtataactctctagacacaaacagtcatctatttttaaattgtaatcatttttgtcaaatgatttgtcaagactggtacttcagtcttttaaaaacagctatttcggccgggcgtggtggctcatgccagagaattgcttgaactcaggaggcagaggttgcagtgagccgaggtcgtgccattgcactccagcctgggcaacagagcgagactccatctcaaaaaaaaaaaaaaaaaaatttggggggagcccataacttccttggtatagtttccccacttaatttttggagataatcttaaaagaaactgaaaattgtttaaaaagcatctatcacgtttcttagaagaaaccaacatatgtaattattttattaaattgggaagacctgcagtctgtttatcaggttcttggtatggcatttcttagagcatttgctgctatcattattgaagtggaaatatttaaaaaacacaaagtatgcaaatacaagaaatggactttatttgaaacagtatataagaagtatgtgccagccattaggtaaatgtccactctaagtaaaaagcatccacagttactgacttctaaggacttccttttctagcaaatatttgttatacattgccacctcaagcaccaaattcccaaggtgaaagttcaaatggcctaaactttaagattgctttggaattatcttgactatggaacatgtgtcagtggttaaaaatcagttactagcatcttctcacaacttagaaacatatcaaattaccctattttaagcaaagcttttctgtaatctgttcttcctttaaatcatatgctcatctcctctttttaaacctccaaacctcaagaaagaataatctatctttgtctctcttactctcttatcctgtcttctctgttcatattttgtcatttgcctttgttgttttccagaaatgtcctgttgaagtcctcaagtccagtgatactgggcttcattatatttgacacaactcattgcttctttattcttaaaactgtcttatttggtttctgtctcttgattgttgctttacttatctgattacattttctggctcttcctctttttttttttttttaaatgtatgtcttctgtgaggatctgtctaggatcaacttcttcacttacacagtcttctttggccatgtcatcatctatgtaagtgactattacatcagcaacgttaaggtttttcaagactcgggtcctacttcaagtgctaaacagaaattttatacttttatgttctgtgaatataatactgagagttataatatttcccagatctattctttcttgacatgtagagcctatgtaagtgttaaatatagtagttcacagatctattctttcttgacatgaagagcctatataagtgttaaataaatctgaatggcatttcttatacctaaaagcatggtttatatttgactcttggcttgtccttgcaccttgttgcaaagtacagataattctgtcctttgatatccattatataatttttattcttactttcttgaccattcttattgctgtaatcatcattagctctcaccaagactgttgggaatcttttttattgttggtaaatttccctaattacagttatgatcatgtcattcctctgttaaaatatttagggggttgatgcttgtaaaaacaactgcacgtattttacaacctggtgtttgagcccctctaatattttaacccaaatgtacgcttaaaaatcttgttgagcacactctcctttacttaacctcatttcatgtagctgaacagctttttttcttttttgtgccttgtactttgctgcctttaattttctctttactctcccatttccacacatccaacctaaccctttctgcaagtcagtgctcagacacaaccttctttacaaaacttgctctgagtcttttattttatctgcagtcctctgatacgtacaggactatgctttgcgctttagtacatgtactttatttcttgaggctctttaaatgcagtattgtatctgggaggctgctgttatgtatttgaacagaaagtacatttggagaaatttaataaaacaatatgaattttaacataatttaataattacttagatattttagaacttggaattcagttcatgaaagatttactctgtacttctgtgtgctgtacattgttctaagttctggaaatacaaagatgagtaagtcatggttatagcccaaagaagctaacaatctcttaggagaacagaaaatagagatgtatcaataatacaatgagatacacaaactaattacatggtattaatggtagttttgagatactttgtactagaaaaggctactaaaagtgaatttacttaagctgcagactaaaattaattttatagtcagtagtgaataaaagctttgattggaactttatctgggggggcggggacatttgtagtattagacaccatctgtttttttcttatgtttaaccaattatatccagtgtttgcttttttgagggtacatttttttcagataaaattgtattactctattctttacttcacatttaacttttgtaataccagtcaaaaggataatcatctttgcagaaaaatatttgaagacttcctcagttcccagtagcgctttttatacttatttattcacatgattctcttgaagtacctatgtgtgtgtcatcattcctgttaattttctcttcttcagttgttatttatgttagtggagttgcctatgatttcacagttctctaacatcactttgatgactttttgaaaacctgctacttgtgtgatgcttcaaggattgacattgcaattaatttgtcttgtattgttgcatcctgaatgattagtcagagagggacaaaaacctggacttgattgggattttaatgaatggcctgttcatttgtgaatacgcttgtgatatgtggatttttacttacccagtttgtaattgggtattttcatagtaaatctataacggagactcctctcctctgtgggactgatactgagggcggggtgagttaatgttaactttgtttcgtggagtatgagggtagataactttctgtgaaaactagactgcttcttccccttccctccctacagctaattcccccctcctccccccaaaatggagtcttgctctgtcacccaggctggagtgcagtggtgtgatctcggctcactgtaacctctgcctcccgggtttaagcgattctcctgcctcagcctcccaagtagctgggattacaggtgcctgccaccacacctggctaattattgtattttcagtagaaacagggcttcaccatgttggccaggctggtctcgaactcctgacctcaggtgatccacttgccttggcctcccaaagtgttggaatttcaggcgtgagccactgcgcccggcctccctctgtgtgtgtgtgtgtgtgtgtgtgtgtgtgtgtgtgtgtgttttaaactttaggttcaggggtacatgtacaggtttgttatctaggtaaattgtttgtcacagaagttaggtgtacagattatttcatcacacaggtgataagcatagtacccaaaaggtagtttttccatcttcaccctcctaccctccaccctcaagaaggctttggtgtctgttcttctcttctttgtgttcatgtgtactcaatgtttagctcccactttcaagtgagaacagcagtatttggttttctgttcctttattcactaaaggtaatggcctccagctccatccatattgctgcaaaaagcacatgtagtattccatggtgtatctgtatcacattttctttatccagtgtactgttgatggacatttagattgattctgtgtctttgctgttgtgaatagtgctgcagtgaacatatacatacatacatgtgccttcatggtagacatgatttataatcctttgggtatatacccagtaatgggattgctatgtcaaatggtagtcctgttttcagttctttgagaaatcaccaacctgctttccgcaatggctaaactaatttacattctcaccagcattgtattagtgctcccctttctccacagtctcaccagcatctattattttttggctttctaataatggccgttctgactggtatgagatggtatctcgtggttttgatttgcatttcactaatgattaacgatgttgaacattttttcatatgcttgttgtctgtgtgtatatcttcttttgaaaagtgtctatgtcctttgcccactttttaatggagttgtttggtttttgtttgttaatttatttaagtttcttagagattctggatattagacttttgttggatgcatagtttgcaaaaattttctcccattctgtagtttgtctgtttactctgttgatggtttgtttcttttgctgtgcagaagctctttagtttagactacttctgtaaaactagatgtttggtattttgataaactgaaatttaaatgaaatgaaagaagattttaaaataaggatttaaagataaggatgagatgttatgaccaagatttttggggaagataaactaaatgatcattctagatgaagaaattgttacaatagtaagaaacacaccataccttatttaattggtggagtgtaaggtgtaatcatgaaggtctttgtaggtcatatagaaaagtttgaacttttccctgtgcagtagtctcccctatctttggttttgcttttccacagtaagatattttaagaacaagggagaccacattcacataacatttattatatagtatattgttatacttgttctatcttattagttactgttaatttcttgctgtgcctaatttataaattaaactttatcataggtatctatatatagaaaaacgcgtaatatatataggatttggtactatcctcagtttcaggcatccactgtgggtcttggaatgtatcctctacctccactgataagggggagctagtgtcgttcagaaaaacttctgatcatctatgtgccaggttttttgttaggcttagagagataaaaacataattcttttcttcaaggaacaagtactggtgggtaagacagacatttaaaccaatcattttaatactttatactaaatgctatgctggagataagtacagaatgctaagagcacagaggtgggtgctggatacagattacacactgcgttctgtctgatatataagctatctttaaggataagtaggagttagctaggagactaggggtgggtagtttaggagaggggagtagtatgagttaagcaggcacacgggtaataatcagcctggtttaagtatagaagtcaaaataatttggtgtttctgaaatggattagtaatccttaccttcagagttgtgctttttatttctttattaagagacagggtcttgctatgtctgccttagcctcccgagtagttgggactacaggtgtgtaccaccatgcccagctagagttgtacattttaatatgaatagtttttttcagtgacagaactaaaatgtataaattgggcagttttatcttgcccagtaaatgaaaaagatatatatgagatggtgtttaagccttaatttttgtatcttatttaagttagggcagatttatatttactagtttttttctgttttaaaagtatgtttgttttctaacacatctaactggtacttattagggcccagatgaatattgcagcttcaaaatgaactttagtcacaacatctcactcttgtgagcagtgaagcaattattgtagataaacttgctactgtttactctttacttaaaatagcaaattttatatctgaagttgttactctttgctgccatttgaataatatctggaataattgtgtctttacaggatgaatgctatcaagtaagacaagtgtttgcccagaaacttcacaaaggcctttcccgtttacggcttccacttgagtatatggcaatctgtgccctttgtgcaaaagatcctgtaaaggagagaagagctcatgctaggcaatgtttggtgaaaaatataaatgtaaggcgggagtatctgaagcagcatgcagctgttagtggtaagcatataagaaaatggaaaggatactttttcagcctgctagtttcagttttatagaatatagcatgatatatgatattactgttatttattatttgtgattaacaatttttattaccatttttcaataactgcttttcatttaatatgaaggtcatttaaaaaatgcatggtacttaaatatcaacctatatctgtttatgtaaaggactaaatggccaaggaaaataaacaatgacattggaggtacttttaacagaatagtaaaatttgtacatttatatagattgagcattatcttattttaattggaaaaaagtacaagactttgatctttgttgtttgttctcacctgtagctgacattaatatcaggtgtttgcgtgcctacttttcatctgctcactttaccccattgaggttagttggtgtgcctcttgacttccatgatttaacaaacagcattaaaatccatccagttatctcactcagaaatcagaggcattattcataccttttttccctcctctcatccgtcaccaaattctgttaattctttctccaaatgtcttgaacatttatcttctactctcctaccttgctatattttcacttggattgttgtatacattgcctccctgttgtaattgttcctgtgcctctgacccactgcctgctgtatcacattgctatcaaaattatccttctaaaacagattagatcacatcagtcccttacttgaaatttctgttgattctctgttgcttgtgggataaagttgaaacaccttatagccctttatagtttgctctcagcctgagtttcaagctttctttctgctccctattatgaaatctgtgtttcatttactttcgattacttgaaatttgtgtaacagtcttttttctctgttgtcaactctatctggaaattgcctcctgtttccagacaaacaaacaatgaacaaaaccaaggaacatggttgacaccttttgaatgctttaaaatacagttttggggttaccacatcactgtgaccctctttctttttttttccttccttacgctggaaaatgtgaggggtctgcagtcacatcccacttctgccgtttacctgtcgtattttggcagattacttaatcatttgtgccctagtttccttatttgcaaaattgatataattatactgattgcttgtggttgttgtgagaatttaaaaaattacatacagtgcctggcataatgtatggcccaaagaagtgctcagtatgtgttagccattcttattttggtgcacctttcacattgaagtgtagcttctgtctctgattatgctttagtgtgagctctttacctagtcttactcatctttatatttttagattctaatataggcctggaacatagtaaacagtcaataaatatttgatagaatttaattttaatttcaccagattttgaactgtgttacctttttctttccacgtcggccttgaaatgaatgatgttacacacaaactgttctctgtagatttagcaatagaaataaagaaaatttgatgctttattgacacatatacatgaggttaaaacatccaatttatatttttatttggcaaataggaaatataaatggaaattgtccagaatatgagtcccagtctatgtgtaccccttattaaaccaattaggattaccattctgacctctttaacagaatatgtttatctcagccaacatacaaaaataattgcatttaaactaaatagctgtttctttatttaaaatgccctagaaactcttaagtctgttcctttattctgtttttctgttacaattagtatcaacctcttgttgttccatattgactctgaaaaatactagatgttacttattttgctcagcagcttacaagagagtgttaaacatagggtcatttctaataggaaaaatagatgttttttctctcactcttgaatatagtttgtttgggtcactttttccttacgtattttaaaactgaaatatttgtttttgtagcctcagcccatggtgtatttagtaggccatttcaatattgaacatggtagatgaatgaatagactgtttatcatgtacctcaacacagggtatttcaatatatttttcttcaagtcattgtggtgaactgttgggatgcagaaaatatagtacgaaagaaagagtatgtaagatttggttttctaacctggatatttttgttttgttttgttttttgctttttcttttgtttttttttgtttgtttgtttgttttctttttcagaaaaattattgtctcttctaccagagtatgttgttccatatacaattcaccttttggcacatgacccagattatgtcaaagtacaggatattgaacaacttaaagatgttaaagagtaagactttttccatcccattttcatattttctgaaagttattttttctccttaatgctgataattggatctcaattataattagtttattgatgtatttcatttcttaggtgtttaaggttctttatttgctctcttgtctttcttttttcataccatctctttatattacatttttaatgtagtttcccaaaacttaatcataattattatagttatgtttctgtaccagtctggtgttccttttctattgaagtaattcattaaaatttccattccatttcttatcttttccttcttccttctgaaactgtgtagattttcatgtgaggtcaattaatcatcttgcttttactcatgtagtaagcacatttttctttgcaataactatcttcctctgtagaaggagaatggtctaattttaacaatgggccaaattcgtaactggggaactactcctacttattacttaattggtgattctctaactagagtttaaaatatttgtaattctttcaaagattattgcttaaagactgaaaacactgtacatgcctgggtggggaataggaatatagtgatatttagagaaatctttaagaccagcataattctttaaataagctcgagaccctggtccttgttcagttacaataaaagattaccattgggatttttaatcaactaatttatgatgcctttagtttcctattatattaaaatgtttcttaatgtcttaatttttagaagtattttatagttaaataatttgagaagcctcaggagaataaaatcaaattaatgatgaattctcatggcaaaggaaaaaatgccctttttttcccactgcagtttccttttttaaaaaataagaaattagttcggccaggcctggtggctcatgcctgtaatctcagcactttgggaggctgaggcgggtggctcacctgaggtcaggagttccagaacagcctgggcaacatggcaaaaccccgtctctactaaaagtacaacaaaattagccagatgtggtggtgcgtgcttgtagtcccagctacttgggaggctgaggcaggagaattgcttgaacctgggtggtggaggttggcagtgagccaagatcacaccactgcactccatcctgggcaaacagagtgagactctgtctctattaaaaaaaaaaaaaaattagttctatcaaaattagttttgtgttagagtgattaaaactgttgaaaacttctagccacttctttctgagaacattgggtttttaaaaataaataaaacatcctttggaatttactagacacttacggttatatttctaagtagccccagtgtagccatgcataatctccattctatcagggagccacttcagaagaacttatcctatacctaagttcctaaaggttatttcttttctgttctagaataataccttgcttcacatttctctcctccttctcccattacttttctcctctatgtatcaactataactttgttcctttctgtctctataatacataggcaaaacactttcattttgtattgaatagagttttacgtaattaagtttaaaactgagctactgaagctttcttttaatttttccctttttaagcaaagacaatgcttataattgtcaatcttgactttttctctctattattgaatattcttaactgttcatatttaataaggcagttatattctcttgaagagttcccatcaggactgtagtcagtcttgagtatctgaggcctcacttgatccgtggccccactattcctttgacagtctttaactccctgtcatagctgagggttaagataacttcatcctttctaccatttatgtttcccctttaacccgcctccttggaaatctggtgagattttaagaagggatcttataagctcatatctgcattgttgacctgtttttatatgtttgtatgacatattctttttccctgctggtttgtaactgtttcttttttttttttcttcctggagttatattatctaggtttgttatatttatatttagaattattgtatctatatttaacaaaggatgattttcttctatatttcttttttccttttttttttttttagatgtctttggtttgttctggaaatattaatggctaaaaatgaaaataacagtcacgcttttatcagaaagatggtagaaaatattaaacaaacaaaagatgcccaaggaccagatgatgcaaaaatgaatgaagtatgtaattctttgtaaataattatggttccatattgatttaaaaatttaggtgtaaagtatgaaacttctgtagtatttatagatagcatcaaataattttttctattagtaattagaattacgtagaattagcagtaattttattacaagtaaatgagcaaaaccagtagtgtaagctaagatgcttacacagactgttgctttcattagtttgctattcagactggattcatgttctgaaattattcctagtttacagagtctagattgccagcttaagtatctgtgtttttaaaaatatactattgcagaaactgtacactgtgtgtgatgttgccatgaatatcatcatgtcaaagagtactacatacagtttggaatctcctaaagacccggtactaccagctcgtttcttcactcaacctgacaaggtagttactttacaatttgtttgtgtaagttgaaataaaatgtattctcagcactggattgtaggaagatcaggaaggatcatggaaaaattgctgtgagtcttaagaatgtgatttaagatcagaaccagaatatgagtcaaactggaggacacacataaggttcagatattaggatgatctggtgtttatgttcagttttaagacagtcttagagcgcaggtagaaatgtgatcaaagcatgtgaatctgtgaattaatggccattgttcaaaatgggaaggagagtgctgatagagatacagtctgaagttaaaagccctttattgggatttataattggtatgaggaaacaagcagagaacagacactagaacatgcctaagaccctgggaatactacaagagtgttaccaaaccatgctccaaaaactcgagtgtgatataagatgtaaaaagtgtttcccacagtccctcttactcctttataatttatttatttaattcctcgtaatttagctgaacatattgagtaacagagtctggaaataaccactatcctctttttgcttttaaagcaaaatgccagttaagaccttaccagtgtatagagatttggaacaggcctgtaggattgctcagtagctaaaagggctgtcacgttggtgtgagcagagtaataggaatatgtacatgtggtctttcccctgaagggtgttattaaagaagcatgtgttttctgatgcactcttagagctctaacatgttagagctcaaatatgttttgttaatattagagttggcatgaggttggtttaaccttattacagtagttaaaatcagtgactgaaattttgtgtttcatatgataatttagtttaaataaaaaaactgctgtttgctttgttggcttttgaaccacctgtagatagtgttttaatattcactgactacttctttttctcttggttgtagaatttcagtaacaccaaaaattatctgcctcctgaaatgaaatcatttttcactcctggaaaagtatgttttgagaatcattttaatttttatgtggtagcttattttagagtgattattggcaaaattgtgttattttgtatttcttcaaaaatttatattttcaagctggaaaatataagaattaacgatcttacatttactagtaagaaataattatatttactagatatacacaagctgaaatacacaaattactttttagcttgtaataaagtcctaggagacctgattcttagacttcttaggttaatatcaagataaaaaaaatcttaaaaggcttttttttttgagacggagtctctgttgcccaggctggagtgcagtggcgcatctcggctcactgcaagctccgcctcctgggttcaagtcattctcctgcctcagcctcctgagtagctgggactacaggtgcctgccaccacgcctggctaattttttgtatttttagtagagacggggtttcactgtgttagccaggatggtctcgatctcctgacctcgtgatacacccgccttggcctcccaaagtgctgggattacaggcgtgagccactgcacccggccaaaaaagcatattcttatgtctttccatggcaagagtctaattatctattttcattgttgattattcatttcatttgttctcactttttatgtaagccgttttctccagataactaagaaattcaactgttatgctgtctgtatagtttttaatttgttcaagtgatatttagtttatacttattactttgcttaaggatagacacatttttcatgatttgtaagtaaatactttgagagagatgttatttatggttctttacacgtaactttcttttggctttaaccaaataaaaagagatgtgcatttctcatttcagcctaaaacaaccaatgttctaggagctgttaacaagccactttcatcagcaggcaagcaatctcagaccaaatcatcacgaatggaaactgtaagcaatgcaagcagcagctcaaatccaagctctcctggaagaataaaggggaggtaagtgcaaaagaaatgccacaatttacatttaaggattccagcaaggctatgagatctgaaataatataatccaaaatgtttcatgtcagtaaatggaaagtaatgtattacttaatttttccatttaacattggtagtcacaagttcatacttatttgcttgctcattttggatgggtgctctgtcttagtctttcattctttagcttgttgggggtaatctgtgttagtacacataaactagtttccaacctcagtgtgtagcaattgtaaaactgttgtattatggtgtatgatacaatggaatacatagtcattaaacatgatgaggtctgagttagtatggaagagtttccacaatacattattgagtgaaaaaggcaaagtatataaagcagcattatggaatctttaagttttgaaaacagattaatgttcacatttgtttttatatgcatagaaagtttttttgaagaatatgcaaaatcttaacagtatttatgttaacctagtatagaaagggaggttattttatactttttggtatcatttgaatttatttgtatagtaccacgtacatatataaacttcgtttttttaaaagtgtgtttttgcttttttgttttttttaaattcaacttttattttagatacagagggtacatgtgcaggtttgttacatgggtatattgcatccagatagtgagtatagtacccaataggtcgttttacagcccacatcctcctttctccagctcccccagtagtccgcattgtctgttgtttccatgtgtatacccatgtgtgtttgatgttccctcccatttataagtgagaacatgcagtatttggtttgctgttcctgtgttaatttgctcaggactgtggccttcttgctgtgaagtacatgatttcatccttttttatggctgcgtagtattccatggtatatatgaacttcatttttttaatccagtccattattgatgggtacctaggttgattccatatctttgatattgtgaatagtgctgcattaaacagatgagtgcatgtgactttttggtgtaatgatctatttgcatttgggtatataaccagtagtgggattgctggatcaaatggtagttctgttttaggttctttgagaaatctccaaactgttttccatagtggctgaactaattcacattcccaccaacaacatataagcgttctgttttctctgcagcctcaccagcatctgttgttttttgactttttagtaatagccattctgactgatgtgagacggtatctcgttgtagttttgatttgcatttctctgatgattagcgatgatgagcattttttaatggttggccatttgtcttcttttgaggagtgtctgttcatgtcctttgctcattaaagaagagtttttaaaatgattctttgagaaaaacaaaaggaaaattaattcatcctttcactggttttagcataagtgcttagggcacgatttgttagcacagagcattgtatagggctaaactgccactatttattgatttttgccaagttattattaaaagactgtactgtctttttcattgttgataaccaatcagtaaagaaggtaggtgacattctatgaaatcttaccaaatttcttataatgaataaattgttgaatgatatatagtatgatagaaataaaagaaattgcatttatagcttttgtttgttctagattcctgtattaatgcatgttagtggctaataccaaagtgaccctttagttatatcagttggacattttctatcaaatggtctcatatttaacatgaccagaaacatttccatcaactcattttctaaattactggtttttctccttgaattccttattataatcaaagatgatctaattcacccaggcagaaagcctcgaaattgtgtttgactcttcccccctctatattttttcagttgctaagttttgctaactttttttctgtgcaatgttttgtacttctctttttactgtcatcatttagttcattttctttctttaattattgtcgtatttgactagtttacttccttattcctctcaattgtgtatattgtatcactgctagataatcctttaaaaatactactgtcgtgatgttatttcattgctcagagatcttaattggcttcccttgtttgctttcaagacaagtataatttcaccctctccttatcatccatttgttattcaacacaaaagtatcctaatttatactttttcaatatagttttctttaaactttctttcaatgtttgaccaatctgttttgttatttttttcttccaaattccgtctgtttagtgggactgtttgcaggggaatgaagtaggtatatttgagaaacctgtttggttggagagtaggaatgagggaaaaattatgagaggaagttgagaggtagtctgattatgtttggacttcgtaaaccatggtaaggagtttggatttgattttaagtgcaactgaaagatttgccagggagtctagcaatctcatttgtggtttttaaaaaaaattgccctgatgatttgtgcagaatgtactatagaggagctagaattgaggtagaaaaagcaattaggagtcagcgaatcataatctatggcagggatgaagagggaagaagatggtaaatagtcaaatttcagattttttttttaagagtagtgaaatgcagtagtgagaagggaggagtgagttaaaacaaggagtttgatgtctaactaaccatgagcaatcagttgagaataactcactgcctttcgaccaccctcagatttattttgatgttagatagatcagatgatctttctaatggattagatgtgaacagttagggaaagggacgatttaagggtgtatcctgggctttttacctgaataactggagagatggtggtaccgtttactgagatacagaagccttgaggaagaacaggctctgtttgtatgtatgtgttttggggaagtggaaataagaagagtgttcaaataactgttttggctacattaaagatcaggtgcctattagaatttcaagtgaagtgttgagtagacaattggatatgtgagtttagaactcagcgtagctggaccagagattgagatttagagttcaacaacatataaatagttttaaaaactagataaaggtgagaccacccaggacagaggcctggacctttatatgaatgccaactctatgcctggcactgatttaagtgcttggcatacattggtaagtaaaattgattgacacaagattcatgcttatattctaacaggggaaggcagtcagtacgtaataaatgtaataattatagtgtgttagagggtgttaaatgctacagagagaagaaaaaatagaatagggtaaggaaccagggcaggttgcagtgtagaccaagctaaactgccaacgagaaaagttttaattggttctatgatctgaccccaaaatagaatttaggttttaaaaagacttagaaaaatattagatttaaatttttgatttttaaaattttctcactatattaaattaaatgagcttcattgcttgttgagttggtaccaaatatggtagaatgaaactgattcatttttgaaaagaacgaaattttttccataaatctgtaaagctacactaggaacagaaaaagcttgtaaggttatttgattgtaataacaattacaaatgtctgtattaaaaggcttgatagttctgaaatggatcacagtgaaaatgaagattacacaatgtcttcacctttgccggggaaaaaaagtgacaagagagacgactctgatcttgtaagggtgagatatttgcattgattttataataatattaatgataattttacttagtaatgtttacactgaaaccagttaacatgactatcaaatttacattttattttattttattttagtggttttaaccacaaacctgagtttataattatcctctatgtaatttaagtatatagaatctgtgcttcttatcaatgtgataagtaatctcaattgttcagatttttggtattagacttgccagttgcatactcaactgcttggtttttgtattgttttcctcatttgcttgtggttttgttgttgttgttgtttttgttaacataggatatttagacttagccttagagaaggggaatggaatgaggacccttaaaacttctttcatttaatttatttcttgagccttttactaaataagctgctgttaaaggtagaaaatgctatagttctcgtcaagtccttgttcagtttttaaatcttaatagaaatgataaaatgataacttgtatgatagacagtttgtgttgttttaagacaaatttgttaagttttagcatagacacaaaatacagttatgtcttctaacacaactcaatggacttaactgggtttgttttgactttacagttcagcttcagatcatttccttaataactaattaggctatcagaatcaattttcttatctgtatgtaaattatggatacttagctggtaagctttatcagagtaagtgacttagccaaaatgaattgctgctgctgtttcattgttacgacttttgattatggttatcataataataaaagttaaaatgttcgaatctacgtgattaagagaggtgagaggttaaccaagaaataattacttttactttctctaaaatattactgcccatcttccacgagtccagcattacacatgccaagaagtttattttcatgtttctccaataacttattttggcagagtgtttatttccatttagaaagaattattcttttttgttttgttttgttttgttttttgagacacagtctcactttgtcgcccaggctggagtgcagtggcacgatctgggctcactgcaacctccgcttcccgggttcaggtgattctcttgcatcaccctcctgggtaactgggaccacaggcatgtgccagcatgcgtagccaatttttgtattttttaaaggcggggtttcaccatgttggccaggctggtctcaaacgcctgatgtcaggtgatctgcctgccttggcctcccaaagtgctgggattacaggcttgagccatactgcccgctgtgaaagaattattctaaaattttattgaattctaactatgtatactgtaagttacgatgtttattggctgtttaaaattttcacatgagcaaaattaagaattgatcacttagcttggaaacaatcttgttatctggatttacagaagaaaatccttgaattggaaaaggtattatgtcttcttagttctcacttactgcagaaattcctttattattaatgagagctggtcaccacgttgaaaatgctttaagcagagagctcatgatgtatttcatttgttggaaaagtcaactaggtcactcatacccacacctatagtgtactacacttataccttggtgttcccatcccccaaaagttgggaaacatggtttttattaattcttaatattctgttatcctataaattttgcatctgcttttaccttttgggatagtacagaacaaagtctactctatttttcatagaactgttttgaatttttgagctcttgagacctattagtatgattgtaatggaggccttttgctatttgttgtggcatggataatgtgtaacgttaggtccagttttagaggtgctagaagaatcttattaataagctagttttgactgaagtgccctcagagagatgagtattatgagacacaagttgaatttaaagaccagtagattataatgaaagagcacggtctcatttgcttgttaccagcttctcattgaaatttcacagcaaaggaattattttccatatacgtttgtatttaaatatttagctttataaataaaatattttcctgtcttttgcttctaacctcggttttatactccctctgttcttaaaacagtgcaatgcaaaatgaaaaagaaataagtagtggtgctttaggaaactagattagtattctcaagaaagtagacattgggttttctttttaccaccaaccttttccagagcttaaaggaaatcatctacctttttagatctttggacatcaaaaagaattatagtaattaaaataagaagtgacattttaaatttagttctaatttaacatttcttttaccttcttatctttgagtaaaaacagttaatttttaatttgtgcacaaaactctaaataaataaaacaaactaaatccagtcatgtatagatcttcccctctccttagaatgtaaggatagcttaatgttaccaaatcttttactatgatagtatattaaataaaccaaagggaaaaccaaaaacaaaataatttcagatcatgccaagaggacataaataaaacttaagatccgttcttgacaaataggaacttttagtaaactagtaccagaaggatacatctttaatgtgctaaaagttttgtctattttaaatcagtagtcaatgccattcttcctaaaggcaaaatacttgaagcattctttttaaaaatcaggaacaaaacaagcaacctgctgtcaccactgtttttaaaaattgctctagaatgtttgaccaattgttatttttgtaatcttagaaaaataaaagaagcaattgaaaatctatccctacctatgtatatatttatgtttgtaactaacattactctgataattttggtttgtatcagatgtacatttaggggaaaagggattattttcttcatcacaagaaccagtgcaacaacaaacatagattgactgattgacagattcatagatttaaatataacctttaaaagaaatagggagtacctatatgtagaaaatctcaaaactgagatagggaggacctatatgtagaaaatctcaaaactggaagacttgaagagagagaagacaggccatgttcttgtataggagaaaggaataaaaaaggatgaaagtttttttcaactgaatatataattgcaaaattccagcatggttttgtttcaagtctatgtggaggaataaataaatataaaaggaggagaaataaaggtaggttcagccctaccagatacataattatacttagtaaaatattgtgcttctgttatgatagcccagaaatattattcttgttcaaaacatataaaataaaggaagcactacaaatcattgattctgaaatggttggatgtgtctttgggagtggaaaatccagtttagaatctcatctcacattctgttctaaaacaatacacaataatgtcttagtcagctcaagctgccattataaaataccaaataccacagactgggtagcttaaacaacagaactatattttcttacagttctggaggctggaagtacaagatcaaggtgccagcagatttggttcctgatgagggctgtcttcctgggttacagatgccaccttctcctgtgtcctcacatgagaggtgtggggtgggaggaagaagaaaggcacccaagctcactgatgtttcctcttataaggacactaatctcatcatgagggtgccacctcatgacctcatctcaacgaaatacctcccaaaggccccatctccaaatactgtcacattgggattagagcttgaacatacaatttttttctttggtggtgggggccacaattcagtccaaagcaagtaagaaataacacttaaaggacaggtgcaatgacacctgtaatcccagcactttgggaggccgaggcaggcggatcacctgagtttaggagtttgaaaccagcctggccaacacggcaaaaccccatctctgctaaaaatacaaaaattagccacgcatggtggcacatgcctctagtcccagctactcgggaggctgaggcaagagaatcgcttgaacccgggaggcagaggttgcagtgagccaagattgacccactgcactccagcctgggtgacagagcgagactctgtctcaaaaaaaaaaaaaagaaaaaaaaaaaaagctgggtgcagtggctcatgcctgtaatcccagcactttgggaggccgaggcgggcggatcacaaggtcaggagattgagaccatcctggctaacacggtgaaaccccgtctctactaaaaaaatacaaaaaaaaaaaaaaaaaaaaaaattagccaggcgtggttgcagacacctgtagtcccagctactcgggagaaggctgagacaggagaatggcgtgaacctgggaggcggagcttgcagtgagcagagatggtgccactgcactccagcctgggtgacagagtgagactccatctcaaaaataataaaagataatattaataataaagaaataacacttaaaaataagcatagaggcatacacaaaagcatagaggaatatagagaaaacccactaacaccgcagtagtcaaagttgacaaaggacacaatacgaaggatgtaattaggcagttcacatacaggaagctcaatttaaagttagaaaaagttacagataattcgatagtttttgttgttttcagtgatttttgaaaatataaattgcgcagacttttggaaattaactttgtattataagtgttcatacatacaatttattcttgggtctttggagaatttcttcagccttcacgctggttcacatatagattctctgaatatagactaggattttattttaaatgtgaaagccactggttttttgttgtttctgttgttaatcagttagttatacctagaaagaagcagtatttctaattcagaagtgtttccaaaatttataataaatgatgaatatgtttaccttttgtatcttgcaacctccatttgtaaaataatagttcttttatgatgttgtaagcatgtcatatagttaatattttatgtcttacgcactatgtggtaaaattagaattacttaaattgactatccaaacagatactttagtatagttgtcatttaggaccaagcactgaatttataatgctctttttaatgagatagctcttcactaaaatttataatttagtaagatactgatcttgagaggtttccttttaagacactctagctgaaaagtaagagtgcaaatgtacccttttatcccagataagtttttaaaattaaaaactataataaaagcaaataaatacagttctggtgtatttaagagctgtatattttaggtacatatctaggacaacattagataacagatttttttgtttcattcctcaaaatatgtatactcacaatttcataaccataaattgtgattttttttttcccctagtctgaattggagaagcctagaggcaggaaaaaaacgcccgtcacagaacaggaggagaaattaggtatggatgacttgactaagttggtacaggaacagaaacctaaaggcagtcagcgaagtcggaaaagaggccatacggcttcagaatctgatgaacagcagtggcctgaggaaaagaggctcaaagaagatatattagaaaatgaagatgaacagaatagtccgccaaaaaagggtaaaagaggccgaccaccaaaacctcttggtggaggtacaccaaaagaagagccaacaatgaaaacttctaaaaaaggaagcaaaaaaaaatctggacctccagcaccagaggaggaggaagaagaagaaagacaaagtggaaatacggaacagaagtccaaaagcaaacagcaccgagtgtcaaggagagcacagcagaggtaagcatgtgtaactctaaactgcatctgtttcgttactatattataaatcataatttgatgctatccacatttgggtcttccccaaagcagagcagaatctcctgaatctagtgcaattgaatccacacagtccacaccacagaaaggacgaggaagaccatcaaaaacgccatcaccatcacaaccaaaaaaaaatgtgtaagttgtaaatattacatttcaaaccaatttcaaattattttgcaaaagttcctaaatttgtaaacatacatattgctgtatttaaattccatatatttagccccattacactaggtaagataaaatttttataaacttaccttagtgattgatatctcaataaactatcttgtacatttttacaggtgcaggcaaatcttcataaatgaataccaaatagtatattatttcctatacagactttatgatatctaaagaaatcataaggtatttttaaataatcaccacacattgaccaggttgccttgtcattccacactacaattttttttttaaatgtttctcattagcaccttttcctttaaaaaaaggaaaataggtcttatgcttctgcttttattctttgaacttgtagtaggaaagtaacaggtaccattttttaaaaattatatccatagaaattaacacatgttggtctcaagtgtttgatatcttgattttgtttgttttctaacccagttcatttatctacatcaacatgtatatagttttagatgttcacacaaacacatttataagagaggtacagtaagaatctgtacctcaaattttagtgtcaccagagtatcactgctgtaatttgcagatctgacagtgttttttctccttagttatgtgagtggaaatagagtagcatgtcttctattagtcagaaatttaacactttttctgagagtaatcccacccatacataattacatcatggctcgacttttcagagttgccaatgtactgtcattaaatactcaattatcttagagattttcctattcctgtgtattccacaggaagaggaaaagttgcctgggtgtctagccagtacttcatgccatcttccatgtaatttttctatcaggttaaaagtaaaggtaagtacatttttgtggcagctttataaatgtgtttggattcaaccaaatcactatttctaaacaaaggattcttaaggaatcctttatttaataaaatacacatgaatgatgtaacaaggaaataacaaacctcataattttagtttgtttatatttggacatcataaaattcagggtttaaatgattattgtgctctcctaaaattacacaagtcctatgaatgttctaaaccaaacaagtatttcttaaaaaaaaaaaaaaattgatatggaagaagattctgtagtctgtcttggaagcctatcttcctttcactgggaagctctttctagagctagtatactaacatatgttaggatttgtttctttttcttgttctgacctcagtgaaattgaaaaagattgtcattatgtttcatgttatttctatagtttcattaatctcgaaaaaccaaaccaagtaaaaaaattgtttggttcgagcgtgagttaaaaaaatacatattttggattgcttatagaagtgatgttatgtttctaattttaaaaaataaagatttatcaagagggatccatttgattagatggttctattacatattttttgatgcctcctgtgtttcagagagtactaggtgctagggacacaaaacagacgtggtacttgttttcatgggctcgtggttcttgttttccaccatctaatggagtgaggaagttttttctttaaaagtaacaatgagttgatatcttgagaatagtaggggctagacaggcagagaacaggtggcatgaacactatatttgaagtttctgaagtgaaaaataacttggcaaaatcagaaagctaaaggaaggcaagggtttgttggattgtagttgtggggagttggggagcagaaagagatgagagtggacaggtaggcaaggaccatctactgttccttgtatactttgttaaggaggtttacaaaattattctcagctcagtagggagcagtaacatcatctgttcttgtacttttaaaagataactttgtaaagagaagaggcaagagatgggaatggtttgaattaggtggtagcaatggagatgtggagagaagtgaatggatttgagatctccataagaatctataaggccagacaaagacaggtacactatattcaaagcagaattcctttctgctttgagcagctcagtagacatagatgccttttactgtgttaggaaagatgaaaggaagagcagactttaggttatggtatgttctcagtcacatttttttgttgttacttggtagataatatgtaacattctatgattaaatgctggtttaggattcagaatattaaagaaatgttcttgtctcataaagtaactgagggtaaagatgatatgacgatgaaatacgtgaaacatttcttctaacgaggtaatctactgaaagattggaacgttcattgtgttttacatgtgttttactctagccgtgtaggacgctccaaacaagcagctactaaggaaaatgattcaagtgaagaagtagatgtgtttcagggtagctctcctgtcgatgatattccacaggaagaaacagaggaggaggaagtttctacagtaaatgtatgtgttcaaagtttctgtgagtggtgtgggatataaaaagagttagtaaatgtttggttagatcatttagtacttgtttagtatttatatgttttacttcattagttcatagcatcattttatctaccaggttggataatggagaacatcttttatggaaacccgaaactaagcaaataggtgtagcttaatgagaatgtaaatgtcaagtctgaactgaatgtacagcattctaatattgacactttaagcatgtaagttgtaccttgattttagggcactgatacccattaagtatactgttgtttatattttacaactctccgtttggtatttctatttgggtttcataatagaaattagaagttagttacacagaataaaatcagcctttggaattgaagtttgagctgaatgagaattcataaaattggtaatacatacttattttgcaaaagtaggtatgtgttacttcctgacttttttgtttttgagacagagtctcactctgtcacccaggctggagtatagtggcgcacgatctgggctcagtgcaacctctgcctcccagattcaagcaattctcctgcctcagcttcccaagtagctgagattacaggccaatgccactgtgcccgactagtttttgtatttttagtgcagacagggttttaccatgttggtcaggctggtctcgaactcttgacctcaagtgatctgcctgctttggcctccaaagtggtgggattacaggcatcagccactgcacccggcccttcttgacttttaaagtaataaataaataactttaccagttaatacaactcagatatttctcttaggaaaaaacataatacatttaagtagaagctcttctcctatctttgtttgagaaacccaagctctataatcaagtctcagaattggtctctgctgttctgtcctgtttaatggaatcagaactcctatctgtaccaggattcatatttgtgaataagcgagttaagtacacaggaaaatatgcataattgtgacctcaaattagtttggcttgtttcttaaagggttttggggaggacatcaaagtaagtctgaagagtcagtaacgattgatgtcttcatcagagaaaaactacatgtaaattaaaaccctcttttatattcctattgttaatattgacattttttgaactaaagttttatgctttcattagtgcttgtcagcaaatgataatatgtttgaattttaggttattttactgtattgataattgttaagatccaaactcagtaactgctttcccagaaagataatgtaagttcataaatgtgaaatgttttcatttaccacaggaaacataagtagaaagatgattaatctgtttgagttatttttcttgctgtagacattgacttctgttcatttctctttaaaattattagatagaaaagtaaaataatttttttctttcactgttctggggaagtctgtgagcctgtaagggatcaaatgttatagaggtctaaatatgtgatgccagggcagaaagtaaggataaaaagtttcagggaaaggaaagcaaagaaaatcaggaacaaatgagaataaagattagttaaaaatgattactgcatatcttatgcacatatacccattttaattaagcatctggtgactttccttttaaggtacggcggcgaagtgctaaaagggaacggcgatgaacaaatgtaattaataactttctctgtgaaagctttggaaaaatctttttttttttttttttttttggtcaagcttgaggctgaataaagcctttgatgcacaaaatgggactgctgaagagtggacagttggaccttactttggtgaccccatacatttgtggtcacatgctttagccatacacatggtaacattgactatggagtcttgtgaaagtgtaatgtgcgatggctatgtagacataaagaagaaacttgtaaatatcttttttcttttttttaatgtttctgatttctgaagtgcttgtatagcttttatctgcggctttaaactgacagtacccgactgtttattggatctattgatttgaaaagaatttgttaggatagatcttaagcagtaatctgtcagtgtttgtatttgtattctctgcaattttactgtgaaaaaaaatttgttttcaacaattggtgtcattttcttgatgtcactatttgttggagagttaaatggtctcttccctttgtgtatcttacctagtgtttactcctgggcacccttaatcttcagaggtgctaaattgtctgccattacaccagaaggatgcctctgataggaggacaaccatgcaaattgtgaaatagtcctgaagttcttggattactttacacctcagtattgatttgtcccagaattttctggcctttcatggcaatgaaaattttaagaagaaagatttaaagtattttaattttaaagagtgtgttataaaataatgtactgaattctttatcccattttatcatcctttcagtttttattaatctactgtatcaataaaattctgtaatttgaatgagtttttaatagtctagaatgttattgtgtatagatatttcctcttgaacgttatgttcagaaaatgcaaattacactataatataaaacctgatatatacacattagaaatattccagttctccgtaacagtgtaaagttaatcagaaagaaaaaattttattgatgcagtgtgtctttataaagctgttcttgaaagccaagtgttttgtattttatagtgagttgcatgtttttgaaaaaaagtgctgaaaatgggatgtgctgttttctgtaaattcatatttagccatagtatatgatagattgccccataacatagtttttcatcaagagtttattattgtactttattttggagccaaaaaattgattctggggggtgggggcagcgtagaagtggtatatccaagtatatcagctactgtagttgtcacagtcttgtgaactttgaatgaaattccactttgtccagattgggagaagtggaaatttatttggatttagagcaggtctttttttttcttcattgtaatctgcaaaatgtagaaataaattacttaaggcagtatcctttatacagttgtataaactgtattttgaaccaaaacatataggttactacttaatgcttacctaatttcattttagtattttaggtgctgttatgttttttcatggttaacaccagaggggaaaaaatcatattctaacttattaaatttatcacattgaatagtggaacattttcatatgatacaccattatgtttaagatatatttccaagattggttataatagatggggcatataataaagaagctactattttggaaaatgacattttactatttgccaatgtatattgcaattgatgtgattatttttcttttaaagatttgtttgtgtttatgaaacagccatttattttttaaaaagtgttttgaattgtgtcttaatctctccatattcaactattcttcatttacaacaatagtgacaccagtaattatgagaggctgtcatatatcaaagcagctcaggtgggatcaacatacattggttttgaaatgtttccttagctcggttctcccaaacacataatttctgtttcagcagtacaaaggcatgttttaaaat

SEQ ID NO: 15831 - DNA, 35104 bp, Human
atactttataaattcatgattgttaagccacaaaatcaacctttccaaataaaactgagtgtaagtcaaactgccaagcgaaaagagcagctatggagctctcaactctcccttttgtcatagtttatctctgtacaatgccagataaagcccagatgaggaataaagtgatgtgactattgctttatacttattaaatctcatccgttattgtgggaccatgctgccatcctcctcacctgaggtgcccgataatgatcaccctagcggggggttataaggcacctttgttcgaaagaagtttatagaattggactcagaaaggtacagcttgccctccagggaagcaaaggagaaaattatatttaatgcatattaaacaaacaattgttggagattataagctacatcgattccaagatcccaaaatacttgagtcagcttactccaaaatgttaccagccagccactttaaacattaatgaggtagctggtttctaaaatctggaaggaggaggaggttttgtttaagccaactatttcacagaagaggaaatacagttcgacctcaggaaatttaaatgagactgctgaataactgggaaagaacatctcctgtggatgacagggcaaagaagaattaagctgattttaggccaaataacaaatgtgacagctgtgcttttttgtgtatgtattggtgtgtgatagtgtataatttctagaaaagcagttctcatgcatttgggtcttgaaaatttccacttttaaaaattattgagaactccaaagaactcttgcttctgtaggctgtatctatcaatttttaccattttaaaaattgaaactaagaaattaaaaaaatattgattgaatcattaaaaaaactgtattaacataaaatatttttatttaaaacattgttttcaaaaaagttattgagaagagtattattgttttatattactgcaaatctatttaatacttggcttaataaatggcacctagattgtcatcttttctccatatactctattgtgttatgttgttttggttgaagtatgtgaagcgaagttagttcacacaaataagtaattggaaaagagagaacctcatagtccccttaaaaggatctcaggggactcccagggatccttggggcacactttgagagccactgtcctgaaaagtagtttggaagactatgttaagaatggctgtccaggagtggtgagattattcacgattctttttttcttttcttttcattagtatttattttctacaagaagatggattgcttgtgcaaactaaaaatgagaaagaaagaacatactcatgttgagggcagattatggaggccctggaaaaacccaggcagaggagtttacacttgggagaccaaggagccactgtcatttcttaaatgggaaaatgataagagctgtgtttgggagtaagtgaattcgaattgaaagagagaaagagagatgctacttcagagaagtggtgtggtgagtcagacctcaggtgttggcagaaatggagagaaaggacaaactccaaagactttgagggcagaatgacctgagacctggatataggaaatacaggagagggcagagtcaaagacaacagttttaaaattaaaacatttgaagaatgttttttcccttctatccaactttggggcctggttctgttgctcaggctggagtgcagtggcgcagccttgacctcctgggctcgagccattcacccacttgagtagctgggactgtaggtgtagattgcctctttctatccaacttcaactttttctgaatgttactccgattaagctaattgaagtcttgtcgtgttttccagagttggccaccctgttcaagggcttaggagaaagtcaacacacttcgcaacttgaattggtcccagctgctcccagaagaacgggcgggttggtccctatgccacccctggagagctactcgccgcccactttgccgtgaagggctgtgcggttcccgtgcgcgccggagcctgctgtggcctcttatgcactccaccacccccatcagctccctcttctccttcaccagccccgcagtgaagagactgctaggctggaagcaaggagatgaagaggaaaagtgggcagagaaggcagtggactctctagtgaagaagttaaagaagaagaagggagccatggacgagctggagagggctctcagctgcccggggcagcccagcaaatgcgtcacgattccccgctccctggacgggcggctgcaggtgtcccaccgcaagggcctgccccatgtgatttactgtcgcgtgtggcgctggccggatctgcagtcccaccacgagctgaagccgctggagtgctgtgagttcccatttggctccaagcagaaagaagtgtgcattaacccttaccactaccgccgggtggagactccaggtgggtcgtctttacgacgtcaaggtttattttcagagtgaaggtcgtgtgccccattgatggagaatgatggggcaccagcagacagggacctctcccaaaagagagagagagaagagaggagagggaggttcagttttgagggactcgtccaaaattttgtttcccggaatgaggcagctgtccaatcaaagaaagttcccatgaaaacgatattcctgcctggaatgccacaggaacactcaatccaaagagaatcgcagtaaaaccctgttatagccagtgtgaaggaatgaagataaactagtcaggaaaatctagaaagaagatattttcatttgatttcattatgctggtaagctttgtgtgattttgaaaatgaggcagatggctaatcggagaaaactgccataaaagttttattttgaggtatctgggacaagtcaacataatcttttaccagttcttggggtcctgaaaggttttaaaatggccttgataatgatgagctgtaaaaattaaacatcctcctccccccgccccaaacaactgaactgaactgtactaaactgaactaaggcagggtttttggctgctactttgttcaagttcaggtaagtagaagatatctcatgtctaggtctgaaaacagccaatgaaagagttgctggaaatcattccaggcagttatttttaaaaatggttttaagtacagacaggtatcacttaatgatggaaatacattctgagaaatgcatcagtaagtaatttcttccttgtgtgaacaccctggagtgtacttacacaaaccatgagcctgctacaccgttaggctatatggtgtagcctattgctcctaggctactaacctgcacagcatgctactgtactaaatactgtaggcaatcctaaccacaatggtattgaatgtatatgaacagatctaaacatagaagaggtacagcaaaagtacagtatcataatcttgggggaccactgtcttatattggtccctcaagcaaaacatgattacacagtgcatgattgtataggaaagtatctttctaaaacccttcacacccctgtgtgtgtgtgtgtgtgtatgtatattatatatatgtgtgtaagaaatatgtatatatttcctcctcctcttggagaagcctggtgtttgtctttgttccttcacactggctataacagggtttcactgtgattctcttagattgagtgtttctgtggcatttcacacaagaacacagttttaggagagctttctctctttggccatctgcctcatcccaggaaaccaaagcgctggcacattagctcagggaaattgcccatgtccagtgaagagatggtcctgtctacgtaggcaggttcacttaaccttaaaacagtatccaataagtgatttatgcccagcctacctcagtcttagctaagtgatccttcaagctcccagaacttaacatctacctgtgtgtggatgcctcccacagcccattcagggactgaggccctggctgagaaggtattagaaggttccacatgcttggcaaatctgatgcgtttcccctaaatcctggagcgagttgctttccacccttcttccctggttcattttgactcttttcgcttacttaaaaaaaaaagtcaataatgtctaagcttataacaaaaatgactggattccattttgtgtttcaaagatttgaattacattaagcatccaaaatatatccaaatggaaaaatgttcattaataaatcatttctgtcttcctgaataatgtagttgtaaaatttaacaacttgtaagaaatatcttgtaaaatgtacctggttttccttttgaatattcaaaagcctaattttaaagaactatttgacattttagtttttcatgtcttttgtttttttgtcttgctctgttggcaggccggtgtgcagtggcgcagtctctgctcactgcaaccgtcacctccccagttcaagcgattctcctgcctcagcctcctgagtagctgggactacaggcacgtgccaccatgcccagctactttttgtatttttagtagagacggggtttcaccatgttggccaggatggtctcgatctcttgacctcatgatccacctgcctcgtcctcccaaagtgctgggattacaggcatgagccaccatacctggcctttagtttttcatgttctgtaagattcttttaggaatgatagtgtgagtgttttacatatggtaaatatatttcattttatcataatttaggtgtgaatttccagaaggaaagatgggtaacgattatattaatttaaggtaatatttaagttacagaggtttttcttacttgtgtttttttaatagaaaaagtagattttatatctagttagctatccatatttaaagtaaatattttaggaataataaaaatgttaatgttaaacaagtttgctgagttcctatttatcataaagcttaagttttgcctttgaaatctcattttttagccatccattttagatacattgaaggctgcattcccattttcttttcattcacacatccacttcaataattgacttcagtgctttccaagttatgtgtggtgagggatcagtttttatttttttaatttccagtccttcaaacgaacacttttatagtacagacaaattactaggcaaatgaaattttaaaaagacttagaaaatataagcccaattttaaaaattatttaaacaagtgtaaactagaaactctgtcaaattgctgtgaaaagtttctaagtactaatttcttcacagactcgtacccaacagttggtgaagggtccccagtcctcagacacactttacctggcacagttctggtggaagccatgcaagactgttgttgtggtacatgatgattttactccatttggctggaggttatttcaggagtgtaatttcttttttatataaaatattcatattatatcaaaaccacatgactttttttaaaaagacagaagtgttttttttccagctctgctttgcatgcccatgtgccctgtaactccttccgctgtctccccccgtgtgacactgagatgtaaagatagcatggtgtttaaaagtggcataagataggcatgagtgtctgtaagcgcactgtcatatttacaagcagcagttgagatgtggaagtggaattaagtaattagggatagctgtgttgtgagtgaaagtatttaaaaatatgatcagtgcacatttaaggcaacggagccagtcaggtcaaataacaactaggatgaaactatcagttttctttgcaaacatccactggctttgattttacccagatggtaaaaatatattatcaagatagttgttatgataaagggaaatgtatcctttcttttctcttggtgcctcagatctacaggccatgaagaaatagaagtctctacattcagatggataggaggcattatatttttatcagtgttaggaatataccgtagatattttacattaaaactgaagtcacagagatgattcaaattcttcttcataaagaagtgagtgtttacttgaacatcgttaacattttgatgaagggtcattgacaaagaagccatacacattcgctgtgtcaactcctcacttcagactattcatgaggcacataatctttttttttcctgcatagttgtggaatatgaatacattaaggggaatttaatggtttatgatccatgtcactgtttgatggtgatgttgaatgtttgttctctggtgtcataaggcagcatacgtatacaatagcttagaaaaggggaagaaattatttgtttctctgccaccctcacctgtagcagttttagtttaaaaccttttatttacccttcttagtttattttctgtccatataactgaaaattattgtttgttaagaaagagatagatgtatggtgtcaaaggcagatggcagacttcggggttaatgtcattgttattgtaattgtctgtttattccaaaacatttacctttttttaagactttattttttagagcagttttagaacatttactttttatgagtttttattaatacttgcctgtggttgacaaatcagtggtgtgattagaaccaagatctgtcctatttatacccggagacaaactcttctaaataattcttgcttagttctttcatatttctctctattattactaagaattatgacagtaactctagataatatataatatgcttacatatctatttccaaatttatcaccttttagataatgtcattgactctctaccataaaagatgaggatttcactcacatacatacatacatacatacatatacatatatatatatgtatttttttttttttttttttttttttgggacggagtcttgctctgcccaggctggagtgcagtggtgcgatcttggctcactgcaagctccgcctcctgggttcacgccattctcctacctcagcccccccaagtagctgggactacaggcacccgcaaccacgcccggctaattttttgtatttttagtagagacggggtttcactgtgttagccaggatggtctcgatctcctgacctcgtgatccacctgccttggccttccaaagtgctgggattacaggtgtgagccaccatgcccagcctcactcacttatgttttcatcttcttccttcctcctcttctcatccttgatatctatattttagttcatagtttgtatttgtttttggttattccagtggtttccattgtggaattcgggggtaagaattatttgtcctcagaagggcattggtctgttgacttctagtagccagggttagagtgggaagttgaggtcggttgattctcatttctttgtaggtgactttgcggtgatcctctaggagcttttggaatattccagttatcccgcagtgtttgaaattcaagatggaaagactaggtctggatcttttcttcattaattgagctctgcacactctgtggctcttttcaacatgaagacgtaggtcctttgtagctctttgaggttttcctttgttatttcttagaccacttcccccttgtattttctttgcttccctgtctggaacttatgttggtcacagatggctcttcaacaacagttttggagtagctactttatgccaggcattgtaaccttctaggagtcggtaggacgtgagggcctgggcaaagcttgcccttaagaatttgaatttattctgaaattttgtgtataatcagaatcaagaacagtaacattctttttaaaaaatgaaacccagaaaagcatagtaaatgaacaaacatcatttatgttttgttattgctgcttattttatttttttgagacagagtttcactcttgtcacccaggctggagtgcaatggtatgatctcggctcactgcaacttccacctcccagattcaagcgattctcctgcctcagcctcctgaatagctgggattacaggtgcccgccaccacacccggctaattgttgtatttttaatagagacggggtttcaccacgttggctaggctggtctcaaactcctgatctcaggtgatctggctgcctcggcctctcaaagtgctggtattacaggcgtgagccactgtgccctgctgctgctcatcttttacttagtcacttttattattattcaccgtttgtgttttacttaataacttttaattactcaccttgaaatctttccattaaggacacatagaatgtttttatttcagtggcactactgaacctgaaattgagtctggtcatctaaataattcaacatgatctctgaaggaaaaatattctggggatcacttagggtttcattgcaagcaagagaaactgattttgccttgggggaaaaaaagacttatttggcagaattaaagaaagacgtaacaatcaggttgccagaaggccaggtattaggacagctctggtcatttccaaggtaggaataaagagcaggtctctttagagtgctgacactagaaagatccttctccaaatgcttttgtgaattatgacattctgcttaagattccggttacaaggagaagactgttaccttagcttactcacatgcttgcttcttaggtggagatggggacttaatcgacagttttatgatgagcacaaagactaatgggagtagttcccaaggggaaaaacagctctatcataaacaaaaaatagataagaacagcaagtatccactctgttgtgtactgatgagcaatgttcaattctaactgccttgttcctttctgatcctagtactgcctcctgtgctcgtgccaagacacagtgaatataacccccagctcagcctcctggccaagttccgcagcgcctccctgcacagtgagccactcatgccacacaacgccacctatcctgactctttccagcagcctccgtgctctgcactccctccctcacccagccacgcgttctcccagtccccgtgcacggccagctaccctcactccccaggaagtccttctgagccagagagtccctatcaacactcaggtcagtaagaactatggtctgtggggaaatacgggaaaataagcccaacatcatgatttatgatgaacagtcacaatgacagtcattgtaactgtcattcatatagtataaacagtttacaaagcaatcagccttaaaatgattaggactatacctattttgaagcagttaccctggagatagaacatgtttttcctctagttttagttctaatgctctggaagctctcagaaactaaatggatttgaatagtatccctgggaatttccaaggatttttttttttaaggcagtagaaataagatgaaaagacttctgtaatccaagcagaagacttggcctgaggacaagcaacatggaagatcaatgctaggcctttaccttggttgcctctttcaacaatcaaaggaagcccttgcctaaaacatatgcctgcatcctttgagtgaggcagaaagtgaagccccagctccagccagtgcattatccctttctgccatgtgaagccaggacagcatcttaaatatagagctcttcagtttgctgaattgagaaagcatatggaagggaaagggagcctctagcatgctgtcataattgctcttgctaccatacctgtaaagtggatctaagttgagataatgaataaaagatacatatgcactttgtgagtgtgagataaatactgtgcggagctgacaagttcctaaaggcatgcataaatacatttggtgccagatgttacaatctgcctcattcatttattcctataatcatttatttaatggatatttattaaactcttactatatgcaagcattgccttaggattgctgaaaggggaattaaaaggttaataaaaattgtccctacgatgtgggaagataaagagggaattgcctcttcacctctcagttacttagttccttttgctcctcagcaagttacataagcatctattatatttgttgcactatattatataattcctgtgtgtctattttccccattgaacagcgagccttgttttttctatgtctagcacagagcctgaaatgcagtggttgctcatcagttgcttattgaataaataaattactacacaggcgtttatttatttttattttttattttttattttgagacggagtcttgctctgtcacccaggttggagtgcagtggcatgatcctggcttactgcagtctctgcctcccaggttcaagcaattctcccacctcagtctcccaaatagctgggattgcaggggtgtaccaccatgcccagctagtttttgcatttttagtagagacggggtttcaccatgttggccaggctggtctcgaactcctgacctcaggtgatctgcccacctcggcctcccaaagtgctgagattacaggcaggagccactgcacccagcccacacaggcattagaacatggacatggagctccagaccataggcacaggttttattgactcagtaagtgatgactgagcacctgctaagtgtctggcactgggccagtgctagaggtgcagtgatgattaagacggtgtagttgtccccccttatctgaggtttcagctaccagaggtcagttgcagcctgaaaatactggatggaaaattccagaaataaacagttcataaattttaaattgtatgtggggatgaaacttcgtgccatcctatccaggttctgaatcattccattgcccagcgcatccacgttgtagatgctatccacctgtgagtcaattagtagctgtctctgtgatcagatctactgttgaggtcactctgatttaatagtgaccacagagtgcaagagtagtgatgctggcatattgttctagttgttttactttattattagttactgttcctaatctcttactgtgtttaatttataaattaaactttatcacaggtatgtataggaaaaaaaacatagtatatgtggtattctgtactagccacaacttcaggtagccactgggggtctcggactgtatctctggtggagaaggggggactactgtggtctctgaccttcaggagtcagtagctattgagagccatcacatacaggtagcctgtagcagtccaggcaagtgattataaggagttgaactaaaacagggatatggggttggaaagagggcagtgaattgggggagggaggtccaacaggacttactgtagggtgaaggcagagatgctggagggtagcttgagagtcattaactcagtgtaggagcagatggttgaagttttgcaagtggctgagttcactgagaaagaagaaatacaacagaaagagaagtcatttgaggacagaaccttggttaaggaacaggaggataatagtgttgcaaaatatatatttacctaacacacctctatgctacaaagacttcctgtgctgactttgaattcctgccctggttactctgacaggttgatgttctttttactcttcccacccaagcaggacagacaccaacagtgatgcagaagctggttagtttctcacagaaggcatagcccttttcacttcaaagaaaataattcttgtctgaatgattaacagcaaaatgccaacctgagtaacagacctgtagataaacaagagtaaaaggaacctttgcgatttactggttcagcctctaaattttttaaaaagctctattgaggtataattcacataccatacaaccacccatttcaaatgtacaattcagtggtttctcatatgttaatttttttcaagtagtggtgaaatatatctaacacaaaatttgtttaaccattttttttttttgagatggagttttgctcttgttgcccaggctggagtgcaatggcacaatctcggctcactgcaacctccacctcccaggtacaagccattctcctgcctcagccttccaagtacctcggattacagacatgtgccaccacacccggctaatttttttgtatttagtagagacggggtttcaccatgttaggctggtcatgaactcctgacctcaggtgatccacccgcctcggcctccgaaagtgctgggattataggcatgctccactgcacccagcccattttaaccatttttaagagtacagtctagccgggtgcagtggctcccgcctgtaatcccagcactttgggaggcttaggcaggcggatcacttgaggtcagcagtttgagaccagcctggccaacatggtgaaaccctgtctctactaaaaatacaaaagttagctgggcgtggtggtgcatgtctgtaattcagctactccggagactgaggcacgagaatcgcttgaatccaggagtcggaggctgcagtgagctgagattgtgccactgcactctagcctggtgaggactattaaaaaaaaaaaaaagtacaatctgatggcattaggtgcattcataatgttgtgcaaccatcaccatatctattttcaaaaattttttcatcaccccaaacggaaactccgtactgatttaacaatagctccgtatttccctactttgccagcccctggtaagctctatctactttctgtctctctgaatttgcctattgcaagtacctcatatactagattcatgcaatatttgcccctttgtgtatgttttatttcacttagccaagtattttcacagtttgtgttgtggcatatatcggtagttcatctttgtgactgaacgatatctcattgtatggctataccacattttaaaaaatcaattcattagctgttggatatttggattgttcccaccttttggctctagtaaataacaccctgctttcaattcctttgggtatatacctaggagtggaagtgctacattatatggtaattctattttcagtccccctttttttaattttaattttttagagacagggccttgttttgttacccaggctggagtatgggggcacagtcatagctcactgtaacttcaaactcctgggttcaagtgatcctcctcagcctctgagtagctaggattacaggtgtacaccaccatgcccagctaatttttaatttttggtaggatggggtctcatcatgttgcccaggctggcctcaaacccctggactcaggtgatcctcccacttcagccttccaaaatgctaagattacaggtgtgagccactgtgctcagcctgttctgcttcttgagtaaatagacatatttagtcaaagacctacaaaaaggtcatcttgccttataactttttcaccaaagtcataggagtcatagtccattttctcacaaggaaataccttacccatggtttcctagtatggtccacgaaccctgcattagaattgccattggggcatgttaaaatgtacatggctacattcaaccactgacctattgaatcggaattgctaaggatggggccaggaatctgcatttttagcaagctccactggcaatttttgtgtacacttaagtgtgagaactacttgtgtggacaattcgatacaacaaaggcagattgatccaaccttttacgctgttgtattccaccacgcatgttaacaagaccattctgaactaacattagacatgcatactgaaggaattggttgttttgtgctgaggtcctccataaagagtttttcctgtgcctcatgagtttttactgtgttatgaattattatccacggaatgcatcccatttgcctaaccatgatcactgtccagtcacaggactgtcatttgggtagaagggcccttctcagcgtgccttgggtacaaggttataattacgtttcaggtatcttgaagtatctcagggatagagcgtccccgtggccattgtacaatttgtgacaacatagaagctgaaaattaagctcacttcaaagaaggtttagctttctctgtgttttgcaagccagatcacagactattctgctatgagaaaagctaggagaacaggttctgcatttgaaagtcttgccctgaagtcattagaactcaatgataactcaaaagtcggagggaaaatgaattgaccctttactgaggctctcagaacaaccagtttcttctgtagggtactcacagtgtcacttcagaagagccttgttacattaatatggtctctctgtaggagtagcactgtccaccaagctcaggagtttaatggcaaaagatgtcggatccaactgtctttgtgtggtttatcgatttgacaattcctttgttctactgctttcttttagttgacacaccacccctgccttatcatgccacagaagcctctgagacccagagtggccaacctgtagatgccacagctgatagacatgtagtgctatcgataccaaatggaggtaaattgcagatgaacagtgaaatgtagctattttccaaaagtatttcctattacccccaaacaaagcaactcaaaaaagaaaaccagaaatgtactggcctgctgttttgcatgtgttttaagaggcaaatgggatggctttgcattttaactttgacattcctcagtacaatagaattaatgttttgtttatcatcattactagaacaagttaactttttattttaactcagcatttagaagtttgtagttcttgatgttaagtatggagttgggaactcaagaagttagggattttattctatttgtgtttttactatatgtttatagtggtgtctttcagttggccagagaggtactcttagaaatatacataaatgaggtttttacaaaattttatttgcatcttataatagtctagataagtgttgctcgaccttaatgttcatataaaccacgttgtgatcttgcataaatgaagatttttattctgtagatcttacggtggggtccaagaatctacattgttaagcttccttgtaatgcggaggctactgttccatgagccagatcttgagtagagaggttctaaagaagtgtaccatttgaaatactccaagtgaatattttataagctaagatccttttgtaagagaaataataacccccaaatttatctgtttcataaatttatatttaatgcatataggaacacactctagatgcaagaatgacaaggatgttcaaggaagagaaaggtaatacaatcactagaaaggcagagaaagggtgtgagtggcaaagaaagaaggaactctgaactttggttagttacaggaaagtgacttaactttatgttgggtgtgaaaacatccatgggtttcctgatgaaatatccagctctctttaaatgtttttttttttccatgcataactagatatccacaaagcagaatgtgagcccctctatgtggaagctttttttttccttaaataatttaatgtcctattcagcattattgatttgctttttatcatagtcaaactattgttttccatctctagtttgttagaaaatgatactttttgccacaaggattcaagtgggcacagtaacagcaacatgccatctttcacatgtttctgaaagaagaggtgacctgccagcttcctttgagctgtgcttgctttagggccgacagtttttttatgttcatctgttcatgtcatgttttccctggccccttcatgaccaatacacatttataaatgctctagccatggaagatgaacaaggaccatgggctctacatctcaggtgtgctagtgaaatgagccagccccaagcagctcccatgagagctacaggttctaaaagattgcagagcggcatgcttggtcttgcagccgactttctggtgaaaagcattaactaagtttcctggtggaatcatgaactacacagcccaggtatgacagtagccatgtgttctctggtttgttttcttccagactttcgaccagtttgttacgaggagccccagcactggtgctcggtcgcctactatgaactgaacaaccgagttggggagacattccaggcttcctcccgaagtgtgctcatagatgggttcaccgacccttcaaataacaggaacagattctgtcttggacttctttctaatgtaaacagaaactcaacgatagaaaataccaggagacatataggaaagggtaagagcaaagatgttattcctttagtcatctagccgaaatgtagatggtcatgtgtgtagaagtgcacgtgaccaccctcacatgttggtcatgtgcccctgtggaaggaccccagggctggtgagctctgagatagctctgacattaccactggggaaagcacataggttgtcaggatcttagtccctcttcctctaatgtcatcatgccactttctaggggtggcatggagtggggattgtgaagacaagcaagatgataaatatgaagaaagccggatgaaattattaaatagaagtgttatgcattatttttcatttccctaaaacttacaaactaggatcatttctgaagaacaggaattctgactagatgattatttgtatcaggtgaagttccctttggagacttagcagctaggtagttagaaagaatgactgatttatgtctggaagcctttggcatgtgattggggctctcctgtgtgcaggctgattgggtacaagtcatactggtctcttttctgaccagtgatgcttttgaagcccatctcattggtctgagtgatggtagcaaatcccagctgagtgtgtggtctggctgaggatctttaaattattttcttttctattggaatagttggtatcttcgaatgataccatggagtcatagatgtgaagaaccttcagtcatttgaccttttctctctccatccagcacttaagccacctcgggaagggagcctgagccttttctttcaaatttccaggggagattcattgttccatttggtgatgcattctaatattcttcctaacataccttcaaaatgtctcctgttggagtaaacctaaaagccattgtttagaaacaggttgaaatcattcattgatgttgactcttaatggagacagttactttatgtttatttatattctgtctccatagtggctttgaggcaacttacgagaaaccattgcagtgaaatgataaatgaaaaatagaaaatcagaaacgggtcgaggggaggggagaagaatccagatatgtcatccataagggttagcattgttaaccaaactaagcagggtcgggcctggttagtacttggatgagagaatgcctgacctcctgggaatgcagccctgtaggtctcaaccttattttacctaacccctattcaagatggagttgctctggttcaaacgtctctgacacagagagctggagaagatggtggtgattttactctaggtttcctgacaaggagggaagaaatgaaaaactcactctggaatgtaatttttatcccaaagggggaaaatagccattcctcaaaggaaataatctttgaattaattcctaaacaagtttcttgagcatggctttactttcaaatgatttttagaagaaccttcagtgaactctcaaggcaaaacattaacacataatgttgtgaagcagtttgctgaggagctttgcagattggtctgcatgttcaatttctgctggtgccagtggatccaaagacaggattaaagtattaaaggagtgctgaatgtgttctaggaacctgtctgcaagtcgcttcttcaaggtgctcctgctgaggacatggagagtgtgtggtagtctgtttcactgctataaaggaatacctgagactgggtaatttattaaaaaaagaggtttatttggcccatgggtctgcaggctgtactggcatgtgcttctggtgagggctttaggaagcttctgaaaatcactgtgtaaggcaaaggagagcctgtgtgtcacctgggaagagacagaaagagaagggagggaggtgctggtctctttttaacaaactgatctggcaggaactaatagagtgagaatccactcattacctcaaggagggcaccaagcagatcatgagagatccttctgtgtgacccagatacctcccaccaagccccacctccaatattgagaatcagatttcgatatgagatttggaggagtcaaatatcccaattatatcagtagctcctgtgttgttgactgagagctcgtctttagggttaagaagccacatgagcaagagctgggactgatgacctgttctgcaaactggagcacctaatagtgctcccctcgatgcaagggtactcactgtcacatggtccgaagacaaagttacagttttctcagagctgcttagaaattactccaatgtggaaaaaaatttttttttggacatgccacaagccttgccataaagcgtgtgggtggaaaaaagtgttggcttgggagattttaaagcaagggcagtcagtcttctgtgagatcacaggattctctctcagatgctgccatgggttatctggttctgagcagcatggcttccaggagcaccagcctgagtaagttatctgcaaaatgcattcctcggctagcaaatgagttaacttgctctgtggagttagttaacagacattaggttttagtaatatgcattcatctcacgagtacttactgagcatcgcctctcagccagactggacacgagggatgcaacagtggaagaaagaccatgagcaggcttcctggattgcttgctgctggggaaagacagacacgaaatacaacatacagtatgtccaatagagaaacacaaagcaggggaagagaatggagactttaaaccagcgtaaccagggaaggccttcctggaaaagtgacatttgagaagatgttaccagaaaggtgtcccgattcagaccccaagagaagattcttggaactcacacaagaaagaatttggggtgagtccatagagtaaactgaaagcaagtttattagagaggtaaagaaacaaaagaatggctactccacaggcagagcagcagcatgggctgttcgactgataatgtagttatttcttgattatatgctaaacaaagggtggactttttcctttttcatgagttttctgggaaaggggtggagatttcctggagctgagggttcatttcctttttagactatatagggtaacctctgggcacggccatggaatctgtaaactgtcatggtgctagtgggagtgtcttttagcatgctgatgcattataattagcatataatgagcagtgaggatgactagaggtcactttaatgccatcttggtttgggtgggttttggctggcttctttatggcactctgttttaccagcagggtctttgtgacctgtatctcgtgccaacctcctatgtcatcctgtgactaagaattcctagcatcctgggaatgcagcccagtaggtctccaccttattttactcagcccctattcaagatggagttgctctggttcaaatggctgtgacacagagagcaaggaagtcagtgttcgtggagcctgaaccagtctgtcaggttaaattttagagctccctggctgaggagagggggtccattcaaattgttgcggggccttccagttttatttttggtttacaatatgatctgactttacactttcgaaaagattgcctggctgttctattgagattaattagacggtgatgggcaaggatggaagatttttttttttttttgagacgggagtcttgctctgtcacccaggctggagtacaatgaaacgatctcagcttactgcaacctctgcctccagggttcaagcgattctcctgtctcagcctcctgagtagctgagattacaggcgcacaccaccacacccagctaatttttgtatttttagtagagaaagggtttcttcatgttggccaggctggtctcgaactcctgacctcgggtgatcccctgccttggcctcccaaagtgctgggattacaggtgtaagccaccccacctggcctgaatatatcatttttaaaaattctttttagtgaccagacgcagtggctcatgcctgtaatcccagcaatttgggaggccaaggcaggcaggtcacctgaggtcgggagttcgagaccagcctggccaacatagtgaaactctgtctctactaaaaatacaaaaaattagccgggtgtggtggcgggtgcctgtaataccagctacgcaggaggctgaggcaggagaatcacttgaacccaggaggtggaggttgcagtgagccaagactgtgccattgcactccagcctgggcaatagtgcaaggctccatctcaaaaaaaaaaaattctttttattatagttaatgatgagccattcccctacccagtagatatcaattagccttcacaccatttctggcttttattccttgtgacttaaattagctaaatggctggccctgctaaaggaaggtcatgttgccaccctgtcagcactgcgtgcattttgagttttgttttctctagtggtgatgatgggtcctcatttaccccacttaccatctagtgggtatgtccctgaggtagaggggctggtagaaagcatttatttgtagccatgcagcagttaactggtacaaagggactgaacttatgactttgacctcactagcaagatgctttaaatagctactaacagttagcactagcacaccaaaagctaccacttaaatgtcaaaggcaataccttgggcagcctggaacatctcattccagtgtgggatctatccatattcttccttagaaactaggcagaccacttgaactctctacaatgacatatcaaataataataatatgatgatgatgatagctacccccactgattacctaatatctaagagacacgctggtggccgggcgtggtggctcatgcctgtaatcccagcactttgggaggacgaggcgggtggatcatgaggtcaggagatcgagaccctcctggctaacacactgaaaccccgtctctactaaaaaatacaaaaaaaaattagccgggcgtggtggcaggcacctgtagtcccagctactcgggaggctgaggcagaagagtggcgtgaacccaggaggcagagcttgcagtgagccgagttggtgccactgcactccagcctgggcgacagagcgagactccatctcaaaaaaaaaaaaaaaaggtaaaaaaatttctccctttgtgggagaaaataagtgataaccattaaccctggttattgaactttctgagatagatcaagcgtatcctgaaaataattatcacatattccaaatcattgcattgtttttggaattgggctttttttaaaccattttatgaatctttattttcttgtatatctcaagttctgtataattctagtaattcttcttgttttatgaaaggaattatcttgacataaggatttcaccagtcagctccttgcagagatgttaccggaaagcggtcctgacccagaccccaaaagaaggttcttagatctctcacaagaaagaatttaaggcaaatccatagagtaaagtgagggcaagtttattaagaaaggaaaggaataaagaatggctgctccatggacaaagcagccaccagggctactggttgcctatttttatggttatttcttttttttcttttttctttttttttttgagatggagtttcgctcttgttgcccaggctggagtgcaatggcacaatctcggctcgcctcaacctctgcctcccgggttcaagcgattctcctgcctcagcctcctgagtagctgagattacaggcatgtgccaccatgcccgcctaattttgtatttttagtagagatggggtttctccacattgctcaggctggtctcaaactcccgacctcaggcaatccacccgcctcggcttcccaaagtgctgggatttcaggcgtgagccaccgtgcctggctggttatttcctgattatatgctaaacagtgggtagattattcatgcctcccctttttagaccatatagggtaacttcctgatgttaccatgttcaccatggcatttgtaaattgtcatggcactggtgggagtgtagtagtgagaatgaccagaggttactctcatcgccatcttggttttggccagcttctttattgcagcctgtttcatcagcaaggtgtttatgacctgtatcttgtgccaacctatctcatcctatgacttagaatgcctacccgtctgggaatgcagcccagtaggtcttagccttattttacccagcttctactcaagacggagtcactctgtttcaaactccttgggcagagggtctgcatgtccaggtggtatttgggttgcttcctttcccaatggatttcacttccctgtctcaaaatagtccttttgttctgcctctgaacacatgtaaggcttctcatcttaaaaaaagcaaatcctaaaaaatattttaacataggatgcaatgtcacactgttacagtcattaaacttgatgttgcagaatacttaatatcctgagaaaatgttcacaagatattattaactgaaaacaagttttaaaacatcctgtagagtatgatcccaattttcttcttaaaaatgcacatggctgagcatggtggctcacacctgtaatcccagcactttgggaggtcgaggtgggtggattgcttgagcgtaggagttcatgaccaggtgggcaacatggtgagaccctgtcactacaaaaaatacaaaaaagttagctgagtatggcggggtgcatctgtagccccaactaggcaggagactgtctcaaaaacacataaaaaagactgaaaaatgttaatagctaataactaatagatgttagctttgattatttctgggctgtggatttgtggctgatttttcttttctgtctgtattttctaaatttcctatagtgggctttcttgatcctgtgaggatggggtgggcatggtgtgtaagggtgctctggaaggcagcagcagtggtaagggagacacctcacagtgcagcccaggcagagtggctgcgtgtttgagtgacagtatgggacatgccgtgtagtacagttggacccaaacaagcttgtttatcatgttgtcctgagaaacttggtcatcaggggcagtcttggaggaccagccttgctatcagcccagaggtgactttgtgtgagttaggaaaaggtgcctcttcctcaagagaaattactgccatctgctgggaaaggattgtaataattacacaaagctctgaagactaggaggcaaaccctggtttgcagtggttgtgcagtgcacaacggtaggcacagtcctctggaagacctgcctccatcctctgacctaggccctggtgtggatctggaaaaatgtatttttatattattagtatttttttttaccacccattaaaacttttttattgtgggaaatttcaaataggaaaacagagaggggaatataatgagtcttcatcttagtatctccggcttcaataaagattcacattctgtgccgttctttttcatctatcgctctacagtatttttgctagaatattttagagcaaatctcatgcttcatatcctttttcccatctattggagtttatatctaactatataagaaataataccattattacactcagaaatatatatattttcttaaagcttctaaaatagctgtgcagaagaaaaggcaacaaaggcaaggggaagattaattacaaactcgagaggaggcgttgtgcttgtgttgggacgtttaggttttgtcctaagaggagtggagaggcttctgcatcttctgtgcaggacactctgccttttatggtgatctttttgcctccctcccagtaaggagggtatccctgcaccttccttctactttgggacactgacttcttcctctgttagtaggttccagagattggcacactctcaccagcctgcccaacctgccctcttcccagtcatttcctgtcattcaaggcaaaagaagaggattgaaaggggacacactattgtagttccacccagcaaacccaaattaaacccaaggttcttctagtcctcattaaccacaacacaggactccacactccatgatctcataaaaagtgggtggcagtcacacacaaatggaaagttcagataaagaaagacacagcccaagcagatacagagcccaagatgtgggtggaacttgcttgagggctgcattgccagtgttctctttatgatctcaggcagtacttcctttggggcatttattccttattgctaggagttagaacaggctgcaggattgtaacactagcttttccttccacttctaatgctactaaattacaataatgaacatattaatggcatatttgattgcaactaacaggtgtgatgtctcttttaagcatttcatacagaactgtcagaatgtaggctgcagtaaaatctgcacatgttcatgcttttcctgtaccgttttaaaggaatatcactggctaggcatggtggctcatgcctgtaatctcagcactttgggaggccgaggcaggtggatcacctgaggtcaggagttcgagaccagcctgcccaacatggcaaaacaccatctctactaaaaagacaaaaaattagccaggtgtggtggcaggcgcctgtaatcccagctactcgggaggctgatgcaggagaatcgcttgaacccgggaggcagaggttgcagtgagccgagatcgcgccaccccatctccagcctgggtgacaagagggtaactccatctcaaaaaaaaaaaaaaaaaaaagtgcaggtcacccggcctcaccctggacctgctgaagtagtgatctgttttaataagccctgcaagtggtcttagtgcaagctaaggtttaagaaccactgctctactctgtggtgatcttgaatctgacactggcgtttaaagctactattctggcctaccaaatggatgcaaataacattgttggcctacttgactcctcctcagatgctggtgtctctagccagaatctggcctccctcaccctgaggctgggttccacccttttctggtgtttctgggcgggctccgcatgctggtcccattggctctgctcttctctctctggatgctggacgactgcctacctgcccaggctcttctctgcattggtagctttgccaaagtggactgtggttgcagatgacctgaacaggattgaaaaccaacccctgaagatagataacagactcagataacaaaaaaatcgtatttatcttatgtaataggttttgagaggattacatatttgaaggtcattcaattcacataccgactaaatccttagcagctccactctggccccttcacctgctttccctcttgaaaaaaccttcgcccaccctcacaaggcaggtctttcccctttggagcccacaggggttgttgtaagaggcggtgtttgcattttgccctggcctggggttctctttatgatcgtgagggtccagccaagtaactctcccagccagttaggaccatccttctgccccctggcaccaccacctaggccctggggttagggcccaaggccattcaggagagtgggtaacagcgatgagatagaggagggagaggaaggctgagggaagcggagaaggggagccagtctctgactgaggaagaggagaggcagtgacaggacagtcgtggactggatatccagggctgtgctttagctgtgcgaccctggctcagtttcttcagagtgatgtggttgggatacatactactcaaaattgttcttttctaaaattttattaagggaaaaggaaacaataaatatggtgggatgtaatcacatataatgcagaactgcctcaagtgctacttaggacctgacaaagaaactcccagcagctatgtcagtaacgtttcctagattcagagtcatgcacacgaggccctgagcagccctggaagctgtgagttctgttctttaaaagtttcacaattagaccccaaatatataagtatattctggattgtttctacaaacaccttataactgcatagtgatcatatgtataatcacattgacttctagtgctggagacttttttttccccatcaaaagtgggagtaaaattgttctgatatttaatattcactagactagaatttcttcatttttttctaacatcagtccctcgctatacatttatattaaatctcaaacccagacatttagagggaaaggatcaactaaaatttaatttggaatggaaattagcatgagcagcaacattctcaggatgcttttcttttttttttttttttttttttttgagatggactctcactcagtcgcccagtctggagtgcagtagtggcgtgatcttcgctcactgcagcctccgcctcccaagtagctgggattacaagcgtgtgtccccatgtccacttaatttttgtattttttagtagagacagggtttcaccatgttggccaggccagacttgagctcctgatctcaagtgattcacctaccttgacctcctaaagtgctgggattgcaggtgtgagcacccagcctcaagatgctcttttgaactttaattccaagaatattagataaagtgatgtaggctatattttgcttatgagtttttatattactgtatctgaaaatgtagaaatttcacttcacaaatcaaaatagacattatttatatgatttatattagtggatgacaaatttaattgaaatagatctctgaggtatttgttaagagaaacagatttataagtattggtaaattttttaagtgtcttttattgtttcctctgaggtaggtttaatatgtgcacttaagttacattttcatgatattaactgtgtccagttttaaattttaaaatttgtgggctgggtgcagtggctcatgcctgtaatcccagcactttgggaggccgaggcgggtggattacttgaggttgggagtttgagactagcctggcctggccaacatggtgaaaccccgtctctactaaaaaacaaaaattagccagctgtgttggcgggcacctgtaatcctagctactcaggaggctgagacaggagaatcacctgagcccgggaggcagaggttgcagtgagctgaaatcgtgccactgcactccagcctaggcgacagagcgagactccgtctcaaaaaaaaaaaaataaaatttgtgtatgtacatgaaggattacttgatttttttgtgtgatatattcacttcatttctaatattataaaaccttatttttggaacaaataaacaggaatgatgggaggaatagtatatgagaccttactgactggttcttgggagtgattgttaacatgggttgcaatccacttttatttttttatttttatttatttatttttttgagatgacatcttgctctgtcacccaggctggagttcagtggcgctaccttggctcactgcaacctctgcctcccaggttcaagcaattctcctgcctgagcctcccgagtagctgggattacaggtgcccaccaccatgcctggttaatttttgtatttttagtagagaaggggtttcactgtgttggccaggctagtcttgaactcccgacctcaaatgatctgcccacgtcgggcttccaaagtgctgggattacaggcgtgagccaccgcacccagctgcgatccacttttaaatggatttgtggaaaaagcacagattatcattaaactaagcggcatttaggtcacacatctcattcatctgatcagtgatctgacaacctgatgggagagtcacatctcctagggtttcaggaatcagtgggagaggcacgctatgaaagggcatgtgaaggaaggctgtgtttttgtgtctgcaggtgtgcacttgtactacgtcgggggagaggtgtatgccgagtgcgtgagtgacagcagcatctttgtgcagagccggaactgcaactatcaacacggcttccacccagctaccgtctgcaagatccccagcggctgcagcctcaaggtcttcaacaaccagctcttcgctcagctcctggcccagtcagttcaccacggctttgaagtcgtgtatgaactgaccaagatgtgtactatccggatgagttttgttaaggtaaggagtgcttgctatcacgttataaaatgttcagtgaaaaacaaaacaaaaaagcaccctgactgatgtggcaggcagttgtgcggtcaattctgatagacaaaaccaatttattattattattattttttgagacggagtttcactctgtcacacaggctggagtgcagtggcatgatcttggctcactgcaacctctgcctcccgggttcaagcgattttcctacctcagcctcccgggtagctgggactacaggcacgcaccaccacgcttggctgatttctgtatttttagtagagacagggtttcaccatattggccagagtggtcttgaactcctgaccttgtgatcctcccatcttggcctcccaaagtgctgggattacaggcgtgagccaccgcgcccagcccaaaaccaatttttttgaattctattgtttttaggaggagttcctctttgagtataaactgtcttgtttagcaattatatgaaaattgttacacattacttttgaggaaaaacaaggtggctatttgattgtttttaatgcagatgataaagtaacaacagtaattttacaggactagtgcaacagagattttttccatccttccaattgccaagcactgttatcactcagtgaatgttggtgaatttatctgaattcagtaagatactctccttactcttagaaagcatacaggcacatggaggagataatatttatgaataagctacaaaaataggcagggttggttctaatacaagataataaactaagtagtgttataaaggtataaacaatttggaatagaaacgggtgtgattaattcagagagcagtatatgttctgttgatgaatatttgttgaatttctcatatcgaatcttattaaggttgctatgaaggctggagaaccaaggaagtttcttagtgggaaggaaagacaactgggtttgtatatggaagtgaaagccttcagtttcatcacctgctattttgtctgttgcaaagtactcgcaaatgagtctagtatttcaaaatatgggcttatcaaagtatcggggtatgtgtgacagttttcttactgccatgattccatccagggaatcagcatggcttgttccaggcatttttttcaaagtaaattttattagcactttaaaattaccatgacaaataatttttctatactcaaattatgtttttattatcactttagtaattatttaaaaagtaagaacaatatagtttccaattttaaaaaacagctgcttgaaattatttctctttcatggtgacaaagcagtttcattcaaatttagtgttttgaaagcatatattataaagttatattaacaaataacttcgaaatcttttcaaatgttctgttgctttagaaacggcagagggcatcatttgaatcatacagttttttttttttccgggtctgtgtttttaaaattaggatgaaatgccaatatctcataggtaattatttcactctgattaaatataagcttatatagaaatctgattttcctaataactagatacatttctcagataggcagcatttacattcataaagctacacaattgacacagaagacaaactgttcctaatactgcaggaacttttaaaataaatacatagtaaatataactatagatcatttttttttaacatttgagatgagcagctgtagctaccactgggctgatggatcagatctctttaaggtttctttcagctctgatttttactgattctaggacttagtcagtcaacaaatgtttattgagcacctgccatgtgcaggccaggcacgtgggacatgccaatgtttactcacagatctctgacctcagggaaccaatattctaggaaggagagatggataataaacaacagccaaaacacagaagaaggatggaaagagaaagtctgggggcagggtgaagggaattggagcacgggggcagtggagtcatctgcacatgagggtgggcctcattgaaaaggtgacaggtcagcagagactggaaggagacatggagctaggcccagggacccctggaggaagagcagaagaagagggaagagcaaggcaacagcatacacctggaaactctgaagagcaggcaggccagtgtggctggggcctaatgagcaggggaagtgagatgagagcagccgcagggaaccatagcaaggcctcctgaacctctgctacgagttcagcggtgactgtaaggaggtggcgagcttttgcagggatcagagcagagcattttcatgatctaacttctattcttaaaggatcgccctgcctgctgtgtggaggatagatattatacaggcaaggttgcaagtagggaaaccacttaggaggctatagtaatagtcaggtgagagtcgcccccacctggagggatccagtacagctgtgagaagtggaaggattctgaattgtgaaggcggatcaggcgtgggagaaaaagaggaagatgaagttagttgccttcaatcaagatggagaagacgcaggtgtaattgagatgtccgttgcattcaagtggagttgctgagtagccagttcgatataagagtctggattcggggagagaggtttgggcttgaaatacaaatttgggaattgtctgcaaagggaccgtatttaactccctaagtgtggatgagaacaccaaaggtttgagtttaaactgagaagagccgggcgtggtggctcatgcctgtaatcccagcactttgggaggctaaggtgggtggattgcttgaggtcaggagttcaagactagcctggccaacatggcaaaaccccatctctactaaaaatacaaaaattagccaggcgtggtggcgcgtgcctgtaatctcagcacttgggaggcttaggcaggagaatcgcttgaacctcggaggcagaggttgcagtgagctgagatcgcaccattgcactccagcctgggtgacagagccagactccatctcaaaaaaattaaaataaataaataagaaagggggctctaggactgagccctgggacacttcaacatttaaagatgggacagaagggacagaatcagcaaagaaaactgagaaagaccaaccagtgaggtagtaataagaccaagaagtgtggtgctttggaagccgagaaaagacagtgcattgatgagaggatgtgatgaactaaatcaaatgctgcccacataacacaaaggctgagagctgatcattcattttaacaatatgaaggccttttttgatcttgacaagaaaagttttgttggcggctggggtgagatgatgatcagaatggatttaagagagaatggaaggagacaaattgagacggctagtatggatgactcttctgagggtttttgccagaaatgggataaaaacatagggcagtagctggtggggggtggagaagtatcttgaaggtggaagacatttcagtgtgttcatatgttgacgggaatgatatagtagacgcaaaagattgcaggagagaaggggaagatttgctggaatgatgtctctgggaaggcaggtctgagagtgcattaatgggtggaccagcttatttggaaacacaaataattaatctgtggtaagaggtagaaaggccaagtatgtggatgcaggtcctgtggaaacttatttctgatgtattcatttttctcattaaaatacaaaataaatatcagttgcaggtatggacagggaaaaaggggttgcaggttttagtggggaggagcgatcacctaggagggggacatgagagaagggactggggggtgggttgtgactgccggggacatcacaggtccacttgaggttctcagtcatgaaagtaaaatgtgatcaggcagcatggttgtgttgaaatccaagttttaaaaaactctacggagaatcactgctcccagtcacagaactgatttacttggctgtgatctcccttcatttttaaatatcctttcattgatatataacatatagagaaaaatatgcaaattaaaaaaaaaattttaactgtctctcctttgaatggtgataaaagggaaattgccagttgaactagagagagagagagagagaataagcaagctttgataatgagccctgaaaaaccaagagcgccttccagttctgtctttaccactttcaggtccagtcactggtctgcagtaaccattttgtgcaagacactgtcctgggcatgaaggggtgaacaaaaggtcaagtttcttcctttgtggaagggaaaatgatttttcagtgcttcccgtgtgactggagtgccagaacctctctagatccgagtattcagttgtgaaccctgagggaatgcactgatttggattcatctgaaggcatctggttggtgtgagagttgacctgtgtttacaggaaggtagaggccatgttctctccctctcaggtctcaggagctacgctggggtgtgggctctgtgccccgctgagctctgcctggggctctggaggctgagtgtaagtgtggcaccatcactcagctcctttcttgtttttcagggttggggtgctgagtatcatcgccaggatgtcaccagcaccccctgctggattgagattcatcttcatgggccactgcagtggctggacaaagttctgactcagatgggctctccacataaccccatttcttcagtgtcttaacagtcatgtcttaagctgcatttccataggatagaggctattgcagggagtggcttgtatcatttcagatttgcaactgaagtttctaaaaacatgtgtaaatacatagaatgtatactgttcttattttttttaatcaccgtttgttttgtgctttctagttaacctgatgccagtacagtgcaattggaaaagcaggactttggtgcctgtgctataagcagcagattttgtgggaggaaacacttgagaggcgatattgtcaacagtatttgaagggtgttagcagaataaaagacagctttagtcagccgtgtcattataaagcatgttgtgtggcctcacagaaacattgaaactgtttatacagcaaaagtcaggtattagcagcactaaagcaaatatcactcagatgaaacaaagcagtgaaacccctacagtttaaatgatgtcacttttagtgctgttggcaagaaaaaaaaaacaacaaacttgtacaatgaattaatgagataggccatagaaactttatttctaaggttgacatacctatagctgggctcctgtgctcatattcagtggtacattttaaacaaactgtgatcggaaaagaaaaaaaactgtgaagccaaaagtcatgttccctcagtctaccactgtaaaaacagagtctaatatgggaaaataaatatgaaaatagcatgaaatgctgtttcccagattgcaagataagaccagaacttggtccaagagccagccacccagggagactcctgctttccacagaggagaccaggttcctgtcgtgctggttgttcgtgtcaggcagtcctgcaaactttgagtctgcgcagcgtgccagaatagcttgtgtttcagtcctgtgtcaagaagcaggtgaaaccaaaggttggagaaaagcatcacacgtcgacttacactttctcatttcccacgttccagtctcctgggaagggcactctttcgccacgttttcctgcctcttggcaaatattaactctttgcagatcactaaagcaacagtaaagactttgagaaaatctagacacattattggatcaatgagttatttaacctagtgtctagtgattatctaacctggaaataaattcccaaggaaagtgataataatttcataatcatctgcaatttctggggaacagtggtactgaataataagacatcttttaaaaatatacacaatattaaaaacctgttcttattttactttagatgagggaggaaaatcccccaaatttctaggtactttcatatatatacttgccatgcactaaacactgcattgcttggaaaaatatttcacaccctctttaaaaatgtacaatttaagatggcagttatgcttgtaacagacagcacttcagtaatccaagaagtttcttcatttatacattttatctcaactctttctagcattagtgcacatggtagtttttctaattaaattgtattcaaggtagaaatgatcatgtgagaaagatatatgattgagctactactgtcacctcttacagttactagtgttagctaatagaaactttcatatatacacatagaaaagaattattacattttacattgaaaaatgtaatatatggcccatgtagtgtatagaaaaatctgtagtttattggttcatcaactatgtattgtgcacctacctatgggtgtcaggtacaatgttaggtactgtagaatcaaatgtaaataagagacagtcccagccctcagggagccgagaacctaatagtgaatctgtttgtacagacatcttcatgtttcagaacttttaaaacaaaacaaaataatgtaatctatcatcttttgcttgaaagaatgtgattgatttcttatctctgttttgaaattatttccttactcttctgcaaagtcaggtaatggattccttgtataaatgctacttttcttccatgtctcaaagttgttttttttcctcccctttcttccctgttttccaataattctccatg

SEQ ID NO: 15832 - DNA, 17723 bp, Human
  misc_feature (1)...(17723): n = A,T,C or G
agtgccgtgagtgggggtgtaagtgacaagccctgaaacgtggaattggttcagtcaaaggggtggccaatgaggatggccccatccctggttggcagttggcaaagcttgacatgcagtagacaatccatctgtgaagctcttacctgtatctcaggactaaatccacatgccccttaagatgggggcttcacagcagtgttgttcagactttgagttgtgacccattaatggactgggaaactcaacagaaggcacgtagtaaggtgagcattgtcccatcaaactttagtgtcaaccgtgtatttccaaacgcattattctattcactcactcactcagtagatacttgttgagcagctactgtgtggcaggcactggggatccaggagaaagtaacacatacaaatgcacctgtgtgtgcgggtgcttgtgtgtatgttctggatcacagcatgaaattcgtctctcgctgtgggctgcagtcagagagcccagcggctgctgctgcctggtggctgggtgggaatgtcagggtactgggggggtggctacttcccatgtgggtcagcaagttacaagaacagaaaaggcctctgtttgaattccttttcggcacccggggaaacgagcagctttataagaaaccctgcccgtagccatccgcccaagtttggtgagggtcagaaaatcatgcacaaaaactgtgttttctttcccgagctattgttagcgcaagtgtagacagtcagccacgttccttgcttcatggaagccagtcttcctcgtaggaccatgaagaccttttcttttctttttctttctttcttttttttttctttgagatggagtttctctcttgttgcccaggctggagtgcaatggcgcaatcttggctaatgcaacctccgcctcccaggttcaatcgattctcctgcctcagcgtcctgagtagctgggattacaggcccctgccaccacgcccggctaatttttgtattttagtagagacagagtttcaccatgttggccaggctggtctcgaactcctgacctcaggtgatccacccacgtcggcttcccaaaatgctgggattacaggcgtgagccaccgtgcccggccagaccttttgttatgatgttattttcccctctttactccattttgctttgccagtttctctactcacctgggccaccacctagagcaagttgcctcatctctccgaggctccgcttccgaaccctgtgaaatgggagtaacagaagtcctgcctcgtgggggtgttgtgctgtgataaatgaagaaacaccttggagaatttagggcagtggctgggcctgaggacagtgtttgtgttgcctgggctggggcagggtctgggccggacggggctctctgaggttggattcctcctgcgaggagagctgtttttctgcaaagccccttcctcctcctgctgaagcttctggatttgagaggctttactctccaggagagtgaagcgagttgggccagagctgagagtctggtggccgagcccacaggaagctggggtctgtggttcagatgccggattgggcaagagtagagaactggtcgctgtgatcctggtcagggatatttggagacacccacagttctggtaaattcggaggcaggaagtgagagggggagggagagagggaaacggcaaactgcaccccagcccctcctggcctggcaccccttccaaatggtgcaatgagtggggtgagtggcgtgtggagttgagcgcagcccaggggacccccctctctgggaataagaacagagatagccccgtcccctgcccccaccccacaaatgagttacagctctgtttcctcttctgtttactgtccaaagtcccaggccaggaggtgccaggttagagcttggacactcagaccctccagtgcaggccttgcccggaccagcccctcctccactctcctctcccctgtgagctccacctgccccagttctcctggctttaacccctccttggccaaggccagggttgcctgcgggagccaggtgtccgctctccacacctttcacaggtaactgaggctggggaggcaactgggacgaggatgcttgggaacaaggaggccttggttcagggatggggaggaccccatgggaagctgtgggtggtcgggtccatgagcgtggggaggggtctcctggccaggtcaaggcccaagcggtctcctgagaagggaaaggacccagcgggatttcaaacctcatcccaaacgccctgccaacctcagatcctacccaggccaccaccccgaacccctccgaccctgcgttccatcccaccatcaacctccacgtgaatctgcacctctgccccagccccagccctcagagcaacctcagcccagcccagcccagctccagctccagctccagcccgggccccatcatggccaaggactttcaagatatccagcagctgagctcggaggaaaatgaccatcctttccatcaaggtgaggggccaggcactcgcaggctgaatcccaggagaggaaatccatttttgaaaggcaagtgtgcagtttctgcggctttgctccccctctgtctcagctcatgattgctctgtccctttgaggtctctgccgcacccactctgtgaacagggactgaggagggcccgacacccccgcttgttccctcacctcaccttcctgtctaccccaggaccccaggaaaggcatgtgccagaggtgtggggagatctggaagataactgcctgcccttctcctcccaacccaagaacacatgtgccccgtatgtgcgtgtgcacgtatgtgcatatgaggaatgcagattcagctgggactctgtgtgtgtgtgtgtgagtgaatgttgtgtgtgtgtatatgtgcgcgagagcgtgcatatgtgtgtgtgtatgtcgtgtatgtgagagggtatgttgtgtgtgagagtgtgttgtgtgtgtatgttgtgtgagtatatgttgtgtgtaacttgtgtgtgagtgtatgttgtgtgttgtgtgtgtatcttgtgcatgtgtgtatgttgtgcgagtgtatgttgtgtatgtgagtgtgtgtatgttgtgtgtatgttgtgtgtagtgtgatgttgtgtatgagtgtgtgtatgttgtgtgtgtgtacgttgtgtatgttgtgtgtgtgttgtgtgtgtgtattgtgtgagtgtatgtatgtttgtgtgttgtgtgagtgttgtgtatgttgtgcgtgtgtgtatgttgtgcgagtgtgtgtgttgtgtgtgtatgttgtgagtgtgttatgtatgttgtgtgtgtgagtgtgttgcgtgagtgtgtgtgttagtgtgtgtatgtgattgtatgtgtgtgtgtgtgtgtgtgtagaggtggggtgagttgggatgggtgggggacgtgagcacagagagatcctggaagatccctgctcctctcatctcccaagacccttccctggatccttctgtaataaatcttgactgaaggacctaagtatcttggacattttttttttagagacaggagtgtagtggcaggatcatagctcactgcaaccttgaactcctgggctcaagccatcctcccacctcagcctcccaagtagttaggacttacaggtgtgcaccactgtgcctggcaaattaaaaaaaattttttagagaaatggggtcttgctatgttgcccaggctggtgggaaaagattttaaggtgagagagatctgagcagtgctaggcagaagggcaagagccaggaatggaggagtgtcaggtgtgtgggtgctggtggtggagccgggttccatggaggcaggaggagcaggggcttggagcttaggaaggggattggttagctgggctggaatgagggactcctcattcctgaggctggccaaccgagggagggccggtgctgggcagggcagggcaggggacaggagggataggaggtccctcccgaggaccactcaggaacaccagtagcatctcctctctctgtagggggctggctggacttcccaccaggcggtgtccccacaggcagaggccctgtccgcctcactctcctctgcaactccagtgcccacacggcacccggtacatagtgaacactcagagagaatacgggatgctgctgaatcttctgagggtgacagaatttagagtttgagcaggaggcttggagagaggccaggatttctgaaattaatgggagagtgagctcacgcgaatgggctgagggacaccagtgagggaccgtctgaagggatgtagcaaagtcaccgcatttccctccagcagcccgggtggtgggggctgggggaacgtcatcatgggagctgacactgatcagctgctcaccggggcccatcttccacttgtctcagcacttgatttttttctgctaccccctttttcttttaaagatttcaattatgcatgtattaagggtcccacagctcactcattctctttccattttttaattcttttttctcccagtgtttcattttatagagttattgctgttcattaagttaactaaaattttccccttcccctgccctgccccgcgggaaggcagctaaggcgtggcgagaaattgagcacagcagctgctggctcaggtgctaagcccatcactgcccgcggccggtggggcaggccggccactccgagtgcggggtccggcgagtccacgcccacccggaaatcgcgctggcccgcaagcgccgctccctccacacctccctgcaagctgagggagccggctccggnnnnnnnnnnnnnnnnnnnncccctccccctcccctccccatccctccctctccctcctccccctcccctgcccctccccctccatccctctcccccctccccctccatccctatcccccctcccctctccccctcccctcccctcctttccttccctcgcttcccctcccctctctctctctcatctcactctgttgcccaggctggaatgcagtagcttgtcacaactcactgtggcctccacctcctgggctcaggcgatccttccacttcagcctcccaggtagctgggactataggcatgtggcaccacacctggctaattaaaaatttttttttgtagagacggttttgccatgtagaggggttttgccatgctgcccagactagtcttgagctcctgggctcaagtgattccccccgtgtagacctcccaaagtgctgggattacagatgtgatccacagtgcctggccctaaatttttcttacgcatttctcatcttccattatttccatccagtgtgttttttcttttctttcttttcttttttttttttttggaggcggagtctcgctctgttgcccaggccggagtgcagtggcgcgatcttggctcactgcaagctctgcctcccgggttcatgccattctcctgcctcagcctcccgagtagctgggactacaggcgcctgccaccacgtctggctaattttttgtatttttagtagagatggggtttcaccatgttagccaggatggtgtcgatctcctgacctcatgatctgcccgccttggcctcccacagtgctgggattccaggcgtgagccacggcgcctggccagtgtgttttttcatttcagacattgtagtttttatctctagaagttcacctggggactcttaaatatcctccacaattctacttaattttttgaacataatgggatatggctataatatctgttttaccatccttgcctgctaattctagcatccgtgtcagttctggatctcttttgatatttatgaacctcctcgttatgcattgtgttttcccgtttcattgcatgccttgtaatctttgattggctgccagacattgtcaatttcaccttgttgggtgctggatatttttgtattcctctaaatgttcttgagctttgctctgggatgcagttaagcaacttagagtcagtttgatcgtttgaactcttaattgttttggtctcctcggactctcagctccatctcctcaacgtggggagtctcttgggctctgcctggacttccctttcctgtcctgtaacctgcagactctctccaaacagtaagctggggtgatcggagggttcctgttgtttgcttcttatccctcagggatctttactcctccttgcctgatgtccagagtcttgaaagctgccatgttctatagttgtctgtttttgttttgattgtttctggggagagaagaactcttcccatcttgggcagaccctgtcttttatgttcaaacttttgcctaagaagcacattacatattttaactcatctaattatccgagcaatccaatcgggtagctacgactgtgatctccattttacacacgagaaaatggaagcatggagaaattgaatgctggtgcatgatctcagagctacctggaggcacagctgggctaccctgtgggcagtctggtttcagggtggatatacagacacgttgctgggctgacccagcattgggagttgataagtcggactgggaagcaggacaggaccctctgagtggagggtgctgaagacagcagtcagggactcagccatggagggccagcttggtggggaacaccgtggtcatggagcgcttctggatggagaggaatgcaaaggccttggaggaaggggtgggggcagtgagagggagggtggggctgtgctcagagcgggagtgggcagtggaggtgtcagaggcctccctgggtcaaatggggtcctgagtgtggctgcagtggggaaggtggaagtcactggtgtgaaaaagatgaagagttatggacagtcacttacaggggcagtgtctgactcaggacagtggcaggaagtgacctggggaggaagattctgggcccctgactgagcctccccaggatgtggtcctgctgggtcggggggtgataggaatgagaagacaaggaagtccacagagtcagggtccaaggcctagaaggtgttctgtttgcaggtggatgctgcaaagagaggagctcagggctgggacaactggagctgctctgggtctggaggcagcagagagggagcccagctctgtgtgcaggaagacgtgggtgtgtgagtgtacgtgtgtgggtgtgtcaggtgtgtgtgtgtgggagggagtatgaatgtgtgcattagcatgcatatgcacatgtgagagtgggtacagcagagcgtggtcatgagtgtgtgcaaatgtgtgtttttgagtgaagtgagcaatgtgtgagtgtgtgagtgtgtgtgagtttgtgagggcatgtgaatgtgtgtgtcagtgctgtcagggtgcagatggatcaaggggcaggagaggtacctgtgagatgacctcgggctgaggggagcaaatttagtgtggaacgaggtttctagggaagcgagggcaaagggcgctggggaggaggccttgcgtggtgggggatgaggacaacaggtgggacctggagggttgtgcttggagagtgggctatggtggaatgacccagatttaaggatctcaatggaattttggcaggggagggactgttccagtatggattttaggaagaacacagggcccagcttctggagtctccaatctgaggggacaggagccttagaagagctgagactaaggcccgaggtgatctggaggcctctgccactggctggatgggaggaaaaccattcacagatcccccttctcaggatgtgtgcctaggcagggccgggtctgcccccccgccccctgtgcgtctcccagtcccccagctccaggatccgggctttgcacacagctgatgtgaatatcctgagtcgtgtgcatgggtgtgtgtgcaccagattagctgcgtgtgtatatttatacatggtaatatgggtgcgagtgtgtaagagtgtgtgtgtaatgctcaaatgctggggtcaaagcctatgatgacccccccccatggccccaaccaatccccccgcccaggttatgcctcctcaggcttcggtgccctgtctttaccctccggctccccacacccaggctgccggctcctgatgcccctctcccacagggccacctcctgcccagcccctggcacagcgtctctgctccatggtctgcttcagtctgcttgccctgagcttcaacatcctgctgctggtggtcatctgtgtgactgggtcccaaagtgagggtcacagaggcaagcagggatgggcaaggggtagggaaagagacatgggcagtggcgggcagcgatcggggcgatgggaggggaagggatggaggcggggtggagcacaagctggggcaaatgcggggacattgaggggccagtcacatggacagtgatggggacacggcccctctgcctcatcctgcccccactaccacctgacaaggtgcacagctgcaagccgagctgcggagcctgaaggaagctttcagcaacttctcctcgagcaccctgacggaggtccaggcaatcagcacccacggtgaggggctggacggctgggttctcatttatccgcacaggtttgctgggctcagtgccgagtctgcaacagggctgtgtggggtgccgtgggggtgcaggctgggcaaggcgtccaggggccctgggggatgtataggagggaggcaggtggggacggacgaggttagtgccaggtggagaggttggatctgcgacacccggaggtgaggaaggcaccatgtcttgggcctgtgagcaaatcgagtgtggcaggcccatcggaggggcaggcaggtaaggggtggccagagagaggtggggaggggcccggccacgcaggtgagccgtgctgacagagcgaggctttattttgagaaaatggggacccattgaagggactgaagcaggagagtggcctgagccactgtggcagtgcagggagcctgggtggggtcaaggaagccaggaggtggacgcctgcatcgcccaggacgaggcgctggcccccggtcccccagcagcatgaggacggagggaggctcagcggggaaacagctggctttccgcttccaggaggcagcgtgggtgacaagatcacatccctaggagccaagctggagaaacagcagcaggacctgaaagcaggtcagagagcctccggggtgtgtgcacatgtgcgtgcatgtgtacgtgtgcggtgtgtgtagtgtgtacgtgtgcggtgtgtgtagtgtgcacgtgtgcgtgcgtgcgtgtgtgtgcctgcaagcatgtgtatctgtgtctctctccgtatgtgtggtgtgatatgtcatggatctgtgtgtggtgtgtagtgtggtgtatatgtgtgtgttgtgtgtgtatgcatgtgtggtggtgtgtgtgagatgagtctgtgtgtgtgcggtatggtatgtgtgtgtacgcatgtgatgtgtgtggtgtgtctcttggtgtgtttgtgtgtgtgtgatggatctgtgtgtggtgtggtctatgtgtggtgtacatgtctgtggtgtgtgtgtggtatggtgtgtggtgtggtctatgcatggtgtacgtgtctgtgggtgtatatgcttccccagccacaggctggagcctagcaggtggggaccacacctgccggcagcactttcagcctgtctgtcctagatcacgatgccctgctcttccatctgaagcacttccccgtggacctgcgcttcgtggcctgccagatggagctcctccacagcaacggtaggggtggggccgtctccaggcccagtgtgcctgcccctccggctggatctcatctccctgccccctgtcccctcaggctcccaaaggacctgctgccccgtcaactgggtggagcaccaaggcagctgctactggttctctcactccgggaaggcctgggctgaggcggagaagtactgccagctggagaacgcacacctggtggtcatcaactcctgggaggagcaggtgaggccacgcttcccacaggcaggaggaagcccttggaaggcctgctctgggaggctggatcaggcttattttatccattttttttttttttttgagatggagtctcgctctgtcgcccaagctggagtgcagtggcacgatctcggctcactgcaagctccgccttctgggttcacgccattctcctgcctcggcctcccaaagtgctgggattacaggcacgtgccaccatgcccggctaatttttttgtatttttagtagagacggggtttcaccgtcttagccaggctggtctggaactcctgacctcatgatccgcccacctccgcctcccaaagtggtgggattacaggcgtgaaccaccgcgtctggctgaacttcaaagtattttaatgccacagtagttaagccatatgatacaggggccagaatatatgtattgtttgcattacatcaggctctgttagtactttacagcatactgtgagtacgaacatattttgctttactgatcaggttgaacttgccaacatttcatcagttttgacctataaaaatgtcagtttcatgcagttcaacctaagatctcagtgctctgtgatttggcacacaataagctcatgaccactacaacttcgtggtggacggtgctttcgtcactatgaagccaacgtgtgtcccagttaatgctttttgccttgaatttatctgatatataaataccacggtccttgatttttttgtcacttgcatttgcttgctgtatctctgtccatccttttgtttcttacctttttgaatctctgttttaaattaatgattctcagtcttgactgtacattgcaatctcttcaagagttaaaaaaaatatatcgactcctggatctcgcccttaaaaatgctgatttaggccgggtgcagtggctcacgcctgtaatcccagcactttgggaggccgaggtgggcggatcatgaagtcaggagttcgagaccagcctggctaaaatggtgaaaccctatctgtactaaacatacaaaaattagccgggcatggtggcgggtgcctgtaatcccagctactcaggaggctgaggcaggagaatcacttgaacccgggaggcagaggttgtggtgagctgagactgcgccattatactccagcccgggtgacagtgcgagattctgactcaaaaaaaaaaaaaaaatgctaatttaaattaatcttggcttcatcctggaccattccctgaggggcagcacagggcagctaagcttaaggtatttctcctatataggttttttgttttgttttgtttttgatacaagatctggctctatcgcccaggttggagtgcagtggcatgatctcagctcactgtaacctgtgcctcccgggctcaacggattctcccacctcagcctcccaagtagctgggactacaggtgcacaccaccatacctgggtagttttttgcatttttagtagaaatggtgttgtgccatgttgcccaggctggtcttgaacccctggcctcaagcgattcgcccgcctgggcctcccaaaatattgggattacaggtgtctgagccactgtaatccaaaaactgcacctggcaggttttgtttttgatgtttaaaaatctaataagtaccttttcttttaataggtgagtgtctcatttacattctaatagatatgtttaaccctagtcctttcttttttctgctttacatgcttcttaattttcttacaattgctatgtgagaggtgttctttttgttttcttctttatggtattttggaaactatgtagtttatttagagttattccagtgattacttgtataactttaaataataggctgaaaattattggctttgaaaactaaaagtttgtataacttccataggaaaggtgaggagaccaggatacctcttattcccatgtgtctgagtctttcctttcctaggttccttaagtgttgtatctgaaaaaaaaaaaaaattttttttttttttgagatggagtcttgctctgtcgcccaggctggagtgtaatggcgcgatcttggctcactgcaacctctgcctcccaggttcaagcaattctcctgtcttagtatcccgagtagctgagattacaggcacccgccatcgtgcctggctaacttttatattttttagtagagacagggtttcaccatgttggtcaggctggtcttgaactcctgacctcgtgatccgcccgccttggcctcctgaagtgctgggattacaggtgtgagccaccacgcccggcccctcaagtgttttatctgaaattttttgtttatttttattttttgaaatggagacttgctctttcgcccaggctggagtgcagtgacacgatctcgactcattgcaagctctgcctcccggttcaagcaattctcctgcctcagtctcccgagtagctaggattacaggtgcctgccaccatgcctggctaatatttatatttttagtagagacaaggtttcaccatgttggccaggctggtcttgaactcctgacctcaggtgatcctcccgcctggccttcccaaagtgctaggattacaggcatgagccactacgcctggcttttttttttttttttttttttaagacagagttttgctctttttgaccaggctggagtgcaatggcacgatcttggctcactacaacctccgcctcccaggttcaagcgattctcctgcctcagcctcccaagtagctgggattacaggcatgcgccaacacgcctggctaattttgtatttttagtggagatgaggtttctccgtgttggtcaggctggtctccaattcccgatctcaggtgattcacctgccttggcctcccatagtgctgggattacaggcgtgagccaccacacctgggcttttttttttagtatgtagctcaaacttttcatttcctttccttatcatgttctcttttttttttatatcttctttcatgttttatgtcattctttttaaaatttttgaagcatgtaaagaaactgttcttgggagcggggagggagagcattaggagatatacctaatgttaaatgacgagttaatgggtgcagcacaccaacatggcacatgtatacatatgtaacaaacctgcacgttgtgcacatgtaccctaaaacttaaagtataataataataaaaaagaaactgttctccaacatcccctcatattccgaaacaaggcttcttttcaaagtctatttttcacctctctttttgatatcacagttcatttttcatctgcctcatcttcctctttctttttgggggcataagttccatgatgattttctccattacttttgtgaatgggcacagtgctttctttcctatggttcacccaggaaagggggaatgaattctcccggactgtcttctctgatcatctggcatgatttgattcctcctctcagtctttaacacggcgggctggatactgctaatttgtagtctgctcagttgttctgtttctcgtggtgatgggagggagggctggcagcaggtagcagcacatagtgtgtgttgtctccaggcactttctctccaactccgttgactcctctgaatttggggagcagcctcacctgcctctgagggctgccccttcatgcatgggactttgtcctatttgtgggattccagaatttagggatgccccagtttctgatgctcaatcggaagaggtgaataactgcaaccttagttgtttttctagagagtgagagtagaattaggcaattgtccttcaaatactgttggaaggaaaattccaggctgtcaaagggaattgttaagtgtgcacgttgctcaacggatccatccctctccactttctccacaaaaccaggtgaccacaccttcccctcctaccctaccgaaccacgggacctaggtccccaggaacagctgtatgtgtaagagaaagccacttggaggggctaccgtgctgggagtgtgggtgcgcgtgggtcccggggagctatctgcaggctcgaagtccactttcacccaagcccctggcaactggctgtccgggctgcttcctcacaccccggtgtcttcctattttgccccgattgtcagactccacgtagctagatcataatggggccctgggcagtgggtccaagcttagaagctcccgggcctgacagatctcaggaaatgacagctacacatagaagcgagagctaccaggggccaatgtacttgagaggccagtgaaactgagatcttcagtgggtctggggtctggggggcagtaagagcagggaccagggtcgggatcccaggagttcgaggctgtgggcagaagacagggagagaaccggaacttgggtagagccataagctgggaatgaagggggacaccggcccagggctgtgaacaggggacagtggccactaactcaggtacaggattggctctctggctctgcaactccctgcaaaatgtggtcactgcagtgcccatcttagagagcttctgaggattaaatgagatcatctttgcacagacagcacgaagtctagcctagcaaatgtgcactgaacagtagctagagtgacggaagaaaaagctaggaagcagtcttgtcgggagctggtgcttcagcctgagggcagatcaggctggggaaggctgagaggggccacagttccatgcctgcatggagggaggagaaaggcacaagagactagaaatttcctgtttgcctgtgtttccagaaattcattgtacaacacacgaaccccttcaatacctggataggtctcacggacagtgatggctcttggaaatgggtggatggcacagactataggcacaactacaagtaagtggcctcttccctcatctccttgttagatttctctggggacagccccctggcctttcactccaagctaccctgactcgtccctcagggaccaaattccccaatcctctcctccccagactccaacccctccaaagctgtgctcttctgggctgggggtgagggttgctgggactgggcataggaaacatctttctctgcggttgggttctccccagactgggtagcagggcacaccccagctccactctcggccttcaaggaaaatggtcatgaagaggaggaggatgggtaagtcgctttctcaccaccgtggcagagtccgagttttctcttgcctccttaggaactgggctgtcactcagccagataattggcacgggcacgagctgggtggaagtgaagactgtgttgaagtccagccggatggccgctggaacgatgacttctgcctgcaggtgtaccgctgggtgtgtgagaaaaggcggaatgccaccggcgaggtggcctgaccccagcacacctctggctaacccataccccacacctgcccagctctggcttctctgttgaggattttgaggaaaggaagaaacactgagacaggggtatggggaagagctgagcaaagagagaaaggaggtagtttaagagtccctgaccctggaggactgagatcccacctccttctgtaattcattgtaattattataatcgtcagcctcttcaatggcgtaggaaagaagaaacaaatgcttgaatctctgtgtggcctggttattgggaactgagaaacagcatgcaaagaggagggagaggggagggcatggaagacgcaaggcgcgcatcctagacagctgctccttggtccctaatcccgagggacattggtcagggaaacgggaaaggggcttggagcagacaggcttagtggctggcactggtgggaaaggggtcggccgggctgtggctggagggtccgcctggctcccagtgagaggtgacagcgtgctggcagtcctcacagccctcgctcgctctcggcgcctcctctgcctgggctcccactttggcggcacttgaggagcccttcatcccgccgctgcactgtgggagcccctttccgggctggccaaggccggagccggctccctcagcttgcagggaggtgtggagggagcggcgcttgcgggccagcgcgatttccgggtgggcgtggactcggcggaccccgcactcggagtggccggcctgccccaccggccgcgggcagtgatgggcttagcacctgagccagcagctgctgtgctcaatttctcgccacgccttagctgccttcccgcggggcagggcttgggacccgcagcccgccatgcctgagcctccccgacccccgctccgtgggctcctgtgcggcccgagcctccccgaccagcgccgccccctgctccagggcgcgctcagtgccatcgaccacccaagggctgaggagtgcgggcgcagggcgcgggactggcaggcagctccacctgcggccccagtgcaggatccatggggtgaagccagcggggctcctgagtctggtggggacttgaagaacctttatgtctagctaagggattgtaaatgcaccaattggcactctgtatctagctcaaggtttgtaaacacaccaatcagcaccctgtgtctagctcagggtttgtgaatgcaccaattgacactctgtatctagctactctggtcgggaagtcgagaacctttgtgcctagctcagggattgtaaacgcaccaatcaggccagataagagaataaaagcaggctgccccagccagcagcggcaacccactcgggtcccctgccacactgtggaagctttgttctttcgctctttgcaataaatcttgctgctgctcactctttgggtccacactgccttaagagctgtaacactcaccacgaagttccgcagcttcactcctgagccagtgagaccatgaacctaccagaaggaagaaactctgaagacatctgaacatcagaaggaacaaactccagacacgccgcctttaagaactgtaacactcaccgcgagggtccgcggcttcattcttgaagtcagtgagaccaagaacccaccaattccggacacaccagggctcccaaaggaaacatctttctctgcggttgggttctccccagaccgggtcgcagggcataccccagctccactctcagccttcaaggaaaatggtcacgacgaggaggaggatgggtaagtcactttctcaccaccgtggctctgtctttttgaccccaagcggatctagacatatcttcaacacagggtgtcaccaacaatctccacagtgggcaaacttcccgctccaagaacattctgaaactgaccttaaaaagactattcagcggttatattatttatttaagttggagtcttgctgtgttgcccaggctggagtgcaatggtgcggtcttggctcactgcaacctccacctcccgggttcaagcgattcttctgcctcagcctcccgagtagctgggattacaggcatgcgccaccacacccagctaatttttgtatttttagtagaaacagcgtttcgccatgttggccaggctgatcttgaactcctgacctcgggtgatccgcccgcctctgccttccaaagtgctgggattataggcatgagccacggggcccggccccatatttttaaatttttaaagtacagaagtaatacat

SEQ ID NO: 15833 - DNA, 9740 bp, Human
  misc_feature (1)...(9740): n = A,T,C or G
tcgctatgttggccaggctaatctcgaactcctgacctcaggtaatccgcccggctcggtctcccaaagtgctgggattacaggcatgagccgccgcgcccagccgggtgaccactattccgaccgaaataatgtaggttcatttgcctgaataagcccgattgtaagtgattatattagaggatgtttaattaacagcccaacagtcaacaaaatcactggccattgtcccagcacatataaatgacatggtggttgtcaggacacagacaaaggagggcacacacagacctgtcacattttatgcaagagatgtgttcctgaatatctcacatcattgaaaactctcaaaattcaagccttgttttctcactgaaataactgtaaaataggatttggatgacttcacatttgggcctaaagtgagacttattatcttttttttttttttttttgagatgaagtcttgctcttgtcccccaggctggagtgcaatggcgcgatctcagctcactgcaacctccgcctcccgggttcaagcgattctcctgcctcagcctcccgagtagttgggattacaagcgcctgccaccatgcctggctaatttttatatttttagtagagacaaggtttcaccatgttggtcaggctggtctcgaactcctgacctcagatgatccgcccacctcggcctcccacagtgctgagattacaggcatgagccactgtacccagctgatacttattattattattattattattatttttttttttttttgagatggagtcttgctctgtcaccaggctggagtgcagtggcataatctcggctcattgcaacctccacctcccgggtttaagcgattctcctgtctcagcctcctgagtagctgggattacaggcatgcaccaccatgccctgctaatttttttatttttagtagagacggggcttcatcatgttggtcaggctggtcttgaactcctgacctcaggtgatccgcctgcctcggcctcccacagtgctgggattacaggcgtaagccactgcgcccagccgagacttatctttaatattgcctgatttccaagtgagcataattcaaattcacatggctctctctgaagccccgtggggctgtgagggaccatcgtttagcatctctgggacactggagcccagctgtgtcaacgggatgggatcctggctctgtgtgatgggtgtggttctggggcccgaacgcagtgcctggagtcaggctgcccaggttctagtctaccctttgctgcttccttgcagcatgaccctgggcaagctcttaccttgtagggccttagctttctcatctgtgaaatgggatgtgctctggggataatgagagaagttcatgaacgcagtgacctgaggcacacagtagtagtgagtggaggtttgctggcaccagtcccagcggaggctctcctgcctttcctggaaccaagctggccctcatgctgcttggaggactttactccccaggagagggaagcaagtcaggccagagctgggaagcctggggctcagccccacaggaaactggggcctgcggctccggtgccagggtcacaggtctggattgggcaagagcagagaaccggtccctctgatcctgttcagggatatttggagacaccaatagttctggggaatttagaggcaggaagcgaaacggggagggaggagggatatggcaaatcccaccccagcccctcctggcctggcacccctcccaaacggtgcacggaagagtgaggtgactggcatgtgtgggggcaacacgattctcctccctggggagcagagcagaggcaacccatcccccactcccacccccacactcccctaagttccaatccatttccacctctgtttactgtccaaagtcccgggcactggagatgccacgtttggcgtgcttggacacacagacacgcagacacagagacaccggggcccagggccctcctatggaccctgcccgctcccctcccattgtccacggctgtccgcccacccccattctccaagcttcagccccctccttagttcggcatctgcacagcactgaagaacctgggaatcagaccctgagaccctgagcaagtaaaatgggaagagaggtggcgggaggctggctgggggtgcaggggtgcggagggaacccagggtgtgttggggggtgctgggtgggaaacatcagaggatggattctggatgtcaggcctgggaggggatggaggaaagaagaaagctcccggtggggcgcggtggtccacgcctgtaatcccagcacgttgggaggctggggtgggtggattgcctgagctcaggagtttgagacaagcctgggcaacacggtgaaaccccgtctctactaaaatacaaaaaagtagccaggcgtggtggcgtgcacctgttgtcccagctactccagaggctgaggcaggagaaccgcttgaacccgggaggcagaggttgcagtaagctgagatcatgccactgcactccggcctggggacagagcaagactccctctcaaaaaaaaaaaaaaaagaaaagaaaaaaaagaaaaagaaaagaaagaaagaagaaaggtctccatgatggagccgtcaatcagatgggagtaaagagatgggcccctcattcccactctagtcctggtgagcccccacctcagccccagcctcagtcttgactcagtcccaggtccagcgccagccctatcatgaccaaggagtatcaagaccttcagcatctggacaatgaggagagtgaccaccatcagctcagaaaaggtgagggccaccttgccctgcctctgcaaggcgagaatttggcggttctccaccccccagccacagctcctactcttgcccgtgagcctggctctctctctgggtctgtctccctcccccaacactgggaaaggtgtcggaactgcctctctcaggagaggggcggagtgtggggttggagtccctttattggtgacaggtgcccaaagctttcctgtgcctcctggccctcggaggtggacccgggggtgtgggaacagctggaagctggagagatgaggtcactgtcggcttcctatgacgaagtcacgccccctcttcctttccccttccaacaccacccagggaccccggtcgtgcgagcgtgtgcgtgtgtgtgtcagtgatcagtttggtgaagggggaaaaggtttctgtgaagggtctgaggattctgtgaggggggcgatgaggggtctctgacctgagggagaacgagactcttttgcttcaaaaacaaattccccttgacccatttctttgtcctccgagcagggaattgtttaggctgagcaaggatgaagttcgtgggggatggggtgcagcgcgctttgacggaaggagggtccgcagcggaggagacccggcagggaggcccccccaaccctccagctctcagggcacagggctaacgtgtctcttccccctgctgggtggaagacttgagggcctgaatggtagctattgcaccttctctccctgcacgcagccaaagacaagtggaattcatggacagagaaagaaaccttccttctttccccactttcaggggaagcagcgactccgaggcgcgggccactcaattgcgtttcaaggcgcgggaggagggggtggactgaggttcctggattggctgcagtgacgcagtcatgccattaggtgtcagcaaaagctcagggcctcggtgggatggggcggctcagcgcttagcccccttccccagccctcttttctccccgatttccagttgcctctggccctgcagggtcgcccaccgcccgcatttcttcatgtacatggttcctcctagactactagggccgccttagcttgctacccttttaggaccctggagctgtgccagggtcccctctgtccccgcgctcctgacaccccctcctcttgcagggccacctcctccccagcccctcctgcagcgtctctgctccggacctcgcctcctcctgctctccctgggcctcagcctcctgctgcttgtggttgtctgtgtgatcggatcccaaagtgggtgccccaggggtgggaagggggcaacattggggggtgttgacgggggaccgtggcaagggagtggtgggtgcagtggtggcggacacagcgatcccgttttcttctctctgcacgctgtcctggccagactcccagctgcaggaggagctgcggggcctgagagagacgttcagcaacttcacagcgagcacggaggcccaggtcaagggcttgagcacccagggtgagggcgctggggcggggctggggctggggctggggctggggggctgtcgggaacgctgagcgagcctctcccgcaggaggcaatgtgggaagaaagatgaagtcgctagagtcccagctggagaaacagcagaaggacctgagtgaaggtcagagagggagtgtgtgtgtgtgtgtgtgtgtgtgaaagagagtgagaatgtgtggatgtgtgtgagaaagtgtgagtgtgtgtggatgtgtgtgagaatgagagggagtgtgtgtgtgtgtgagtctgtgtgtgagaatgagggggagtgtgttttgggtgtgtgtatgagagccttgtgtggatgtgagaatgagagggagtgtgtatgtctgtgagtgtgagaatgagatggagtgtgtgtgagtctgtgtgtgagaatgaggtgtgtgtgtgtgagaatgagatggtgtgtgtgtgggaatgagagggggtgtgtgtctgagtgtgagaatgagatagagtgtgtgtgagacagtctgtgggaatgagagggagtgtgtgtgagagtgtgagaatgacggagtgtgtctgtgagtgtgataatgaggtgtgtgtgagtctgagtgtaagaatgagatggggtgtgtgtgtctgtgagtgtgagagtgtgagaatgaggggtgtttgtgtctgagtgtgagtctgtgagtgtgagaatgagatggggtgtgtgagtgagtgtgagaatgagatggggtgtgtgtgtctgtgagtgtgtgtgtgtttgtgagtgtgagaatgagatggggtgtgtgtgagtgtgagaatgagatggggtgtgtgtctgtgtgtgagaatgagatgggtgtgtgtgtgacagagtctgagtgtgagaatgagagggagtgtgtgtgagtgtgagaatgagaaggagtggatgggtgtgtgagtctgtgtgaatgagggagtgggtgtgtgtacgagtgtgagtctgtgtttatgtgtgagaatgtgtcagtgtatgtgtgtgagaacgtgtgtatgtgtgttagtgtgtgttgcgtgtgtgggggaatgagagggattgtgtctgtgagtgtgagaatgagatggagtgtctgtgagactgtgtgtgaggagtgggagtgtgtgtgagaatgagatgggtgtgtgtgtctgagtgtgtgtctgtgagaatgagagggagtgtgtgtgtgtgtgagagcctgtgtgaaaatgagaaggagtgtggatgggtgtttgtgagtgggagagtctgtgtgtttatgtgtgtgagaatgagggagtgtgggtgtgtgtgcgaatgtgagtctgtgtttatgtgtgtgagaatgtgtcagtgtatgtgagaacgtgtgtgttagtgtgttgcgtgtgtgagaatgtaagtatatgtgtaagtgcatgtgagtgtgtgtatgtgcgtgttgtgtgaatgtgcattgtgtgtgcatgtgtgaaagagtatatgtgtgttgtgggtgagtgtgtgtggtgtgtgtagtgggtgagggtgagtgatttgtaccccagaactaaggtgtccagggagggttttctggacaaatggtgcctcagccccccctggaagagcctcagtccagaacctcaccctccagagtttccacctacacacctgcctgtcaaaagacagcaaactccacgagagccacttgccacaagtatataggatctaatatgtttgtttgttttcatataaaattaatttcaaattaaatcttcctggatgatgaggagttaccgaatgggtacaaggtacatttgtttgggtgatggagattctaaaagccctgagttcaccactccacaatctatgcatgtcacaaaattacacttgtttcccataaatttataaaaataaataaagctgggccgggtgccgtggctcacgcctgtaatcccatcactttgggaggttgaggtgggtggatcgcctgaggtcaagagttcgagatcagcctggccaacatggcgaaaccccatctccactaaaaannnnnnnnnnnnnnnnnnnntgtgttgtgtgtctctgtgtgttgtctgcgtttgtgtctgtgggttagggtgtgttgtatgtgttgtgttttgtgtgttgtccgtgtgtgtgtatgtgggttaggttgtgtgtgtgtgtgttgtatattgtctgtgtgtgtgtgttaggatgtgttgtgtgtctgtgtgagtgtgtgtgtaagggtgtgttgtgtgtgtaggagtgtgtgtgtgtgtgtgtatgggggtctctcaggccaactccgctgctgtttgtggcaatgcgacgggtgttcgggtcccagcaggaggatgtagggctgacctcgtttcccgtttccctccccgtggtttccgcatctcctcccgctcccctccgcccggtctccccagatcactccagcctgctgctccacgtgaagcagttcgtgtctgacctgcggagcctgagctgtcagatggcggcgctccagggcaatggtaaggaggccagcccggcccgctctctgcctccccccttctctgggcagcgcttagcccctgcgccccgtttctcccgctcaggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcaggtgaggacccggagggtctgggaggctggctggcctcggagagatcaccacccgccttctctctcctcagaaatttgtccagcaccacataggccctgtgaacacctggatgggcctccacgaccaaaacgggccctggaagtgggtggacgggacggactacgagacgggcttcaagtgagtgcgcgccctccctcggcctgggtccggccgccttcgcgccctggggccctgggctgaggagtctggagcgacccgcctgcggatccgacctcctggggcccacagctggctctgtccccaggaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagtttgcaggttatcattgtgaacttttttttttttaagagtaaaaagaaatatacctaaaccttctgttagttgtctggttattggggattcggaagcaggagtgggctggttggcattacgaagccttagcgggtgctgtggcatcatgagaactgtgtgggctttgggccagaatggccagactttgttatttacagatacgtgagtttgggcaaattattgttctctgtgtcccagctgtaaacaagccatcttactggaggccatcctacttggagcaatacccccaggaggagaactacccgaattttttttttgtaagatggagtcttgctctgttgcccaggctggaatgcaatggcacgatctcagctcactgcaacctctgccccccgggttcaagtgattctcctgcctcagcctcccgagtacctgagatcacaggagtgcaccatcacgcccggctaatttttgtatttttagtagagaccgggtttcaccattgttggccaggctggcctcgaattcctgacctcaagtgatctgcccccctcggcttcccaaagtgctgggattacaggcgtgagccactgcccccggcagaaccacccgaatttgttgagtgcttcaacaacttcgaatgaaactcactggtgtcctttgcattcattacagcaaacagaagcagtgttcatagacaggtagcagatacaacgaacacacaaccaagaatcaccaaacatactaggaaaaccagtactgcggaacagaagcaacaaagcggatagaatcaacaaccaaggatgggagttaggacaaaccgattcagacatggaactgtgaacaaaaattgccaaagtattcacccataaacaagacctcaagtgattcctaagaggagcaatgctctgaccacagtaaaataaagttagaaatgaacgtgaaagtacagccaagaagagatctaccaacatataattttctcaccatctttttttgtattactgcctaagtaattctgagtttaagagaaaatcgaaatgaaaaaatcaagtgatttagaaatacactacaagagtactgcatttgctgaaaccgtgggatgctcaaagtagttctcgggagaaaatgtaagtagagataagcacttctattatttatttttatttatttatttatttttgagatggagttttgctctttttgcccaggctgaagtgcaatggcgtgacctcgtctcactgcaatgtccaccttctgagttcaagggattctcctgcctcagcctcccgagtagctggaattacaggcacccgccaccacgcctgactaattttttatatttttagtagagacggggcttcaccattttggtcaggctggtctcgaagataaacacttttactaaaaaacaagaaaggctgacttgaaatatgctgtttcaactcaagaaacttgaaacagaataagataaatcccctaaagtagaagaaaagaacttataaaactataagcagaaataatgaactagaaaataaaaatatagatatgatcaaaaaaagtaaaatttgatgcttaaaaaaggcaaataaggccgggcatggtggctcacacttgtaatctcagcactttgggaggctgagatgggcagatttcctgaggtccagggagttcatgaccagtctgaccaacatggtgaaactccatctctactaaaaatacaaaaaaattagccaggtgtggtggtgggcgcctgtaatcccagccattcgggaggctgaggcaggagaattgcttgannnnnnnnnnnnnnnnnnnnaggcaggagaaattgcttgaactagggaggtggaggttgcagtgggccgagatttcgccactgcactccggcctgggtgacagggtgacagagcaagactctgtctcaaaaaaaaaaaaaaaaaaaaaggcaaataaaataaaaatgaaggagaaaaaaaggagacacagacataactttagaaagg

SEQ ID NO: 15834 - DNA, 14641 bp, Human
  misc_feature (1)...(14641): n = A,T,C or G
agaaaaggaaaagggcgtgaggtttcggtcatttttgtcaaaggaaatcagatgaaaaggggtgtacaaaggaccaggtctcgtgagcgcagccaatcttgtccgctcccaagcgactcaggctcttggcaggacttgctgtagagtcccagacggagttagccactgagtccttcagcgacccaggaaataacaacactgttggcaggtgggggagggcgcccgggaagatatccaatagtggcgtcaggcaagaggacagaaatgctcctttcattcacctttcgaagcagagcatttggtccccgttggcctctgactctctgttgcggcaatctagatgttaccagaattcccgtgtttccttcatattcaaaggcacaggaaatctggggtgcaagcggactgctgtctctcaaggaatagaagtctgtgacaaacgtatagaaatgagtttcatgttgaacaagatccgtttctgcgttcctccctcatccagccttgattctccagatgcttaccaacttcttaatatttacctcaactgcaaggctttcaaccggcgcttttgttagaatactactatcttcccattaaagcaatgtccacactcagtttgcttggtgaaaatgttaataacgcacacttagaaaaacggtgataaccgttgcttgcataaagtggccatttgaatagactttggatctgatttagagatttagggatggatgttttaaaaaaagcaaaagtagtaacagactatagcattggtaatgtgtgtgtgcatatatacatattatttttaaaaaaataaagttcgattatttcacctggcttgtcagtcacctatgcaggcgtctgagcccccgggtttccaggagccccccgtataaggaccccagggactcctctccccacgcggccgggccgcccgcccggcccccagcccggagagctgccaccgaccccctcaacgtcccaagccccagctctgtcgcccgcgttccttcctcttcctgggccacaatcttggctttcccgggccggcttcacgcagttgcgcaggagcccgcgggggaagacctctcgtggggacctcgagcacgacgtgcgaccctaaatccccacatctcctctgccgcctcgcaggccacatgcaccgggagccgggcggggcaggcgcggcccgcaaaggacccccgcgatggagacgcaacactgccgcgactgcacttggggcagccccgccgcgtcccagccgcctcccggcaggaagcgtaggtgtgtgagccgacccggagcgagccgcgccctcgggccagcgtgggcagggcgccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagccccacctcgcccgggcggagacgcacagctggagctggagggccgtcgcccgttgggccctcaggggcctgaacgcccaggggtcgcggcgagtccacccggagcgagtcaggtgagcaggtcgccatggcgatgcggccccggagagcgcacgcctgccgcggtcggcatggaaacgctcccgctaggtccgggggcgccgctgattggccgattcaacagacgcgggtgggcagctcagccgcatcgctaagcccggccgcctcccagggtggaatccctcgacacttggtccttcccgccccgcccttccgtgccctgcccttccctgcccttccccgccctgccccgcccggcccggcccggccctgcccaaccctgccccgcccttccccgcccagccggccacctcttaaccgcgatcctccagtgcacttgccagttgttccggacacatagaaagataacgacgggaagagcggggcccgctttggggtccaggcaggttttggggcctcctgtctggtgggaggaggccgcagcgcagcaccctgctcgtcacttgggatggagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtgacgcgatctcggctcactgcaacctccacctcccgggttcaagcgattctcctgcctcagcctcccgagtagctgggatttcaggcacccaccaccacgcccggctaatttttgtgtttttagtagagatgggatttcaccatgttggccaggctggtcaccaactcctgacctcaggtgacccgcccacctcggcctcccaaagtgttgggattacaggcgtcagccacggtggcaggccagttgatttcttaagatcaccttgaggggttcggttttcagctagaaatagtgattagttttctttgttattttttccactatcaaggaaataggtctaggaactgtttgggttatgtatattaaagtaatttaagggctgggctaaaaggaaatgtgaatgcttccaaataaactgtggaactggggttcctccaggttagagcagtgttcacattgatgcaggctgtgcctaaagcaaacctggataatcttggctgtgttcattgcggatagtgttaaaatcaggattagatcaggctagattagattactccaaaatgggtgctttgaaggcagacatcttcccagtactgactaagcagctatgctaacaggtaatggtccctcagatattagttgtgtgaacttaactgatcatagataccttaaccagactgaaaactatacctttcctatttcataagtgagaaaatctgaaaggtttaagcctctgccaaaagaaagctatggtagaaactagattagaagcctctcatctactgactcttcacatgctctgttcaaagctttggagaaaattgagtggaagtggttttaacaaattttaatttgcttagcaatgtttgctttttaaaacttaacgcctgagacttggttcttatgaattgtcagttgtgcctgtgttgaatggtcgcattttaaattcccagttgctaacctcttatgttacctggtgccacttctgcatttccctgtacctatcctctacaacctgcttagaaatctattttgtaccttcccttctctgtttaatcctcagtaacctcctccttcatgcccagtctcagctgatcactttgtatcttattttcctaaaaatatagaagcagcagaagagaatctccacatgtccctgtgtgccatataatctgccatctacatcctgttatgtgactgctatgtccctgctgtcatgcgaggtgcccccccccccccgcgccatgcgtacaatatactcgtgtcttcttgcttcttcaaggatgttactctagccacttttctttctctcatgagttttttcttttctactgggccaaatctgtaagcatacaaatatattgccattttcccatcttaaaaacctttcaactaaacgctccctctgagtattacaaccctggaatctggaccacagggaagaagttgactttgtaaaatcaccttgaccagtccctttttcagctagaaatggtgacgaattttctttgttagttttccaatatcaaggaaataggtctaggagctgtttgcattatgtcgattaaagtaatttaagtgcttaaagaaatttaagtaatgggacagaagctatcccatttaaagccacatatcttgagagtttgtcgtatcttgacatatataatgttgcctttcccactaacatgtaagctccatccaggtgttgatttaggttgtcatgttcactgttgtgtgtccattactttgaacagacctgggcctggccaggatggcacacattgtttgttggatgaatgttctctgtctctagttcttttcctgctctatttggactcaattcatagtcttttccttcctcgactgatcagcattatttgacatggctgatcattattttttccttgaaataatttcttctcattcagcttgtagaacaccactctctccaagttttctacctagctcattggccactgtttgatattctaattgttacttatatatatagtctgtacaagttagagtgccctaggacctagtctttgatctaaatcttgcactcactcccttagtagcctcttagtctcctagcattaaacactctctatttggtgatgactgatatttctatctctggcctgggcctctgaggtttattgcaggctcacatattcaggagcctacttggcatctccacttaggtcatataataagcaacgtataaaacgaaacacccatccttttccctactcccagactgctcttcccaagtcttccttgtctcagtaaatggagtagccatcctttctgttatttagcctccaaacctttgtcttcctcgattcttatttttctctcaccccacatctaatcttatgagaaaatattattaactctactttttaaatgtctagaactattttgctcttcatggtttacaattacttccctggttcaaatccctattgtgtctcacttagaattttcaagttttgtaattgattggcttacttactctccacctgtgcacagccagaatcatccttttaagaaatgaaaagattatgccactcctttgcccaaaattccagtggctcctgtctctgaataaaagccaattcttagatcagccttggcaagtgaacaaaaacaaaataatagtaatgaaaactaatccttaattggcctatggtaagtgcttcatgattggcctcttttttctttctgtcctcatggcctatatgactgtctcactctgctctgtttgctcctactgtgtcttttctagtttgtttcagtcttcttccacagactagaatataaactccatcaaggtagttctttttaaacattttgttcactgctaaattctgggcacgagaaaagcttctagcacatagtagatactcagtaaatatttgtttattaaatatatgtcccagcctatggacacagtatctatgtagcaagagtcaaacctggcagtaacttggagctgtggttgtagcaagagtcaaacttcgcagtaacttggttatctggttacagtaacttatgattgtgactctttgttgtctttgtgatttccccccaattactaccataagtgttcgttttcttacagacataagtcacctatttaacttgataaataaaagggagagttatggaaccacctactaacttagaagtagccttcaacagtacacaccaagatacattataaacaaaatgttaatgtggtagacagagctggcatttgcgtaaatatagctcaggttcatagagctgcccacctgccctgattcagctgacattcatgccatctggcatggctcaccttaatatgcaacagtgtttgatgcattatgcttgttcactgtggcggcaccacagttgttcccattgttcatgttataagaatagagaaaaaggagaagtgactaagaaatttccccaagagtaaatgcattatgtcatacgtaaaggttctgtggcttgtaagagaatttagcagcatcagtttccaaaatcgtgtttcttaataagtggatataaaatggaaacattataggggccttctggctaaaaagttatttatttaaggaggggaattgtaggaactcagtcactgcatcaagagttatgctgactacttataaaatctcatgatgctataaatatgaaagccaatttacagttttccctttatatgtggtacccatttcattttggaagagagctataggttttcttttttctacaatcttgagtttcctttgatacatatgtgaggtagattaaaattttaggtagctctttctccaaatatcaaatgtagacaaagataaggggggaaaaattacacttttgaagaccttttttttttggaattaaattgccgacatagatttttcagtttagaatgtatcttaccttcccaggctgttggtttgagtcatgcaggttcacattgcctctgtggtctttgacgtggcctctaacaaaagatttaaacgttttttaggggatcacaagaatcaggtgttattctggatcagaaaatgccttccctccagctggaaagaaagcactccctgactgtggggtccaagagccccccaagcaagggtttgacatctacatggatgaactagagcagggggacagagacagctgctcggtcagagaggggatggcatttgaggatgtgtatgaagtagacaccggcacactcaagtcagacctgcacttcctgctggatttcaacacaggtaactgacttgcctatggttgatggctgatggtaccctgtatttataactgcctgcagcattcaatagctagtaactagcaagagaaaaacagcaagtaataactgtattcacaactgcctgtagagggttagtggattgaacaaatgtttaaattaaatgagttatctgacagtgttgaactcttgcagtttcccctatgctggtagattcatctctcctctcccagtctgaagatatatccagtcttggcacagatgtgataaatgtgactgaatatgctgaagaaatttatcagtaccttagggaagctgaagtaagttttcccaccttctacttcaatcttcaggacccgagctcttattactaagataaattataaactcttggtccataaccactagtgaatggcactcttatgccagctaaacataagaatatctatgaaaaataatagttgtgatggcaagtcgcaattgcttggactatttctacatgattcaaagggtttatatgttaaatatttcactcttaggaataattcatattgccattctcccctgcccccccaaccccaggttaatttgctaaccaattactttacagaaccagaaatttacactttcttccttgttatgataaagatttatttggctctgatcagaatctttccaacctttgcttgtgagatttttaaatagcaactatattgtggaatgatctttctgaaattgcaactactaaatatcaaaaccttttcccaatcagataaggcacagacccaaagcacactacatgaagaagcagccagacatcacggaaggcatgcgcacgattctggtggactggctggtggaggttggggaagaatataaacttcgagcagagaccctgtatctggctgtcaacttcctggacaggttcctttcatgtatgtctgttctgagagggaaactgcagctcgtaggaacagcagctatgcttttggcttcgtaagtgttctttcagcttgcataatatgaaactatcacttgtcaaaacatggaatttttgtcctctatttcttattgaagaaatgcaatgcttgataattaaaactagtcatgtgtcctttgataaaagatcatcctcttcacaggattgactgagaaactgaaacttaccacatgtttactcttcaatcacctggttatgatttatagcaacaagttcagtgtcatgactaaggcagccatcatctcaaattcaggatctaatttaactattttgcagtgtagtctttttgctatttcctatctattaagtcctatttaaagacagtgtggttacaaaaagctatcttcatgatctagcaaatgacccataataacaggtttatttggttacagtgaataaactacttcaactggttcctgttactatcattcattcatgaaagtacctaattgtgtgggaaaagagagctgggttgtggctgagctacctttaagtgacctgttgctgagtggtagtttcttttctgttcttctggtctcaaacattctattgttaatgcagaaaaacttgccaaaattcccctaaagaaagtagaaacaaaggcagaaggaaagaattgatcatagtgaaattatatcattatgtctcttggctataagcatcatttgctaattcagtggacaaagttgaacagcatctttttaaaaactagaggcctgtggagtttgtttctatcactgtgttgatcttaacacttttttctatgaagtgatttgaggtctgtagaatgtgtaggaatttacctgtagtgtctgtcattcagaatctttcagtgtatcacaggcccaaacctaaaattcttggttggaaattgtttctgttactactcctagcagtaaatataacctatccttgtgataatcatgttcttggtccagaaacaagctcctagtactttcatagccctgagtcatttagtggtatttaagtggatatgtggctgcaaagtaagtctgcaagggccatgcggagaggcgtggcttatggtagcacaggagtagagccaaaggttctaagttttacttctgaaaactcttcctttcccaggaaatatgaagagatatatcctcctgaagtagacgagtttgtctatatcaccgatgatacatacacaaaacgacaactgttaaaaatggaacacttgcttctgaaagttctagcttttgatctgacagtaccaaccaccaaccagtttctccttcagtacttgaggcgacaaggagtgtgcgtcaggactgagaacctggctaaggtgtgtatgccgcgtgatttctaggaacttccagtgccaaggagcgtaaaaatcaacctttcccaatcatccttcagttcttttttccttttcagttttcttcccacaggcccagaaaaactgttccagtgctgaaaaagagctaattttaagaacccagcttttggttataaggcattactattgactatatttggcaggcacgggttgtctaatcacccaactatttaaaaatttaagcttggaaactgttctcttattggatacagaccacatacaagcaaaacctcctaggtttatagagtgggaacaaagtaaatctagtttaataaggttttagtctcatcctaatatattaagtaatgagcattatttggttgtttggagttacagaactttagttgaaggcattgaagtattgctttggtcaactgggtttccagtgaccataatctaggatatctggtatttatgtgctgtgcaaagggtaataaggatgtccacatgttttactatgtttcttctaatatgagatattcccactggtgctgtcctagtctctgaactgcctgatagattaatagctttaatatttttgtcttttggctaaaatctctgttccaattccagctgccagagcagtaccactttatctcagcataaacctaaactattagcataagaaaagtaacctatcacctatactttgagtaggccaaatacttttgtattgacattttaccaaaacataaatgttactgttgttatagacaggcataccaattactaacccagtaagtaattttgagcatctatttttgtagatgccgactgaacaaagataagataccatttatttccttgccatttccaggcttacttgtgaccttagtcacatttctaattccaatgtgttttcttctcttgtgcttagtacgtagcagagctgagtctacttgaagcagatccattcttgaaatatcttccttcactgatagctgcagcagctttttgcctggcaaactatactgtgaacaagcacttttgggtaagattctaacttctttctagatgaaattcaaggtctatctagaatgggcttgcctcttatgagggcaagttagtttaataaggatctggtcaacttgacagcagaccacaacatgccactgagtcttccaggtcagtcatgatggctttgactcaatggcttcactctatgaggactgagattgcaggaagtcaaggagacagcatcacatgctccttcaacagaagcaggcctgggaacctcagtgcccactgttattcagggagggcccttgaggtacaatcattgactgcttcaagcaaaagttgttgacttttaccttctatattaaaaacaaaaacctaggtccaattaggatggccagaagattgcacctcaggctttcaagacaacagggcagtaaagtgttgcctcttgcccaagaaggtggcaacatcagaaatggacccctaggtttggttctgaaggctcactgttgtactaaaagaagtggggtgtctacccttattttcatgaatgcttatgtttttttctgctgcattttctttttttaaaaattttcttttacttttttttaagtaattcttattccagcactgcagtgttttgactaaaaatttttcatgttgtgtacaaatagaatggtcaggcaagcagggctctataaggaccagtaaaaatttcactcatgagggaacaaggaaaaagtgatccagccccaaattgagcattataaatttataatatgagaaaatttagagccttggctgttctttctgatattttacatctaaaatctctgaagggggttctggtctctttcgagatgaatgtgaatatttactaagggactaattccctttatttcaaattggttatcttcggatatctaatataaagttatgtgaagcaatttttttcttttgtcttgattagccagaaacccttgctgcatttacagggtattcattaagtgaaattgtgccttgcctgagtgagcttcataaagcgtaccttgatataccccatcgacctcagcaagcaattagggagaagtacaaggcttcaaagtaagtcactgacattttcatatcttagctctctatttaaagcttaatgggttatagtaatggttactagattaaaaatagattaaattgtgtatctggtgccaggttggaaaagtaagggtacgtgtacaaatttacaaataaatttgaaaagacctagatttataatttgtcagcttttaatacttgtagtcagccagcttccttccttccattctgttaaaactactggaaagttttctgtgacctgagattttatcaaaccaaagtccttggcttgtgctgaccttgctttgggtcttgtttcaggtacctgtgtgtgtccctcatggagccacctgcagttcttcttctacaataagtttctgaatggaagcacttccagaacttcacctccatatcagaagtgccaataatcgtcataggcttctgcacgttggatcaactaatgttgtttacaatatagatgacattttaaaaatgtaaatgaatttagtttcccttagactttagtagtttgtaatatagtccaacattttttaaacaataaactgcttgtcttatgaccatgtgttagatttatttactaattatcatggctgacatattcgtctggaatgtttgttgagagtattaaaagtgttatgtctatttcaaatattcttcaaaactggttttgtaaacgtggcatgctattaggattaagtattccaaggcatccagggatattcatgtttggtaaatggccgctttgaggcttttttccttcctgtctctttattccccaggtagctcgccatagattagtaaaggaaggaagggacagcgtagacagatgggtgaagagatttgaatatgcgctgcctgctctagcttcactctaccatcctagtcagtaagacaggggttgaggcccaaatgtagtcacatagctcttagaggtcactgacatttaattctaatccaaggatagcatgctcatttgtacagggctgctattatgtctatgatcaggtttgatttaggcacccattaagcatatatttctgtcttagaagatgcttgctttgggaggtagaaaagcaaatttcaccttcggaaggaacatcagaataatgaacccaacccaccaactgtgtctcctgggagacctctaccctaagctttggtatggcttgaattattcatgatctttcatgatctacagtttacttcactaatctatatatgttttctcttctcttctcttctctcctctcctctcctctcctcttttctgatgaagtttcagtcttgtcaccgtggctggagtgcagtggcatgatcttggctccctgcaacctccgcctcccgggattcaagcgattctcctgcctcagcttcccgagtagctgagattacaggtgtccaccaccacactcagctatttttttgtatttttagtagagacagtttcgccatgttgttcaggctggtcttgaactcctgagctcaactgttccacctgcctcagcctcccaaagtgctgggattacaggtgtgagctaccacgcccggcacacctggctaattttttgtattttttttttttttgtagaggtgggtttttttgccatattgtccaggcaggtcttgaactcctgggctcaaacccttgggctcaagtgatccacccacccaccttgacctctcaaagtgctggaattacaggcgtgagccaatgtgtctgcccagcacttacgtaggctacaagatgggtaaaatggaaaacaaaacaattgtttagaatttcttctaaagattggaaggaaaaatgagtagatttggccttgagggtgggtggtgctttttggggattaaatgtgaatttgcactgtgctcttgttatcaccaaaattagttgccctggaccagtagttcttgagctctctgggctatgtgtgcctctgcagaggggcctctggagaggggactccatggggcggtcccgaagacatgatttgctttttctatctccaaaacctctcaaggagataagaaatccatgtcttctagattcctttacatagaagaggttacactcaggcacgttttggtgaaatggatatagatgaaattcactgcagattttgtttctttcaagctctaatgaaattataaacataaaaatacagccacattttatgaagtctttaaaaaatttttaagtacccacaagttcttaaaagattttaacattccctccaccctgcttttttttcccagcagataaacattctcaaggtgtcttcatttctgggtccagtgaagaaattatttccctaaatgttttgacatttattgcacacagttcacaaaggggatacaggacctgtattaatactgaattctgtttttatgttatatgattaataactcgttatttcatattctaatatatgactatgtatgtttctgttcactgcatgaacaagctgaactttccaactatccttttgtacttcaaaaggatgacagacaaattgcttcctcccaagtggggagtgggagagggcagttctgttttttgttgttgttgt

SEQ ID NO: 15835 - DNA, 171701 bp, Human
ctatatctggcttctctgaaagtgtagattggagttcattagactatttactttgtgcaattaaaagtttatgaactgaatgagaactctgacttctatttctaacgcactttttaatgaaaaattgttggggaatttgaatttagattatgcaagaattttaaatcagcatcttcggaaatacaacaacatctttggatttatttagccttttaaacaaagtgggcaagtttatcgagagattcatatactttgtttttccctatctttcatataagaaatactagattttttttcaataaaataatttgaggcctggcgcggtggctcagcctgtaatcccagcgctgtggcaggccaaggcagggcggattgcttgtgctcaggaactggagacgagcctggccaacatggcaaaacccggtctctacaaaaaatacaaaaattagccgggtgtggtggcgcacgcctgtagatccaactatttgggagaatgaggcacgagaatcgcttgtactcgggaggtggagattgcagtgagcagagattgagccaccgcactccggcctgggtgacagagcgagaccctgtctaaaacaaaacacacattaaaaaaaaaaaaaccacaaacaaaacctgcaattggccctcgaagggctggttccctcagtcagctctgcacgggtgcgccccctttctccctagaggtcaacaagcgactgcgaaggaaaacgccgccacaagtttcttgctgtttctggagagacctctcagagcgcatgctcttcggatagtcggtctgtagcgccattttcgtatggaagggactgcactctgattaggtacagccttaggacgcccagcgttcaagttgttcaaacagtacgtagagcctcgcagagacaagtcaatggcctcttttagcgggactcctgcctggagcgcttcagctgagactatgtaaagaaattcctttgtgttaaccttcctccttggaccagtggactctcctctctctcctgttccctccgcgcccgcccaggctggctcagcggtctcgccccgcccctccgggaccggagcactgtaaagattaggcatctgtgatgcttttgcgctcacattggcggcccagatgagagggcgtggagaaccagatgggaaactttttgtcccgtgagaacaaagtacaagttatatcagagtctggtatgtgtagaggaaaccaatacatgtactgtgagctaggagctggtgcttctttttcaattgtattttttataaagatgcagaccccctcagtgttgggcgtggggggtggctgaaatgttagctagaggcgaggcagggcacggagatctgaggtttttacgagtgtgtgtgtgtgtgtgtgtgtgtgtgtgtgcgcgcgcgcgcgccctacaagagtttagaagagcatgggtgagtgggcgagaaagaaagagaatgagagagagagagaaaagaaatctggagtgggacaagacttagagggtgcagaaaagaaagggggcgccagcacatcctagcctccgaggccgcgacagcgcctttggcgatgtccactctcaaccccgccgtttcattcataagtttctggcctacaggccccgcccgctcccctgggccgagggccccgtttcctgaacagcaattggtggacggcaacaaagccttagcaaccggctcctagtgacccgcggggcgcctggtaactggggctgctgcggagaaaggagcggggctgtccctttaagggatggccgcggagtcgtgaaagtggagggggctgagggagggcggggaggaaggtctgggggcggacccagggggaggaggaggaggaagagtaactgctgaaaggaggtggcgaaggaggatccggagcagctgctgccagcccgcgggcactgaagtcctcccggctgccgctcgagtagccacgggcgcgatcgggaccagaagtctcctcctccatgatcactttggaagccgggggaagactttgccctgccctgagagctggtctgcgtttcccaggcgcggcggcggcggagcagcagctgcagcagccgagtccaaataggagcggccacagccaggggcgtgagcgccccgcgcggagcgagctcgggttcccctcggaatgtccccggggcgcccggcgcgctgaccccgaagccgcctccgccttcggcgcctgctgcctccctcggccaggcttgttgttcgggactgtgagcttcctggctcctgggcagtggggaagcccccgggggcgagtgacctcagctggccacgacccagccctcccccgtgcgtatctcgcttaagatggcagcggagtcaggggaactaatcggggcttgtgagttcatgaaaggtgaggagcagccgccccgcatcttccaacgctttcttgcccccaactcttcacttcccgcgccactgtccccaccttctcctgaggctgccagtgtcctgcagccgctgcgcgcgctctcgtcccctctagggactctcctttctccgaggaccccctgcttccggcttctctttcttgtgtcccttgctccctctgcagctccctcggatggcctctcggcctcgtaatgggacagcaccggcttctgcccgtactccggcactcagcagctcatggggagcctgctccggatgctcaccggtcacctttactccaccatcgcaggcttcggttttcgggacacccccaaccacaccccccaagtctctctcccttcctctttttcaaatctccgaagctgcgtcgggaggctcacctctttcttccccttctcgcagctgctgaggtctggagatttgggaaccaaacttgcacctccagttctgcgggtacccccagctcctgcctactctgctggcctgaaacaagggaaatgtgggtgctctgagccccgctgagttcctcggtcaggtcctcctcttgcctaactgttgtgctcttgagtctctagctttctgggagggatgaggtttctgcaagaattccacgtgttaatggggtctttaaattgtgatccttcgtatgttaccacccaccttcacttccacttctctacttctcatatgttttttctgtcttttaaacttgtctttcagatcggttatattttgctactttaaggaatagaccaaaaagcacagtaaatacccactatttctccatcgatgaggagctggtctatgaaaagtaagtttatgttttgtttttttttctcttggccattcagcttgttctttgacgaggaaacactatgcacttttatggcagttttattcatttcccccccaatgatacgagtaacaatatcaattttttaagactcaggtgcctggggagaagttcagagaaaattgacagaatttgaacctttcaacacttcagttcttttagacatctatctgttttagttcttcctaccaccacaacaaacagcaactggagattcctaacattccccagagtaggaccagggagacacactgtcattgccagactcagtaattggcctgtgaatcagtcactaagtatttatggagtggccatagggtacagggcagtgcatgtattacaggtgcttgagctttatagtttacaagacttctgttctatctcaggatgtttttgtttgtgcagctctttttcagaaagtgggacacattaactgcggggagctgtatcagagtcacatttatgactaacattttatctgacatattattgattcttttatttgggtaccccaaactttttgatattattttctttgcttctaaggaaatgatatagcagtgctgatttattttctttgattactttgcttctgtgggattaggatttgagagtgtaaaataaaagtagggaactgttttctgtgaaagaccactgatctacaggaaaaagatatcttaatacttcaggcatagtaaaacattaattgaagagagataaatctttattcagtaaaagtatcagataataagaaataagaaggctgaattgacttggttatgtacttttatgaaaagagctggtgtttcagaggagtctaatatattctattttaaacgtttaaattacttgttatctttaccaaatgtgcagataaatgaacatagttaaattaatcataattagcttccttggacttgtcttgttagaaaggttattggcagttctgcctaaggatttgtgggtactaccaggtcttcgaagagtaagtgttctggaccttcaagagcatatcttttatttgggggaaaacaatctttgtcacttcatcatagaggttcttgaaactgaggtctgcgacatttctcttagtggtgctgggaggagaatgcttcttgaatggctaaagtaagagtgggaatgaaagagccctttgctgctgctcatgaatgcccagagttgctgaggcaaagaggtctgagtccctggtgtcagattacagctctgcttctagacaggatggagttatgtgcggctgtgtacctggatgatgtcactgccagcagtgtttattgagtgttcactctgttgttgggaatgtgcattgttgtgcctctgtttttgtgattttaggttttgggggtctctcatgagtctgagagtggggatggtgtatatatcattatgttcaattctacagtacagtggttgttaatatgtcattgaatgagctctagccatggagatctgagtcacttctcttgggattgctaggtggtagatctagcagaaaattaagccaaactaaacactgtgcatgatggctttttgattttaatattgatagatgagggaaatttttaatgtgattttcatgttggtattttgggataggcctacaaatcatattcctcttatagtctactgtttttctggtatcttataaggaaagacttgctggagaaaccatccaatttatattgtgagttgggattgacatttgaaatacgatgaggacttcagcctgggcagagtgtgtacttttcttagtttgaacttaccctactgtgccacagtaatggctgtggctctgacacctccaactccatcttttttgttaccccaacatattacatggtgctaggtgatgcagagaataaaacaatgttgaatgcatatgttaccttcaaagagctccaagcctgtagggaaaataacagaactgcagtttgaggtataggaaagatacctgcccaaagagaaatacaacctctatgctaggagaggcattcacaggcaggtaggggcacatctggtggaagggttcagcaaaggcttcgtggaagagttaagattggcttgaaggatggacaaggtcttatcaggcagagacatgagaggagggatcttggaaaacagcaagtgtgaggaggggagaggcttgggacgtgtgttcagggaacagtaagtcctccagtttgcctggtgtgtattcagggaacatgtaggggatggagaatgtgaaattgagatgttggctggggacagaatgaatgtcagggtgagaaacctgcagtttctttggtacaccatgggactcttgagggatttggggcagccatggtatgacttgatttgtgctaattacaaacaatgggaaacatttattgagcatttaaatgtgtgccagatgctgttctaggtgctctataactattaattcattgtgttttcacaacaattctgtgagacaggcactattatccttattgtacaaaaaggcatagagaagctgggtcacttgcccaaggtcacagaagtaaaagtagcagagctggagtttgaaaccaagtcatctagttgcagaggacatatatccttctcaaaaaattaatacagtagcatcatttaagaggggttgttaaggagataagagcccacttaaaaaaattcaggggggaccaggcatagtggctcacgcctgtaatcacagcactttgggaggccgaggcaggtggatcacgaggccaggagttcaagaccagcctggccaacatgttgaaaccccgtctctactaaaaatacaaaaattagctgggcatggtggcgtgttcctataatcccagctacttgggaggctgaggcaggagaattgcttgaaccaggacctggtaggtggaggttgcagtgagctgagattgcgccactgcactctagcctgggctacagagcaagactctgtctaaaaaaaaaaaaaaaaaaaaaaaaattcaggggaaagaaacaagtacctggattaggatggtgacaatggtgatggaaagaagcgatctgaagccatgtgacctggcaacacaggagggtggcgtggaggggtgctgaggaaaaagagggatcaaagaagtccttaagacagcttaggttgtggtgagcctactggagctcttaactgaaataaggaaggagggtggaataattggctttggtgggaagatcaggcattccattttggccagattgaatttaagaaatttaagggatatttacatcactgttagatatcacatacatttgaggttcttaaatttgggaattttcccaaagagactaataaagctgtgagaatgatgcgatttctgggaagatagagaaggtctcaaggtctgtatttcacaagtagaaccaggatgggaggagcaagggaaggtggaagtacgcaacaaagaggtggacaaacactgaaggggaaaggagaaagggagaaggactgactccatctcgtcagctccactttggggaagtatagaatgagagagactgcaaagcccctagaaggatgtctagtaacccgggctctgtctggaggacgtcctacagcgagaaagattttgactatcacatcataatgtgcatgtctctgaggagaagaatatatttatattcattatcacacaggcctttgtactgtgtaattatttgctgaatgtttaaattaaatgctgcttttccagctgggtgtgcttgtagtcccagctactcttgaggctgaggcgacaggattgcttgaggcctgcagttgaactgaaaagccagcctgccagcctgagcaacatagtgagaccccatctcttaaaaaaaaaaaaaaaagaaagaaatgctgcttttctggctaaattatcaccttagaagcgattgtttttgaatcaggaagtagactctttaaatattaggctgtggatattctggccacagctgtgttttgcgcagatgtttctttagttatgaaaggaggacagcattccatgattgaaatgtcaaccttctgagatgctggtggagaaaatttaatgaggtggcctcatgaggtaaggctattaaaagtgaacgtttgaattatctgcttgattttttaaaacagaacttattactataaaggcctgggcagctttaataaaatgaggatgataagaaatcatcctttgtccttgggttatgatttcacaggtcagagttaaaatcaaagtataggctaacacactagtggtacaaaaatagctccacaaaaagggagcctttcaaagaagatttatctgcatttgattaagctacaaataacacaccactccctggaaaggcttgttctttggtattggaattgggccccgtaatccaaacaggcgcttacttttaataacttggcttacttttgtgtggctaaaaagttagtgaaatgaaatatattacttgttatgacatctgtgtgcccctcctagtggtggtcatgggtgtagggttggatgttcatggcatagaaagccagtttgctgggaaggatagtgtatagggtcttcattttcagcctgtccattgtcatttcttctctttttgagttgtgaagaaaggtattgaaagtgcaggaaagagctctttagggagaaactctagggactgaattttaagcagtttctgaagtgacttgaagaatttcaccaaatgttttagcatgttaagaatgagcagcctctaatgagaactaattagctaaatggaagatttaaataatttaaaacattcaattttcatttaaacttaattaaagcagcctgatattaatgcatccaggaagttttggataagtaatttatagaaaaatgatttcttttatcttgtctatagcatagttttgagtcaaaatgtgaacatagaatatttatgagagaagcatggaaaaactactcttgcctagaaatatttgtgggaatgcatatttaggttagaggtaggtcaggagaaacccttttggtttttaaatttttatttcaaattaaatgtatagcaagtaggataatttaatggaaggttgaatgccacttaagcatatacacacatacacatatatatgatctgatagagccttacggtcatcatttagaacctcaattctcattataaattgctatgatatagacagaagaggagatttggttgaacctcgagacaaatttcattgtgggaataataataaagccatagcaacaacaacagcagcagcagcagcagctaacatgtatagccctgtgccaggcagtgttctaagtggtttacacgcacacattaactcaattaatcctcagaacaagcctaggagttagatgctgttattatcactacttaacaaaggaggaagtagaggtccagagagggaagtatattgcctaaggtcactgagctggtaaggcagagcagggatgcaagccagaggcagtccaccctggagtccaggcatttcccagttggcctgagactgatgccaatggggagggtatgggacaactttgccccttcctgacagacttgatccctctaacttgggtggtgatggctcttgggggaaatgtgccactgacagtatatgcacaaactatgaccagctcctatctgggaatgtgtggtggtaatttaaacatttttctttgtaatttcacttttggggggtataattttgccttttttttcctatcagtgcactaccaaaaagaaagagaggaaagaaattgagttaattgtaggacacgtgaaaacgaaagaagcccagtttttataagcctatgataactgcttttgtaggctgtctggtgaaatgttctggctgcttacctggtgtaacttaaggtgatttttttttttaaggtattctccaaaaaaaaccctcagaaaactgtttactttctaaaagatggtagtttatagtttcttcccccctttttcttctcttcatccaaaccttggaaaagtaatattgttcagggctgctttttttcaccttcttctttttttttttttttttgagttggagtttccttctgttgccaggctggagtgcagtggtgcgatctcagctcactgtaacctccgcctcctgggttcaaccgattctcgtgcctcagcctcctgagtagctgggattacaggcgcgcaccaccacacccagctatttttttttttttttttgtatttttagtagagacgaggtttcaccatgttggccgggtggtcttgatctcctgacctcgtgatctgcctgcctcggcctcccaaagtgctaggattacaggcatgagccactgtgcctagcctttttcaccttctgttttgaacacatgacagccagtgttatgatgtagtatatgttaagaggaagtagatatatctgtgtacattcatagttagttctttttttttttttgaaacagggtcttgctctgtcacccagactggagtgcagtggggcaatctcggctcactgcaacctccacctccggggttcaagcaattctcccacctcagcctcccgaatagctgggattatgggtgcatgccaccatgccttgctaatttttgtatttttttgtagagacagggtttcaccatgttgaccaggctggtctcgaactcctggccttaagtgatctgcctgcctcggcctcccaaagtgctgggattacaggtgtgagccaccgtgcctggcccacagttcttaattctgtaatccaggggaatcaaatttaccttctagataatgatttatttaaatatctgctgttttgacctcttaggcattcggtgtagagttgatctctaatcttcataatgataaattattactctgttttttcagtttgcttgagataaggctgtgaaaacaaaaaatgtagccgaggtgctaaggagagttatcttaacagggctagtcataatcatgcagcctgagagagagctccaagtgggctgcaggagatcccagtggggagctgtcagccttccaagttctttctgtgccaggtcaccacagggcggcttcattattttgtttgaagtagattcctaagacatcagatgttctcatttgtaagttcataaacacattcccaagccagaagtaaatgacttttacttagccacagctcaatacccctttgtgcttaaaaaaaaaaaaacaacaaaaaacaaaaaacaaaaaaactaaaaactaaaacacaagcctcacaaaactcttgacacatttttatgggaagtgaaaagcataacttaaaactttcataagtggttgaaaattgctatacaagaaacttagtatttagatgggatagattttgatgcagaacactgtactaatgctttggagatatgtatttgtaaagaaggaagtagaaacacatgcagtacaggataatacatgaccaaagctgcaaatgtatgtgttaggagttcaagaaaggaagagattattgctacccagggtgataagcactgagctagtttttgaagggtgtataatagcaaagagtacattttatgatctctgtgaggaccagtactacctgtttttgctcaccattatgtcccaacacctagcactgtgcctggcatagatatggggctcaagaaattttagttgaatgaatgaatgagtgagtaagtgaatgaggaagaaaggaaagaaaaagatttcaggcagagtcctgagaaaaggcacaagaggtgtttgggaatagcaagattctgttagaggaggtgtaataatatttgaatggagaggagtcacaggtcacagcagcagtcacttagttggggactggattgtggaaaactgtttggatgtcagtaaattgtgcttgcttgtaaatggcagagagtgaccagggctctactttaggacgagtgctgccatcgctcgaaggtggggtcagttaggctatggaagaattggattagggttgcagcagtggggaaagaaaggccagatggggagaggctggaaagaattggttgactggatttgggactgagcagatgcgggtagggaggaggaagcaaaggtgaattcaaagtttctggcttgggtgactgggagagagggacacctttaagtaggtgaggtacgtaaatcagaaggaaactgcctttttgctattctgttttgttttgaggattggagataggaagtaaaaagggggtcattataatggagtctttgtcttttgtgatctttaagcggaaaatagaccgtgtctgtcctggatatttaaaatgtggggaggtaagtggcacaactgatctcaagttcctttctggctttgtgatttgagctgaattttttatactgaattgtgaaattcattgtgtcttagaaatattttttttaatttttcaaagaatattgcttttctacaatgaagaaattcaaacctacagtgctataaatttttaattggcataattttgtatatgcagttttaaatgctgatttttttaatcatacatgagcattgtaaaccaatgccatttttcaaaatcaccataaatgtctctatattaataatatttcggggaaaggatataccatactgtattgaacatttttctctctttggtcattttggttgtttcctatgtcttgtcattttaagttgttccaattcacattactgaagcaaagtagagctgtgaataattctttttaaagctttagtttcaatttacttaaaaaatatattggtttgttttaatcaacgaaatacttccaggagcaccaaagaattttatgtggattgagagtcatcaaaaatattgctctatttattaaaaatatgtaacatccccagttcttgacaacttgaaaatgaagcagcattgttgcctggggtaaatacccggggttcttcatctcatcgaagattaacaataggtacacgtgagtgggttaaggagcagagactttaataggcagaagaaaggacagaggagagagtagctctccctctcttgtgagacagaggagtccaaagggaaaagcgggcctgcagctgaccgcaacaggttttatagtctggcttgaggaagcggtgtctgatttacatagggcccgcagattggttcaaccaggtgtgacgtttacgtagtgggtggggaaggctgatcaccccaccctaatcttattatgcaaatggactttccactcggccagtgccgtcttgtctgctcctcactgtacatgtggctggcaaaaagagaagatggagctgccattttgaacatgcctagtcccaggtagtagtattcctactggcacaactgccgacattcacctgtgcaagtttccagcttgcttgtttacgtgtgcagctctcttttacaggctgctgtttgttaaaagagaaaatgattttagggctgcttttcattaaaaggaaacccttaccgagggctcccgaaccctcagtacctgcctaagtaatttctttttaactcgtatatcaaaaacatctggtaaatgatcacaattatttgttgttgacagtgaattcctttataagaaataatttgtgtaaactataaatttgaataagatatttcctttattgttaatttaattttttggtcttaaatattttcacatcctagtgacaaattgaagaatttgccagtttagacttctctttttttttttttataaaatttaattttcttttgagaactggaaaaggtagtttatttcaaatttggtccccatgattgatgtactttagtaatgcatttattcagttttgtgtatctggatatgtggcatttcagtgagacagcttctacagagaattggaaaattacattctgaaatatcaaagttttataatttgaataatttacggaaacctttctaaaatgaatatacatttctgccttcttaaagaatttactggccaggcatagtggctcacgcttctaattccacgctttgggaggccaaggtgggcagattgctcgagcaacatgctgaaaccctgtctctacaaaaaatacaaaaattagccaggcatgttccacatggctgtagtcctagctactctggaggctgaggtgggaggatcacttgagcttaggaggtcgaggcttcagtgaaccatgagcatgccacagcactcagcctaggtggcagatcaagaccctgtcacaaaaaaaaaatttattgatcacaatttactttttttctgtcatacacagacttcatcattatggatgatcatcttttttttttttaattttttatttttgagatggagtctcgctctgttgccaggctggagtgcagtggcccgatgtcggctcactgcaacctctgcctcccaggttcaagcgattctcttgcctcagactcccaagtagctgggactacaggtgcatgccaccacacccagctaatttttgtatttttttttttaatagagacagggtttcaccatgttggccaggatggtctcaatctcttgacctcgtgatccgcccgcctcggcctcccaaagtgctgggattacaggcggagccgttgcccccggccctgtgatcctcaccacaaattttagagtaattattttccttttgagagcctcagccactttatgaaatctgagggttagccttttatgtatgggggaatcgctcatcattctgttttctaacaaagctttgcatatactgtctgtatagctctcctgccttcagtactagccattgaataatggagttaatttacactgcttgagaatatttctgtgggagtgaattttaattttcccagtgcattcctgaagaagtctccttttgttttcgttaatctgagtctctaagggagtttttattaactgaccttctctaacgagggatgttagaattacagaccctgatactggaaggtttcttgataccatctggtctgttgtttggctttaaggcaaagtgaaagcactcacttattttacagaaacagcagctgacacctgacctgaccagtatttacctcgggttaagaaggtaataagtggagaatggttcctcaccctctggtgttgtaaacctgaactttcttagaaatctagacaatgcatcaagggacaggattgatagttgatattggggttctctccttcctttatgatctcaacaaatgtcagactttttgcagacaagtaagtaataaagatgataagtttcctaatacatgtagctgctttgtagtctgtgggtttgctttctggctgtgcagaaaacagtgaatttcatggaaaaagttgtgttcttttccttcctcaaagaggagacactctgagggaaatgttttctgtacccagacccaatgcactgagaggacagacagaacagagaacatcaaatagggcaagtagaccttgagaaacatttgaacagttgaatgggtttgtccaataaggataactagagtcatagactctgtagagtctatatagcggctagaactgtgatatatgatattacataagagctggaaagaactttaggagccatctaattcagtggcttcatttgatagatgaggacgtggagtcccagagaggctacgacaccagattagggacactgagtgaccaaattgggactggaaccttttggcacccagtgatctttagttctgcatcagactgctgtgtgtgtgggaagcttgttagatgtgcagcaactcttccccaagaagttggcatcagtgtgactgtgggtggttatgctaaagggcttgagcaaaaactcagactagtgccctcatctgaggttggtatttgttatgcagttaggacctttttaaaatgtgatcattatgagttcagccataataatcacgtctcatacagaaactttatcatctgactggaggggtgcggatagtattctagtgatagggaaactgttaggtaatgtgtggcccagaggcattgctgatcaatttcaacaaaattttacacacacacacacacacacacacacacacacacacggtctcattgtgttttggaggatactgctattttagcatttatcacattgtaataatgtctttacctgtcttctcagtagatagtgagctccttgtgggtagggactggtgaccaataggcttttagtaactatttgagtgagcaagtgaatgaagagacaaaaaacgtcagcagtgctggtaaaacattgaaaggttggcatgccttataacgatcttatagaatttattcatcctgtttttaaagcagttaattttttttgtattgcaagtactctgtgatgaatatgctaactagtaatgccttgctcagaataggtagtcataaattttgttgaatgaatgagtacttcttggaatgtagcttatctttttgctgaggtgttgggaattttcacatgaagcttctaatgtgtagaataaggtataacaatacttcaaacaatgattcctctgggaattgactcacttaaattatagtttattagaaaaaccgaagacaaaataatggtacatcataaacttcataaatctgtgagaagagctgcacatgttgagtatgacagcaaggcttttaggcccagcttctatgtcccttcaaatttgtaggacctgcacctgtggggtggtgggtgatcctacccttgtgaatgtttgctctgatccttgggctcctgtttctttgttctcctggtaaggagatgaacctccttcctcctccacttgcaggactccaaatgctccaattcttttagtttctttcctgtcaaaacagaaaagggtttgattttagctatttacacttactgaataaaaagatggatggaccgattttcccttaatagttcatgagtttcattgtaggcattgacccataatttgccaatcttcttagaagaaatctgcaaataggtggagagaatcattcgttcatttgttaattcatttggagatgaacgcacgggtactctgaaataataaaatgtccgtgtttttccctggccacatgagaccaaaagactactcccctctgccaagacaaagtggggacccgtgcttggctgtggctctggaagccttttcctaggaaatgccagagtggagaagactctgtccattgtcattaacttcaagtttaggagtgcactcagccctcagatttctgaatagtctctgaagtacttatttctaccatctcctcccttttcactatccccaggttgatgaccttccatttctcctcttccaccctgcttttgttccaagctgcccaaataaatctagcacatttgattattttcattgattatcaattaatttttattttgaatttccctctagctaatagtatgtattataagtatgttttcatttttccctcaactctggtgaagaaggttcttacaaaggagcatgttgttggaagatgtcttctttattcacagtatttcattataccaaagttggtgataacccagcatggtgtgaacaactatcagcaatttttcaatgatcttgacatttaaaaatatatttattaatagtaagctagaaaactatatgtataagactatattattttaaatacataaatagtcttacaagtgtaagtattgtatcaaatgaccttaagataagatagagcttgttggctttatatttgtgacaattctgacttttgaagacttgttcaaaattgctcttggttgtgcaaaacttttgactgaatttttttagtgtaacttgaagctcatccgtctttttgtgggatataaaggctggcccactgagcttcaacatactgtggggtgggaagtcctctgggttaggattgcttattttttttctacctttaacctgaggctcttgccaaaagagaggcataacttcttcattgttgctatctttggatagcagcctactcttaaaacagcctgtctttttgagagacagtgaaggagggtgggaactagatcctcacctatttttccattctcttatgttccaagtcccaactggctttttggaaatatgaccctcttgaacaaaacaggataaaaattaccagggcctattctcactgttgggaaataattgggcctttgtagggaaaggatattgtcttcaaacattttatctatacttcgtttatggtacttggtaatttcttttatcttttatagttattttgatatgtcttttcatcttgatcagtattgtccatcagtgcagaacattgttgaattctgtagccattagctacgtgtggcttttgaacacatttgaaataattgaagaatttttaatttgtttcaccttagttaatttaaatttaaatagccatgactagtggctaccatgttggagagtacagatcaacttaaggataatgtttgtatttgatttactttctcctgtgttattgtagtatgccaattttatttcctggtgtttggtgaaataggttcatatgtgaaccatattgctttcaaaagtacatgtggctaagccaatctgattgttagaaattgtacatctttgaatttgagtttgaagttggattgtaatggttagtatgaaactggaatttgatgacgaattcttttttaaaaaatttcaacttttattttagattcaggggtatatgtgcaggtttgtatacaagcatattttgtgatgctaaggtttggggtataaatgatcctgtcacccaggtagtgagcatagttcccaatagttagttttgcaaccctttactcccttcttccctccccacttcagtagtccttcatgtctattgttgccatctttttgtccgtgagtagtcaattgtgtagttcccacttataaatgagaacatgcggtatttggttttctattcctgcattaattcttttaggataatagcctccagcttcatccatgttgctgcaaagatagaacgatttattttcttttggatatatacccagtaatgggattgctgggttgaatggtagttctgttttaagtttttttgagaaatctccaaactgcttttcacagtggctggactaatttagattcccgccgccaacagtgtgaatctgttgttttttgacattttttttttttttttgagatggagtctcgctctgtcgccaggctggagtgcagtggcgcaatctcggctcactgcaacctccgcctcctgggttcaagcaattttcctgcctctgcctcctgggttcaagcgattctcctgcctcagcctccaaggtagctgtgactacaggcatgtgccaccacgcccagctaatttttgtatttttagtagagatggggtttcaccatgttggccaggatggtcttgatctcttgacctcgtgatccgcccaccttggcctcccaaagtgctggaattacaggcgtgagccactgcctagccttgactttttaatagtagccattctgactggtgtgagatggtgtctcattatggttttgattggtgtttctctgatgattagtgatgttgatcatttttcatatgttaggtgcttgtgtttcttcttttgagaagtgtctgttcatgtcttttgctcattttttaatggggttatttttctcttgttcaactgttaaattcctatggattctagatattagacctttgtcagatacatagtttgcgaatatttttccccttctgtatgttgtctgtttactctgttgatagtttattttgctgttcagaagctctttagtttaattaggtcccacttgtcaatgtttgctttttgaggacttagtcataaattctttcctgaggccgatatttagaatggtgtttcctaggttttcttctaaaaatttttttttttttttgagacacctaagttggagtgctgtggcataatcatggctaactgcagccttgaccttctgggctcaagtgatcctcctgcctcagcctcccaagtagctaggactatagatgtatgccaccacacctggctaattaaaaaaaaaatttttttttttggagacagggtctcattttgtcacccaggctggagtgtagtggcaccatcagaaatcactgcagcctcgacctcccgggctcaagcaattctcctgcctcagcctcccaagtacctgggactacaggcatgcactaccacacccagctaatttttgtaatttttaggagatggggttttgctatgttgcccaggccggtcttgaactcctgggggtcaagcgatcggcctgccttagcctctcaaagtgttgggattataggcatgagccactgcacccagcctaaagttttttttttttttgtagagatggagtctccctttgttgctcaggctagtctcaaactcctgagctcaagcaatcctcacactttggcctcccaaagtgctatttcataagcatgagccacggctcctggcctcttctgggacatttagtttgagatcttacatttaaatctttaatctatcttgagttaatttttgtatacggtgatagataggagaccagtttcattcttttgcatttggctagccagctatcccagcaccatttattgaataggaagtcctttccctagtgctatttctgttgattttgttgaagatcagatggctgtaggtgtacaggtttatttcggggttctctataatgttccattgttctatgtgtctgtttttgtaccagtaccatgctgttttggttattatagccttagagtagagttttaatttgggtaatgtgatgcctctggctttgttctttttgcttattgctttgactatttggccttattttggttccatatgaattttagaatagttttttttctaattctgtgaaaaatgatactggtagtgtaataggaatagtgttgaaactgtagattgctttgggcaatatagtgattttatccatattgtttcttccaatccatgagcatgtaatgttttttcatttgtgttgtctgtaatttcttttagcagtgttttgtagttctccttgtagagatctttcatgttggttagatgtattcctaggtattttagttcttttgaggctattgtaactgggattacatttttgatttggctcttagcttgaatattattggtgtatggaaatgctactgatttttgtacatgaattttgtatcctgaaaccttattgaagttgtttatcagttccaggagccttttggcagagtcattaggattttctaggtatatcattatatcgtcagtggaaagagatagtttgacttattttcctatttgagtgccttttattttttctttggttgcttgctctggctaggacttctagtactgtgttaaataggagtggtaagagtgggcatccttgtcttgtttcaactcctaaagggaatgcttccagcttttgttcattcagtatgatgttggttgtgggtttgtcatagatggctcttattattttggggtatgttcctttgatgcccagtttgttaaggatttttaccatgaacggatgttggattttatcagaagctttttttgtgtctttgagatgatcacattttaaaaaaatgtttaattttgttaatgtggtgtgtcacatttattggtttgcatatgctgacccaaccttgcattccaggaatgaagcctacttcatcgtgatgcataaactttttgaggtgctgctggatttggtttttggaggatttttatggataacttgaattatttttgctttcccaaaatttattcaaagtgagtttaaaaagctgaaataaccatagctaaaacttcaaattctaccagtgtcaatattcatatacaagtagaaaaaaaacaagttatattagtcaaaagtgttgcttccattaacccaaggataagaaaatctcttatttagaaaaaaggttaccttaatcaatactggtagatgcatatttatacacaggcatactgtggagatattgcaggtttggttctagaccaccacaataaagcaaatactgcaacaaagcaagtcacacaaggttttttggtttctcagtacatataaaagctatgtttatactatactgtggtctattaagtgtgtagtagcattgtgtctaagaaagcaatgtatataccttaactaaaaatactttattgctaaaaaatgctaatgatcatctgagcctttagcaagttgtaatcttcttgctggtggagggccctgccccagtgtgatggctgctgactgatcagggtggtggttgctgaaggttggggtggctgtggcaatttcttaaaataagacagcagtgaaatttgccatattgattcactcttcctttcatgaaagatttctctgtagcatgagatgctatttgatagcattttacttagagttttcaaaataggagttaatcctctcaaaccctggggctactttatcaactaagtatgtgtaacattctaatttttttgttgtcatttcaataatattcacagcatcttcaaaaggagtaaattccatctgaagaacccagtttctttgctcattcatgagcaaaaggtgtgagcatgataaagttgaatgagaagcaactcatcattcaagttttatcatgagaatttagcaattaggctctacttttaattttagttctcttgccatttccaccacatctgcagttacttccatcactgacatcttaaacccctcaatagcattcatgagcgttggaatcaacatctttcaaactcctgtgaatgttaatatgttgacttcctcccataaatcttaaaccttatgaaccaacctctgctaacttcatacttttattctgcagcttcctcacctctcttaaccttcatagaattgaagagaattagggccttgctttggatgaggctttggcttaagggaatgctgtggctggtttcatcttctatccagatcactaaaactttctccatatcagcaataaagctattttgtttttgtatcattcatatgttcactggggtagcactattaatttccttcaagaacttttcttttgcattcacagttggctgtttggagcaagaggcctagcttttggcctatcttggctttcgatacaccttcttcactaagcttaatcatttctaccttttgatttaaagtgaaccatgtgtgacttttgcttttacttgaacactgagaggccatgatagggttattaattggcctgatttcaatattgttgtgtctcagggaatagggaggtccaaggagagggagagagatgggggaatggctagttggtgaagcagtcagaacacatatgacatttatcaattaagtttgctatcttatttgggtacagtttgtggagacccaaaacaattacagtagtaatatcaaagatcactgaccatcataacagatacaataataatgaaaatttaaaatattgtgagagttaccaaaatgtgaaacagagacatgaagtgagcacatgctgttggagaaatggaactgatagacttgcctaatgcagggttgccacggttcttcaatttgtaaaaaaatgcactatctgtgagcatgataaagtgaagtgcaataaaatgagatatgcctatactcttcattttggttcttttgagttagtttttgttgacttgtcttggactggtcagtaaggggattataggtatagttcattttggattcgtgggtattttgtttacatttacaatacaacaccacactgggaagttaagaaatgagtctagaacttttatttcaaatcactgctgctttctttctttctttttttttattattattatactttaagttttagggtacatgtgcacaatgtgcaggttagttatatatgtatacatgtgccatgctggtgtgctgcacccattaactcgtcatctagcattaggtatatctcctgatgctatccctcctacctccccccaccccacaacagtccccagagtgtgatgttccccttcctgtgtccatgtattctcattgttcaatttccacctatgagtgagaatatgcggtgtttggttttttgttcttgcgatagtttactgagaatgatgatttccaatttcatccatgtccctacaaaggacatgaactcatcattttttatggctgcatagtattccatggttgtatatgtgccacattttcttaatccagtctatcattgttggacatttgggttggttccaagtctttgctattgtgaatagagccgcaataaacgtacgtgtgcatgtgtctttatagcagcatgatttatagtcctttgggtatatacccagtaatgggatggctgggtcaaatggtatttctagttctagatccctgagaaatcaccacactgacttccacaatggttgaactagtttacagtcccaccaacagtgtaaaagtgttcctgtttctctacatcctctccagcacctgttgtttcctgactttttaatgatcgccattctaactggtgtgagatggtatctcattgtagttttgatttgcatttctctgatgcatctctgtgttcttctcatgaagcctgtgtaaagggacagctaaatttggtgccacctgtaatataaatttcaaaatattaccaacctgcctaatagggatgaaatatacaaattcagcattctttatttatctaaggcaagtggctattggcagattttatgtaatgtaatgacatagttatgatagtgtcatttgggtggcagcaaaaaaattaaatgactaattcaaaggtcttttggggatggattttggaaatgtgttggtatttagtaaatttgtggtctagactaaattgaacttaaagcattaatgaacaaactatttcataatgaatacttgtttctgcttttgtattacctgtaggacattcttctaatcataagtatatgatacagtccctgacagagagacttacattgtagttgattaagtagaatcaatacttaaaataatttgcaatatttagtagtatatgtagtagactaaacgaatgactcagacggtaagttttgaaaactttgagagaaaggtgttccctaggatgattggaaaggcttcatggagaaggtgggatttgcactggactttgagcaaggtagagtgtagcagaaagaaaaggaggacactctagacaaggaaaccgatgtgagtggaggcttagataaagaatacatttagaatatttgggaataaggaatggacatgtttgttggaatgcagatttcctatgggacctctcaggagataaggtcagcctggaagctaggggaatgttgtgtaaggctttgattgctgggccaaggaattattctaaaggcagtaagaaaccattaaacatttttgaatagtgggaggatatgtgagaactgagactttatgaagactaatatctttcttggaatacaggatgattgggaaggggagagagattttaaaaagtacaggcatttctcaaaagaagacatttatgcagccaacagacacatgaaaaaatgctcatcatcactggccatcagagaaatgcaaatcaaaaccacaatcagataccatttcacactagttagaatggcgatcattaaaaagtcaggaaacaacaggtgctggagaggatgtggagaaataggaacacttttacactgttggtaggactgtaaactagttcaaccattgtggaagacagtgtggcgattcctcaaggatctagaactagaaataccatttgacccagccatcccattactgggtgtatacccaaagaattataaatcatgctgctataaagacacattcacacgtatgtttattgcggcactattcacaatagcaaagacttggaaccaacccaaatgcccatcaatgatagactggattaagaaaatgtggcacgtatacaccatggaatactatgcagccataaaaaatgatgagttcatgtcctttgtagggacatggataaagctggaaaccatcattctgagcaaactatcacaaggacaaaaaatcaaacaccgcatgttctcactcataggtgggaactgaacaatgagaacacttggacatgggaaggggaacatcacacaccagggcctgcctgtcatggggtggggggatgggggagggatagcattgggagatatacctaatgtaaatgctgagttaataggtgcaacacaccaacatggcacatgtatacatatgtaacaaatgtgcacgttgtgcacatgtaccctagaacttaaagtatatatatatatataaagtacaggtgtgagatgaaaaggatctggacttctgttggcaaaataggaagagaaagggaaaggatgaattatagtagtagcttgtttgatatatcagaattaaatatttatttgttggcctactgtgattgagagatttaatgcctgagtgactgggagaagcaaagtgtttttttgtctggagggatgatgtgaaggaaagatgggttgagttttagatattttgagttccaggtgacggaagggcctgtagatggtggacccagcaggtagccgagatggagaagactgacactggctctcaagtggaagagacatcacttttccatagggtcgtcagttaaattcatgatgttggctaagagagaagatctacagattgatgactgtatcctggagatgttaggggatgaagagagggggaggagccagtgtgtcttataatacagaaagttcatggagaacgaaaactgaaaaaataccactggatttaagatacttgagaattgtgagctatgtttgagaggaatagttggaatccaaagtacacaagtaagattatgactaaaatatatgataaagaaataaaagcaagtagtacaggccatgtacttgttatattcctgttggttctttctttgcctgttctttagtgtgtttacttaaatggtctggcaggcagataaaaggaggtggaacttaaaactgtccaattagttctgttttttttttttttgcgatggagtttcactcttgttgcccaggctggagtgcagtggtgcgatctctggctcaccgcaacctccacctccacctcccgggttcaagtgattctcctgcctcagcctctcgagtagctgggattataggcaagcaccacactgcctggctaattttgtatttttagtagagatggggtttctccatgttggtcaggctggtctcgaacacctgacctcaggcagtctgcctgccccagcctcccaaagtgctgggattacaggcataagccaccgcgcccggccactagttccctattaagagactagttagagtaactagagggcattaggacgaaaccattagttatttggattataccatggatcagattagttataagataattgaaatttgattgtaaatttaatgaaattaaagatgaacattgatgttactgaaaattatactttgactaaatactacgttttttgtttttcttgtatcttagtttctatgcagattttggaccgctgaacttggcaatggtgtacagatattgctgcaaactaaacaagaaactaaaagtgagtattgtagtgatatttataatttggaattaaaacatttgaaccataggatctgctcagtggggttggtgtgcacaaaacatttagtcaggtgatcttgatctctggaaatttatgtgagtagttcacctagagtttgaaagtgatcctcctgattataccacaaaggacatgttaacctctttcagttttcagaatgaattgcaatatgagctgaatgaagtcactggaatagtgatctaagaaagaaagcacaaatccttttaggctgttgttaatgagtctctatcaaattccctcctaggataatttttctgaaaccttcagatatgcctgtagaccctgtttccaagtgatgaacagggcttatcatggctggagctgtgtgcataacattttctgtttggtcaagattgaaattttttgcatgtttcttaaatgttctgtgtagttaacagccaggtgagattgatgaaccagcagcaacagagaatggaatttacctgagatgatagaattctggtcatacatttagtattcatctatagttttgatttcacatgggtatctggtttccttttctgtacttttatgtggattttggcatgtggctttttttttcttcttcaagcatatgaggaaactcatctatatacctagttttagtaaacttattttatcacacagaaagcaatatttatctccttgtcttccaatttctaaatgaagatctttactatttcagtttgaaagacaaaatgctatacagaggactcttaaggataaatactaaattatattgctcaggtattttgctctttctgctgggtaaaatgttactggtgttacatagtacaatgccttggacatattaactgttctgtgattattttttgatttgattggtttttaatgaacttaggtataaaaagcagtctgatagagaatttcctgtagaatatgttgtatccttatgaatttacaaatttttgccattgatttcaaagtgagaggtggacatggaattataccaaaaagaatcaataatcatataacatattaggttggtgcaaaagcaattgtggtttttataattacttttaatgttaaaaaccacaattacttttgaaccaacataataaaatctgttttactcaacttttgtaggaattaacttacaaagttgtctgacttgaaaagatacatgtaaattcctttaattaagccagatctgtttttaagaaaagaagccagtattttagaaagtaaaatagaggtttttgcaatcacctaggaagtaaataatatcctttttatagaaaatgaacttttaatggctgagtaaacaagaaaaggataattaataaataatggaagtctatttttttcttttgaagaccaaggaatttctttgctgtcttgattagtcattagtatgtagttggtatgaattgggtattataattaatctgggaaccgagtactatctagggtagccaaagagaaaggagtcattatcaggaaagtaaaatcactggtctgactcagtgttctacttatagcagttgcagaagagtagatgggttgagttgagagtattttttctaccattttctacactgaacagtatggtaagtatatgtatgtaaacttgtttctatttgctttcatttataatgctgtgtttcgacattattaataaagtttaaacactctccttggttcattttagtggtaaggtaatctgttggttgtctggaatgacatatgtagctttaggacaattaatgggcactgcattacttgctgaatgattgaattttaaaaacccaaatgttgataagtcatgagttgtctcaatgaagcatactacatagaatctctaattaggagaaaaagatttactgtaccagtccaaagttggaattgcttcagttttgtggaatcttagtttcttcatctgtaaaataggaattatagaactgtcacagggtggtggttagtattatattagaaaacatgtcttagtctgttttgcattgctataaaggaataccagaggctaggtaatttataaagaaaagagttttatatagctcatggttccacaggctgtacatgaatcgtggcaccaacatctgcttctggtgagtccctcaggaagctttcactcaaggcagaaggtcaaggggaacagtcatgtcatatggcaagagagggagcaagggagaggggagggaggtgccacactctttttaacaacaaaatcttgggggaactaagagtgaaaacccactcaatcccctcagaatggcaccgagccgttcatgagggatctgcccccatgacccaaggccccacctcttaacactggggatcacgtgagatttggagaggacaaatatccaaactatatcaatatgtaaaagctttgtacattttaaagtcctatacataataaagttaccaatgtaacatttgtgaattctgatagggaatataataaagacagttcttctacaaaatcgatgaacacctgtttctcagccttaaagctattgtttatatatgggaaagctgtccaatataattttaggaatctaaatgaccatttagtcaagactcagaaagggaagcctgggaaaggtgtgtgacttgcccagtgcagcaggcaaagtcagggctagatttcatggctcttgaccacatttttcctgttcttctttccaccttcagtaggaaccatagcctctggtttacagtcatcctttgttcactcttagcattgccccagctacctgaccttgttgtcccacgctgactttgaggctcctctgcctctttcattccagtaagtgttagggccattctgtctgcttcacttccacgaacccagactccagattctcccacttggaaaatgcctttgttactcactttgcacattctgtccctctcacactactgggattgctagaccttcagtctccctgttctctcagtccactggcaccctgctgatgtctcttgcctgcagcccatggtcacttacttcagtaaggtcttgggtactttgctttcttgtctttctgccttgccagctctcacccttgttgttttcccagtggatgatttcatgcactaatttactgggaagcagcagtacccttgccactcccagccttgcactttactctaccataccagctgttccatgcatttgctcatgaagaccagtctgactgggatgcccttaccctctggcttgatagctcttcattctttaataccttgtccagccaccaccctttaggaagcatcttcttgtccttttggactggattgagggtgcctcccttgttttcccatcattctctgtgcagatctgtatcgttgatgaattgtaattacctgtttgcacctgtcattctcactagactatgagcttctagagggtggaaggtggaggatgtcatgtatctttgtgttctcagtgcctagtgcagggacaacagacacacagagacttcttttgactttgtcatgatccccttcatttgcagatccccctttctccttttgcttccagaggtttcagaagaagagcctgcctccatccttcctgtgtgctgatttcttaaccctttgttatctaacttttgccttccctactctaccgaaactgctctaataacgtcttaaatgctgaatctgatggcacttgctggatcctcaaactcctttacttctctgagtaatttcgcactgtgttaactagtaacttcgtcttaggattcttctcttgtgtgatttcccagttcttttaggcacatttcattttttagtttggaaatttttattccttccaagaaagcttgtgtgatttttcttcctcattctgtgctttatatagataggtaatattttgctgtacattttattccaatcccaaatttctcatttttgaaatgagaagatgtttttttccagttgatgatttgagttggtgatttatcgctatttttgtgtttctgtgtctatatgcattctattcccaatgtccttattttaattatgtcaatcagaatggaaaattatcccatcaaacatatgcttagattaaaaatccaaacataaaatgcatcatcaccaataaaaaacctgctgcttatttaaactgtactttaaaaaattgtcagtactaggaattaggcagtaataggttgctgtttggtctttcccctaggataggggaagcaatcaaaagagggaagatgcattgaagtgagaacaatttgttaaactgtgtatgttatttaatgttaaatgtcatcaatgattgatagccttgagctggaattattattctggtaattcaagggatccataaacccttgaaattatacaattttgtatgtatttacatttttcttctgggaggattcatggctttttttcaggttctcagagggatccttgacacagacatgctaagaacactgggctaaagtcttctgaaaaagaagactttactaacaaaagacaaagttgtggtattttgaaaaaactgaataccttcctctattcttttttttttttttttttttttgagagggggtctcactgcgtcacctgggctggagtgccatggtgcagtcatagctcactgcagcctcaaactcctgggctttgatgattctcccacttcagtcaactgactaactggaaatataggtgcacacttctgcaccccacccagctaactatttttttttttttttttttttaatttttgtagaggcagggacacactatgttgatcaggctggtcttgaacttctgggcttaagctagcttcccgcctgagcctcccaaagtggtgggattacaggcatgagccactgtgcttggccgtcaatacagttttaattattgatttcattttcctctgagaaaaataaaacctgagcttggagaaaaaaaaagtctctgaaaaaaggggacattttctagggcagtggtttttcttttttttaatacctgctgttatgaatcaacaggataattacagtaatcttgaggactattttaaaaaaggattaaaggagtattcacagaaatgtaattttaaatttacaaaacatcccatatagccctttcagggtaaaaggggaagtgggtgggtatcatgaaaccaaccattatattgaagcattggaagtacctggcagatggtggggcttagggaatgtccttgttgctgaatgaatcagtgccataatcctatcctgtaaaccaggcacctgccaccctatcgggggttatatacaccagaactcttttgatgtaatgactagaccaccctattataactacaaaaacatgttgagatttcttcatgtggttcttttctgtttctggctcataggtttgtggggaagaaaagcaagctacattctggagatagttcatgtagtttaaagaggttctaggggctccaaagcaatgtcaactcccataggagcgagcatataccgagtttgcaaggcaagaaccccttatgcctgttaggaatcctcaggcaggaagaaccccgtttatagagaatcccacgtgccttcaattattgattattaacacgatgaaatcatcttcatgagcaacttttctctgacattttgacttctgctttaatcaaatgtgccatttcattaatgaaatgtattgggtttgaaacaaagtgggccacacagagacacctttttctttttaaagaaatgattcgatctatttcatcttggcactaaataaaaaacataaaccatattttgttttgtacagccaaagaacattttccagagtattcctttcctgagaaagttggaggtaaaacttgtaaaggtcatggctgctcacaggaagacctgctcattttatcgcttttgcagtgagatgaccactgattgctatggagatgctgattgctgcggccattactgggctagcctagccacctgtaagagaatgatgccttggtcattgcggtccctgtgctgtgatctccttaatatgaccatgatcattgacagaacttgcatgtttaggaggtgcatgggctctatttttattaaagagcatattatccaggctgcattaatgtcttccttagctcagtcagactgattcatacagcttaattaaatacagcattctaaccaaataacttgaagattttacttttctgtgtttctttaaattgacctttaactcttttttttttttggctttggctttgagcctaattgcatcaccttttgttattgaatggttaagtagtttgtgctctcctgactgaagctgaacaagtgcatgatttgtgtttgttgccataatccaagtgtagcctgagctatttgttatttgtgcagcttgtcattatttttttctctctccaagttgctgtggcttgtgttttacaaggagtgatcccactagaatataacctttcacatagcttttctttccaagatagaaaatgtctggggtcaatacccttatcttaatttgtattgttctatcatagcagtcattgtactttggtttataagtaccattaagtatttatgatatacacttatgatttacataacaggggcaaaactttgactctcaggtaagcaatacagaaatttctataggtttgattatgttaattgatagtcaatactaaattccaccttttatctactatattttttccttgttaaatgaaacacttactgtacctgtaattagtatcattttattggtccttgtgtgctgtaaatgcatcctatacagttattctcctctgtttttaataagccttggccaatattttgcattaaatattcattagcctttgaggttagagagtgggtttcttctccccttgtcactgcattgctcagcaaagtgtttgacacacaacagctactcaattcatgctgatggaacccatagaaccttcttcagccgcagtatcctggcacccagatttagcaaattggtcacctgtggcctgcattctgtccacagacatgttttcttgagcttaaacactgtttaaaaaattttaattcatagtcaacatctgcagtttatgaaagcttcaattttgtcttcttttaaatattgcagtatctgaccattctgcacccagattccctcacaagagcagtaggttggagcttactgcactttggatagggaatgcttttcttatttaccagctgccccacttcagattcttggcacctgagaacatctgaatttggaacttctggaataatgacatttaaggcagcttaattacggaatcattaaagggacttgttcctaaggtgttatcacctggaatgcatgaatttacaaattgtaataaggtttgctgaggaatctggggaaatgtgttttttgtaaaatgcttttaaaaggcttattgcatgatttagaattcctttttaagagaatgtagagttctttcgagactacttgaccagatggacagtgttttagcttcatataaaagattcccaggggtgggaccagttacatgtttatgtagtgcttctccaaaatttagccatatcttagagtagtggatttcaatgtgtggtgtctggaccaacagtgtcagcattactggaaaacctgttagaaatgtaaattctcaggccctactgaatcagaaattctggaggtgagacccagcaatctgtgttttaataagccctgcaggtgattctgaaccaatctgttaagagaatgaaatataatacaataataatataatgtggtttagagttagatttagttatttctgaaaagtcttagtactattgaccaattcaacctgagaattattcaaattctgaagcatgaaacttgttatggcctcataattaagatttacacaaattatcaggctctgtgagaaagttttggactgatcctgcttactactcttactgtgtaaatgttcgtcaaaggccctctctgactctgggcttatgttctccttgtaaaacacagtgtgctcattatattttagccttgcccaggacccctagtctgggagacgttatgtgtctgattaaactggacccctctggtgccattcctattgctttggataatggtggaatgtcacaagtgagcaataaatgcgagctgttgttgcggttattatagagggctggctatgtccacttcagtttagaaagttcagaagggtatttgctttgtaatccccgcactttgagaggtcggggtgagcagatcacttgaggtcaggagttcaagaccagcctggccaacatggtgaaaccccatctctactaaaaatacaaaaattagccaggcgtggtgtcacctgcctgtagtcccagctactcaggaggctgaggcatgagaattgcttgaacctgggaagtggaggttgcagtgagccaagatcatgccactgtattccagcctgggtgacagagtgagatagtatttaaaaaaaaaaaaaagaagagtatttgttccagtttcaagatagaaatctaaaacataaggtggatagtggctggctgcagattgtgatttgtaatgggtcatgtgctgtgctgctacagagctggcaaatagtccagaggtctcagtattctttctgtgaccctctctattttatatttacactgtatttattggaattgaccaattttaaacttcactttgctatggcatacagtgtttttgtaacctgtgagcttcttgtgtaaagcagaaaataatctgtaatagagcaggtagctcattgaaagcctgtggctatgatgtaaccttgcaagtgttctccttgaagggcccactcatcatatttgctttgtaatccctgcactttgggaggctggggtgagcagatcacttgaggtcaggagttcaagaccagcctagccaacatagtgaaaccccatctctactaaaaatacaaaaattagccaggcatggtgacaccttcctgtggtcccagctacagaggagacagaccagagtaaggaagaggccactgtccaatttagaggcatgatattctcctgatattagggcagaatctgagaaaacattgactgggctcatacatagagtcctgtcctattgtctccaaactgtgactttgtctgcatggtaaagttcttccatgaaagatctcaaaagagaagttaatgttccatagaaggtacttcaatcatcgatgtctccactgggtgttagtattgcttcttctagggtgctttgattatgtaatagtattttttaagtgggggacatgcttaaaatttgagaggaaaaaacattaaagagttttttttttttaaatcagcccactcatataaaacatcagctaaacaacggacaaaatattttgttacccctcaaatttttattccaataccaaagtatcttctctgttgaacagcatcactggtagaaaactgtgggccaggatgaccataagagggaggcccagttgtgaaaaggaaagacattagcaaaaggcctaattttgatattagcaaatttgagattaattagaaaattaattaggaaattaggacaaggtctaattttgagattagtagatttttctctgctctcattaactttgaattcgttttgattcctcgagtgagagaactcacctctcagtgatttgacctcggagatgctggccaagcttcgctaagcaggaaatcatttcttggctggtgtgcttttgaaacttaaccgaggaaactgaattccaaaaatacctaagcaaagtaaatgctagcagctttaaacattttcctaaaaatcaggcagaaagctctaaaaagaagtcagttatgtttgcttcctgtggggagtttctcataggaaatattttaaaataaagtttctaggaagattttgtgaagatcattctctatctgatgtaatttatgaaagcttataaagtttaagcattcttctaaaatctttaaagtgttaatttgtattatatttacttaaataatatttatagctatacagtgaaaagaaagtcttcctcagagttctgtcctttagttttatggctcatgttccaggataagtctctgtattctatatactttagaatgcgagagagaaaaaacgaaaccaagtaaacacaaaagattctactccccccaaccccctccaaaaaaacccaaggaagaaataagcatcagtgatgaaagaacagcactataacttgtccctttcagcaagtagatttgtaaaataaatacagtttcacattattaaccaatagcagtagtttgtcataaaacctaaattcttagtagaaaagagcatcaaaaatgataatccagacttgaagatagactgttgatattttcttccccacaggtattttagggaattaggaaatgtaaatagggagaggctgggagccataagagcgtcgagtccctatgctcagtctgactcatgtttattgagagcctggcctgtgtaaggcagtatttagatatttgcaattcagagatgataggagatgcttaggtctgaagagcctttatttcctttttggtaaatcaaacataacttattgatggggaacaaataagtggcaaaaccaaccaaccacccaacagacaatgagacaatgaaataaaacagaaaaaggcaatgttcaggcagtcagtagttccaaattgagaaagcaaagaatcaagtgtcagcaccattggttgtaacctttacatccctaggtaacttcaatgcatcaactcaactgagctgaattaaatgctgtgcctttgttctctctttatttcataggagtatttgtataaacctgtcaggaaataagggcattggcaataagatactttctttgagtcaaatactaattttttttgtttgatttttgtttgtttgtttttgagacaaattcttgttctgttgcccaggctgtactgctgtggtgtgatcatggctcactgcagcctccatctcctgagcttaagtgatactcctatccagtctttttgtagaactgggtctgtctatgttgctgggctagtctcaaattcccagccctaagtgattctcctgctttggcctctcaaggtgttggaattacaggcatgagccatcacacctggccttacatactaatttttaaaagtttaataaaaagggcactactggctgggtgttgtggctcatgcctgtaatctcagcactttgggaggccaaggcaggtggatcacttaagcccaggagttcgagaccagcctggacaacatggtaagacctcacctctacgaaaaatacaaatatttgccaggcatggtggcatgtgcctgtggtcccagctactcaggaggccgaggtgagaggatcgattgaggctgagaggtcaaggctgcagtgagccagatcatgccactgcgctccagcctgggtgctgggtgacagagcaagaccctgtctcaaaaaaaaaaaaaaaaaaaaaaggtaaaagataaaagggtacagccattttcagataatgtgattctaggagttcgagaccagcctggccaacatggtgaaactctgtctctactaaaaatacaaaaattagccgggcgtggttgtgggtgcctgtagtcccagctgcatgggaggcaagagaatggcttgaacctgggaggcggaggttgcagtgagccgaggttgcgccactgcactccagcctgggtgacaaagcgagaatctgtctcaaaaaaaaaaaatatatatatatgtgtatatatatatatgatttttggttataaaagaaatgcctgacttggagtgaagatttcctggctcattggagggatacactttctgtggttacatggtaaagccagagtgttgcagtttcatcttagaacgggcttcagagatggaagagtttttttttaatttgtagacaatagcaggatcaagaaaagtacatagttgagctctatttaccttttttaaagaggttctaaaagcagggattttctgtgtgttgtagtcaatgtataagatagaaaaagctgcttttatagtcaatgtgaatttatagacaaatactgaaatgtacttttgtgcctgtgttttttttgctagctcattaaagacagtttatgtacctatatttagaaaatcaattgtcaaaatacataaattttgaaaagtgaggaaatcaagcagatttcattgagttacattgtgttctcattgtcttatacttattcgagttttgattaataatttgatttcattttaccagatctttttgtcatttcttttcatgtttagcatgtgtacaacataccatgttgattattttgaacttagttaaatacttgagcatgcagcatattgcctggcatataacaggtgcttaataactgtctgaattcatgaatttaatagatggctattgtaatgtgttgtattaagatgtttgctgatataattttttaatggtatttttccattaaccaagtattttcagatattaaaagggggttgttatataacatcccagaaataaaatactaatattggtcttcaaaaatacgattttttggagatcatagtaaactggttgacattttaaaaaattgtgttatatgaaaactatagataatattcctgggagttggagtggcatgtagggggtaacaaagtgtgaagagactttctgtagaagatttagaataaatagtcaaaaatgtttccagttaatagagatgccaatattttaattattttccaccatattagtttcttttctgggagagaaagatattaattatattgttgattcttacattatgattgggctgtacaaaatctgagctagtaattctctaaccctcaaatgccatagaaattaaagttgaaagttgttaaattttatgggttgtagcacatcttgaaggttaagagatgatgtttgccttctgtatatgttaactttgtctctatggttacactaactctttttatctcctctttctagtcatacagtttgtcaagaaagaaaatagtgcactacacctgttttgaccaacggaaaagagcaaatgcagcatttttgataggtgcctatgcagtaagtaccttcttcatgattattttctataatcaggccagtgaaatgctaacactgtcaaagaaaatccaaaccagtttttcagtgggattgagagacggtggagattattagcagtttgggaattgatctgtagtgagaaatatggactagcagtggtggaatgtttactctttagattttattttctactagttaatgagagaatcttgaaactgcaatatgtagcttgaattccacagttatataggtattttaataaaaagaatacctaccaaggacatttctaggaaaaaaaaatgtgtgtgtgcatgtgtgtatgtttaaatgcatgaaatatgatattatggaagattttaaaagacttgacgtgttcgttttttgggagaagaggaaaccttagattgcacaggggaggattgttattatttttatcaatccattcattaatttatacaattgtttgcagtaggcaaactgaatataaatcctgcatatattatagcttccctaataactacaagagacttttccaaaactaatttcaattagaaattttgttctctgcagacactaacatgtcagtatgaattccacatgaccatgctgtagagttttaggtggtgattctggaattttctatatatgctgtgattgggcaaaagcttagaaagcagaaaccatcagagctaaaacatacttgcagggatatgtgtgatatcagctgggaatatgctggtttaaaggcagggagcagagaggtatcatttcccctcatccttggggagggctcgtgctcctctgaagccatggaagcaaccctgctgagtgacttttcaagggcctcattctaaggaccttgagggaagagggcaccagctactagacctcaaactctgccccatcaacccaaaagctctaggggaaaaagcccagcagtattgctggaaaagctgtcagctattgcagggtgcaggctgagaagagtggcagactgtcagccaggctgtgggctggggccttgcttgtagcactgaggtgcccagccctgcccaccttttgtcccttgatgtagctgcaataaacccttggcctaccccttgtggcagcattctttcttgctctgtagatagcatggtatagtacaaggaatagtgtctaagagtcagaaaacatgtttttcatcttgaagggctctgtgatgatgcactttatctctctcagctttatttagtttccttatccgcaaaatgagagggttggatgtaatgacccctacatttcctttcagttcttaggatactgagagtatttgtagtgccagccaggctattgcttttattttaagagcatacatgaaaagctggcagttagcatgaaggttcagtgaagttctggtaagctgaatattttttaccttacattgataatgactactcatttgaaattgatgattgacactgtgattgaaatatggaaaaagactgtactaatttctggattcaagccctgtaaacaaacgtgtttttcctgcagggttttgtgatgctttgtaagcgtgttatttgtggatcctttctcataaaggattgccatcaagaagaggtcatttgccactcttcgcacgtctttcttttttttttttgtgaggaccaaatgatttttattcatattcgtctggtttatctacccaaagtgttcaggacagtgttcagcacatattaagcttgatatagcagttatctatgatgatgatggtaacgatgactctgtatagtcactgtgtttctgaggtcttgtttggtaatcaagaatgtgtttagaactatctctttattagacaaggtaataaaccaaaagtttccaacttcctgtacatgttgaaagttttgaataaagatccttggatacaaaacatggcccacatggctcaaaattaattctgtgacataatattattctgaagtcatacttattttgaaagcctaaaggtttttcttttttatggctataaaaatatcaccaagctagacattttaattctgttgagatatacaaatagaattaccgcagcagcccacacattctatgatttctaaacatttaaacatcaatggttttgggaagttgctgttgtccttaacagttcattaaaagttcagatgccttttgtgagagcccaacttttctacccgcgaaattgtcttttcagaagtcttgccggatgttttctttgtttgcctttccatgttgctgtttaatttgatagatttcattttctagttgaaaaatagtccgttcagtctcataattcttactacagatatccaatttgactccatttctctcaatttagatccagctgtgagttgcatgttctttctctgccagtttaaatcttgaatatgttttcttaacttctgaagttctttctgtgcatgttcaatcatatgaactagattttcattgtatactttccaggcattacatccatgctgtgacattagtttcagattctcagttgtaactgcttgatgctctaactaggccatagaattgtttacacattcttgccatgcagtaatgccatttttttgaccagaggaaggggctggaagttcatatcgtttcatactgagcaattcagttggttgtcgagcagccagtctctcaaattcatttctcatcatgtcagtttcaaaagcagaataatccaggactgtcaggtatctcaggtagttcatagtaggttggtatctgcgagtttacttctccaccagcactgcagctgcttcctgcacaccagaggcttcataaccttgatcaaaatatggatcaagtggtcaatatcaatcaagcggtggcacacgactgtaatcccagcactttgggaggctgaggcgggcggatcacaaggtcaagagacggagaccatcctgaccaacatgtctctactaaaaatacaaaaattagctgggcgtggtgatgcgagcctgtagtcccagctactcgggaggctgaggcaggagaatcgcttgaacccaggagtgggaggttgcagtgagccaagattgcgccactgcactccagcctggctacccagcgagactctgttccccctccccaccgcaaaaaaaaatatatatatatatagcagtgcatccacctcaacctctccagccaccaaacctgtgcctgccattctggggacctcaggtttgccctactcttctcatttctttacccctttttccctcccttgcatcttctctctcttctttccttacttatttatttatttatttattgagactgagtcttgctctgccccacaggctgcagtgcactggtgcgattgtagaccattgtatcctcagactcctgtgctcaagcgatcctcctgcctcagccctccctagaaggtgggactgcaggtgtgtgccaccacagccagctaatttcattttatttttgtagagacagtgccttgctttgttgcccagcctggcttcaggactcctggcctcaagtgatccccctgctctggcctcccaaagtgctgggattacagatgtgagacaccacacccaacctcttctttcctttttaacacctattcttcctgttttgtttagtgtggttcttcattttagcagggtgcctctagaactttgaaaggattaaattagatgcgttgagcttgtcacaaaatactctgtgacaaaatatgtcttctgatggagaagtttccaccactttaaagcaaccaaaaggggaaaaagcagtcctagcatggtggaagaagtgctgagtacagcatgagcttgtcttacacactagttacagtcttgagaagcagtgtgaagtgattattcttgaactggtcatgtcccaattgatttttctaattttgtaactgtattccccagagggctttttgacacaaacccttaatacacacggaactaaaaattggcagtggatccttaaagagaattttatgcctttcttcgtattgtttgtatgtatttacttgttgacagtcttgtaagatagtcaataatatccattatacatatatctcagttaaaatttacatatattaaatgttgctagttggataagtgtccgttttctgggggaatcttctctggatacaaaagacctttaccttcggagcagccatgtaacttacatgaggcaagctaggtaggtaggtatattttatcaaacagaagtctttaagagtgaaggtgttcctgttcctaaaatgtggaatcggccctctgttaagtggcattgactgactaataaaagtattttgtactaagacaaacctttttctcaaagccttagttttctcatttgtaaaatttggataatacctgagtttccttatctgcttcacaggattattgtaaagatcaaatatccaactgcctgtttgatagctccatattatacatctaaatgatacctcaaatttattgtgacaaaacagaagtttttattccttctctccctaaatgtatttatttcccaagtcattccctttttagtaagtggactaccatcagtgacttgctaaatcaaaagagtagtcattttgatttcttttgttcgctcatcccacattctacttattcgtaagtttggtcagctctacctctaaaacatattgaatcagaatgtatctttccatctctgttgctatcacctagcccaagccactgtcattgttcacctggattatgaccacagctttatatgttgtctcctttttatattcttgcttcccattaatttagttgccatacaactgtcagagtagtcttttaaaattgtaaattagatcacgtcattaccctgtttcaaatctgttattgctcactgatcttggcataaaatttatccttaccaatgccattaagatcctttctgatctgaccctctctacctctgtggtctccttgctcaagttgctcccctcatgctggacttctaactgaaattccatgcttgttcctaccaaagagccttgatatttctgttctatctggaatgttcttacttcagacctctgcatgcctggctctttctaatgttactttctcagagagattttctcttaatttctaccctgttacctccacccctagtcatcctttagacctttgttgctttattttctttacagcatgctactatttgaaattactttgtttatgcatttacttgcttattatctctttcccagactagagggtaaggactttatctgttttgttcgtcgctgtgtgtggagggtgataaaatatttaacaaggggttaggccgggtattcacccgttgagttggaagctgggacagggtcctggaggcttcttgctttgctgaatcttggggaagtctagggcctagggggtgggcgtgggtcccaaggaagagactaggatggccagtgtggagtggagtggtgtgctgtgggctgcagctatttaccaactggtatagaactatttcagtatttgaacactatcaatttagagctgtgcctggtatgtaatgggtgctctgtaagtatcttttgagtgaatgaataatgggatgacaaaacatgaaagaaagaaggtaatatatgggaaactcctgaaaataatgaagttggacgtaaggtataaagtggtgtcttcccctttaccagaatatttgtagtcatgactgagccaactttggtttttaaagatacagaatcaaagtaaagagcatagaccaagggtagtaacaagtatacaaaattacatcactacctagcctttttttaaaaaataaacttgtattttcccaatttttttgtggtaaaatatacgtaacatgaaacttgctgtcttaaccattttaaaatgtacagctcagtggcattaactacttttcaactgttgtgccacaaacaccatggcttacttttgagtgtgccatcttgtggcacttttggtttctctgttagataatgacttcaagtatttcacagcttttgtgtttctatttccttatatctaagtggggggagactttttatgctttctctcatagagctgtcataaggatcaaaaaggagataaaatatagaccaagcttgtttaacctgcggctggctttgaatgtggcctaacacaaattcataaacgttcttaaaacattatgagattttttttttttttaaagctcatcagctatccttagtgttagtgtattttatgtgtggcccaagacaattcttcttcttccaatgtggcccagggaagctaaatgattagacaccctgatatagaccatcatgttcagtgatcttaaagccagggttgctggaatgatgtgggcactggagaccacagtgacacttagcagatgctaggcacccattttagggatgcctctactagtagagcatctcttcaccccctgcattgtgacattgtgctccttgagatggaaggctcagatttaagaagagaccagctttgtcagaaaggtgtttcccttccagggcaacactcagtgcagttttgaagttaggatgtttagatcattgtagcatctaaaacactctgatatgagtttgaaaaagatggctttttaaaattatgagtatgaattaattaggttcttgccatgtgcttaaagaccaagtcttcactagtacctgtgttactatattgttttcagttttgcaggcctaggtcaaggagaatttggatcaggtcaccgtgactgaagaattggaaaataatatgtatgagaagatgttaaaataagtgtgactgtatagcttagaaaattaagttcagagttaaagaaatacagtttttttttctgttatgtggaggatgcttaaacagaggtggtagccacattatatactttccttacccacttgttaagtctttgcattgctaaattagaggtctacattgtggattaactgagactagcctgaaccagatgtcatgtctgaattgggaataacaagcctgaggtttttagactgtctaaccatgtctgtgttggctatttattttgtagactacacttaagacctaagtagttatactctactgctaagtctgtgactaattgcaaagaagccattctccatttggcttagtggttgtgagcaatgactttaacatagccacaggctcactgggctttgaatccaattgttagttgtatgccctgagcaagttaacttatccaaactcctgtttttttcatctttaaaataggcataataataccctattttacttgcggtgaggactgaaggaggtcatttatataaaggtgtcatcggtgcagtgtctgacgttgtatgcacttaggaatgtctggtggccctggcagggaagctgtgtggccttccacaaagttttctgacccagtctcctacttcctatcactcacttttgtgcgtagaccctttgggctacctccctgatgatcggacagctacttcccctctttctgtctgcccatcttcctcttgtccatcatatttttcacttaaatacttccttggctcagtaacaacactcatatggttgttaatctgattattgcttagtataattcactggaaggtaggagtatatttctctccaaggatgttattttaagggaatattttgtttaaaccaaatgaatttgtgagatctgtagtcaggtattcattagttcagtaaatctttgtttagctactatgagcccttcctagcactatggtaggttctagggaataaaatatatatacatataaacaatgcctagcttaaaatgtgggacaggtgagcaataaacaattgtttaaagcgggcaataggtacaattgggtaaatatgaatttatctaacaaatgtttttttgaggtattttcatgtaacaggccttgttcctggagttgaggatactaaggtgaatgactccctgcctgttggtgtgggtgtggagggctgggttcagacctggagagaggggaggttccaagatggtcaatcccagcaggccaggttgctgaggaaccatcagacagggagaatagcatgaaggtgatgatgctttttctggtggtaggggagtgaagggaggctggaagaaaactagttattttaaatttttaatttaattttattttaaatgtccgttttgaaaaggggataatctaatgagaagataggggtgtttttttcccttacaattaaaaaaactttaaaaagtggagtaaccacattgtagaagaaatgtggaaaaattctctcgcagttctaaacctgaattatttattaggtgtgattgcagtgtagttttttgagccttttaaaatttagcctatgtatgttttgccattttgctattcaggtgaccaaataatatttcatttagagagaataccattgtttaacattttagatttctttcaaaattttttataatgtaacacatctctttctatattataagtgtttcttttcgtggatttttgtctttagagtgccagaaatagggtaaataattttaaatttcagagtttttaagactcttggagcatattgctatacttaagcaagtttatactaaatttggtattatgtgaaatctccaatttcatgtaaactttgcatattgggtatgaacattacagttttagaaatttaattggtgaaaaatgctacctcattgttttagtaatcatttttttgattaatgaggttgattattctcatgtttttatttatagatttattaactgtttgaaaactttgtgtttttatatttgtttcctatatttagaccattttagagtggataagtgctattagcctccattaaaaaagtaagttagccaggtacagtggtgggagcctgtagacccagctacctggagactgaggctggaggattgcttgaggccaggagtttgaggttgcagtgagctgtgatcacaccactgcactccagcccagaccctgactcaaaaaaaaaaaaaagatgaagtcattttatctgtgtctatttgtttcaatagatacagactactagaaatcatgcccatcagtccaagtttctgtaaaaaattaggaagtccatagacctttcctgctgttactcattagaatgtcagaatgctctattaaatacttctgtatacctgaatataaatgtgcttaattggaactgctgataatggacctattgatttttgaacattaagccgtctgctgagtatacagaaattttaacagaacagtattatttaaaagtggttagagtgtgtgtgtttaaatcattggacactgatatacccagacaattaactgtgattttgtttttgtttttattgtttggaccaagtatattattttgcttatattttgactcacaattctgtaaattctgatttcagaactactttacattgacattaaaaaactgtagattaaataaatgtcatttaaaatgtaggtaaaattatcaaaaagttggttcaaaataataaaggcatttactttaaatatttattgaaccaataatatattagatgtcagctactagtgttctgtcatccttctctgtggcttgttggtaaatctaacggcagtgtttgcttctgcttatagaagttagtggagaggaagggaggggaggcacatggctggggctgggcaatttcctgtttgcagttccttccttttgtagtttgataggcaactcttttgtgatgttgcctgtaaatgggccagtcttttatctttgtaggcttgtatttttggtggctttgaaacagatcaggctccttaaactcatacagcattttcaatttcagactctttgagactggacattctgttagccttctgcatatgggtagagcagtgtcacctcttaacttttcttgcctgtttcatttagctgtgggcgaggaaaattagctgtttgcttttcattactggaagatttatcaagttaaggtgcatcaatcttttcagtttttttttctttttttcttttggcatcctgataataaacttcctttgtgttgtaaataagctctcaaatttatatacacatacacagctgcacacacaggcatacatactcactgcatttagtactatatatttagtagggatgcactgtgtatgcttacagtaatttactcacaaatttctgaatcttatcagtagctttggaataacatatactttctgtgtgaagaagctaacatccatttgtttcattttaggttggtgcaaaagtaattgcggtttttgctacttcaaacaatatatactgaattaaggggatgtacttttttttagcacttgaaattatttatttaccagtttattatctctccctttaagggaaaggactttgtcttattttccacaatagccccagtatctagaacaatgtctgacacatcctaagcgttcaataagtgtttgtgaaatgaatgactgtttaattgataaataagtcttggttgacttccacagttttgtggaagtttaatatggagtaatttaaaacctgtgatgtgcttaaagataaattatgaagtcggtactaattgtaaaaataacagcaagaatcagtgttgcaaagcattaactaattttcttaaagttactgagtaaaacaaagtgtgttatatagaactgaaatgggctttgttaatactgtacatacaaacatttgaaattaatattgtggataataatgttaattttactctcagcattgtttctgtttttctcaataggtgaaactacttatttatacatataagtatttgctactaagtgtcaacgatttttttaacagccatccttgcagtctcaggataatttccagttaagaattaattcatggggccggccacggtggctcatgcctgtaatcccagcactttgggaggccaaggtgggcggatcacctgaggtcgggagttcgagaccagcctgaccaacagggagaaaccccgtctgtactaaaaacacaaaattagccaggcatggtggcacatgcctgtaatctcagctactcaggaggctgaggcaggagaatcacttgaacccgggaggcggaggttgtggtgagccgagatcgcgccattgcactccagcctgggcaacaagagcagaactccattaaaaaaaaaaaagaagtaattcatatgcttgaaagaggaatactagaaaatttttaattagagttggatcttgaaaatttttagctgcatgcattcattatgaaaaaaaaaaaaatcggaaaggaggtactcaaagccctgaagacattatccattatcagagtgtgacttgaaattgtttgccgtgcctgatatgagagcatgttctgtacatgtctacctaggcttcacctggcatttacccgagtgaggactatcagtgttccattttatacaaatatctgaacagagcaggctcacatttagacgtattccccatgcagagctacaggcttccaatcaatgagatgtttactagaatatatacagaaactgaaggtaattctttaaattttttgaaaaatgaggttatttggctgcctggtaattgcagcatggtaaaatttgatattgaatgtatttgattgtgtttactgttttcttttagttttaaaaataaacatcttaattagaaaaaaaagacccacttttgcaagactggtgaagtatctccacagaacactcactaggaagaacccttctgcagtcctgctttgtcatatttcagttggagaatctgaacccagagaggtcgagtaccttgtccaagatcaaacccagctaatggagaaggactagaaccccgatccctaagtttctagctgggagctttatccagtcatatagcatgtcaccgagcactgctggtcttggtatattatactacatctaaaccataatagtctgcaaaaagattagaaacagcatgcagtgtggaagagtagaattttctatttagaaagcagtgttgtagtgtttcaaatacactagtcatacagtttcttttccaggtagcttctgagctttgattctggctaatggggctaacactgccaaaactttcgtgtaccaaccagggacaatggtggttgttctcatgtttactttggtgatgtccatggatgtgttggggtaggtctaagtgcaaggagtgatagggggataagagaagcaaggaatgatataaagtaggttgggctggtatcttaggacagagttttccaagctttattcactgtaattcaccataagaaacacattttacattgcagcctagtacacacacatacacacacgccattcacatgtataattgaaacaagaggttcatgaaacaattcttacaaggtgtaaagcatactgatattttatattctgttctattttatttaaaatatgtctttacccatcaaattgacttcactgctcactaatgggttgtaacctgcagactgcaaaacatagccattggagaatctacttactgtgcttagatccagaaggttcttgaatgttcttagggcattgatttttggcattgaatgagcaggtgattgtttgattgctctgcatctaggctagtttgcaattaacatgaatggcttaaggaaaactgaaagtattctgaagactgctctctctaaacatcaagatgcatacctgtctctggatggtttttattcagttggtacttgactttttgggaaaatctgagtttgttttaagccttcaaataatatgatttatcttttcttatctcactttcatttgaatcactgtgttacccttaaagccctctcatactcctcccttcttcctggcaaccaaaatgtgcattgattcagtttgggagaaccttgattgagaagcctgtagctaggtcaacgttgtgggccctgaggagccagcgctgagcctgccttactgggtctgtcattttagtatctcattgggcttagtttctaagtgtgggctgaaaagttatataatgtcccattcacctcaagacatcgaatcttaaaccttaggtttataagggttttcttgattgaataattttaatttatgtaaatttttatttcaagaaatgttttctatttgatagagtgagtaaaattgtggcctttcccctattttggaaagtgaataaattcattaaacccctcttcatgagcactttctgaaattttaaataaaagaagagctaaccgcttgcagtgagctgagatagcgccactgcactccagcctgggcaatagagctagactccgtctcaaaaaaaaaaaaagagctaactgcaactgctgttgagtttgctgtgtgttcagttatttctaagatttttagtgttcaaaatagggttgccatgctaaaaaacagactgtggccatgtaaactactaggttcccacgtcaccaacactctgtctctgtgtctttcttaattttcttccttgttgctcttctgccttagctttgcttttcctgtgcctatcttcccaaacccccgtaacaaatgcttgtaggggctttgaattttcattatggaaattcaaacttttaattgatgaggacttaaagccaggggtgtagttatacagcaaattcatgggtaataaaactaaatagtgggatggctggcgtggtgtctcacgcctgtaatcccagcactttgggaggctgaggcgggtggatcatgaggtcaggagatagagaccatcctggctaacatggtgaaaccccgtctctactaaaaatacaaaaaattagctgggcgtggtggaaggtgcctgtattcccagctactcgggaggctgaggcaggagaatcgcttgaacccgggaggcggagcttgcagtgagctgagattgagccactgcactccagcctgggcaacagagcgagactccgtctcaaaaaaacaaaacaaaacaaaacaaaacaaaacaaaaaactaaatagtaggactgggaaagtgtaacctcagcctcaaagaaatattttaggagggctgcagtacctcatagagttatttaataagaaataatatttgtggttcatagtttcaaattaatgagcagacagacaagcctttccatgtgaatatacatactgtaggatgaatcagacaattctttcaagagtgggtgtacgagtcatttagtgggcctgctttgggaaatttcttaatttaagaaaccataattcccttctctgataaacctttcctgatgttttctccctagtttttctgcctacccctcactctctgcctcccagctcttcactgtcattttcttactatctgacttagaacatggctcatttatagcttttcttacttcattttgcaattaattgcacataatatgatctactaggatgagctccttgtacttacttgctttgcacactcgcccttgtaagaatgagctttttgagtaaagggataactcttacatatttttttttcttcaacttttattaagttctggggtacatgtgcaggatgtgcaggtttgttacataggtaaatgtgtcccatggtggtttgctgcacagatcaacccatcacccaggtattaagcccatcattcattagctattcttcctgatgctcttcctcctctgaggcacagtgtgtgttgttcttcactatgcgttcatgtgtgttctcatcgtttagctcccacttatgagtgagaacatgcagtgtttggttttttgctcctgtgttactttgctgtggataacagcttctaactccatttatgtccctgcaaaggacatgatcttgtttctttttatagctgcatagtattccatggtgtatatgtaccacattttctttatccagtctattattgatgggcatttaggttgattccatgtctttgctattgtgaatagtgctgcagtgaacatacacgtgcatgcatctttgtaatagaatgatttttattcctttgggtatatacccagtaatgggattctgggtcaaacggtatttctgcctctaggtctttgaggaatcgccacactgtcttccacaatggttgaactaatttacactcctgccaagagtgtaaacatgtccatttttctccgcagtctcaccagcatctgttgttttttgactttttagtaatagccgttctcactggcatgagatggtatctcattgtggttttgatttgcatttctctaatgatcagtgatgttgagctttttttcatatgtttgttggccgcaaatatatcttcttttgagaagtgtctgttcatatcccctgctcacttttcaatggggttgtttggttttttcttgtaaatttgtttaagttccttacagactctggatattagacctttgtcagatagatagattgcaaacattttctcccattctataggttgtctgttcactctgatgatagtttcttttgctgtgcagaagctctttagttcaattagatcccatttgtcaattttttcttttgttgcaattgtttttggtattttcatcatgaagtctttgccccctgcctatgtcctgaatggtattacatagattttcttctgggtttttatagttttgggttttacatctgagtatttaatccatcattagttgatttttgtgtaaggtgtaaggaaggggtccagtttcaattttctgcttatggctagccagctctcccagcaccatttattaaaaaggctgttctggccaggcacgtttgcttatgcctgtaaccccagcattttgggaggcagaggtggatggatcacctgaggttgggagtttaagactagcctggccaagtggtaaaaccccgtctctactaaaaatacaaaaaaaattagccaggcttggtggtgggtgcctgtaatcctagcttctcaggaggctgaggcaggagaatcacctgaacccaggaggtggaggctgcagtgagctgagatcgtgccattggactccagcctgggcaacaagagcgaaactctgtctcaaataaaaaaaaaaaaaaaagaaaaaggcagtcctttctccattgcttgcttttttcaggtttgttgaagatcctatgtttgtaggtgggtggtcttatttctgagttctctattctctccattggtctttgtgtctgttcttgtaccagtaccatgttgtttggttactgtagccttgtagtacagtttgaggtcaggtagcgtgatgcctccagctttgttctttctgcttaggatcatcttggctattcaggctcttttttgattccatatgaattttaaaatagtttttttttctaattctataaagaatgtcagtggcagtttaatgggaatagcattgtatctataaatgacttcgggcagtatggccattttcacgatattgattcttcctgtgcgtgaacatggaatgtttctctgtttgtttgtatcctctttgatttctttgagcagtggtttgtagttctccttgaaaagatccttcacttcccttgttagctgtattgctaggtattttattctttgtgtgctaattgcgaattggagtttattcactgtttggttctctgcttgcctgttgttggggtataggaatgctagtgatttttgcacattgattttgtatcctgagactttgtggaagttgcttatcagcttaaaaagcttttgggctgagatgatggtgtctcctagatataggatcatgtcatctgcaaacaaagataatttgacttcttctcttcctatttgaataccctttatttctttctcttgtctgatggccttggcgagaacttccaatactatgttgaataggagtggtgtctcactcgtatttgtatctccagtacttaacatagtgtctgtctgtgctattttaaaaatttatatttatttttattttttaagttgacttcgtaattgtacatattcatgggatacatactgatgtttttttaaaatgtacatgtaatgcttttatttaaaaaaatcttttattttaggttcaggggtacatgtgcaggtttgttgtagaggtaaatttgtgtcataggggtatgttgtacagaatatttagtcacccaggtactaagcctagtacccaatagttattttttctgttcctctccctctgccagcctccatccccaagttggcccaagtgtttgttgttcccctctttgtgtccatgtgttctcatcgtttagttccagcttataagtgagaatatgcagtatttggttttctgttcctgcaatagtttgctaaggattatggcctccagctccatccatgttcctgcagaggacatgatcttattcttttcaatgactgcatagtattccatggtatatatgtaccacattttaaatatccattctaccattgatgggtatttaggttgattccgtgtctttgctattgtgaatagtgctgcagtgaatgcacatgtgcatgtgtctttatgacagaatgatttatattcctttaggtatatactcagtaatacgattgctgggttgaatggtatttctgtttttaggtctttgaggaatcaccacactgctttccacaatggttgaactaatttacactgccactaacagtgtataagtgttcccttttctctgcagcctcaccagcatctgttatattttttgactttttaataaaaaccactctgactggtgtgagatggtgtctcattgtggttttgatttacatttctctaatgatcagtgatactgagctttttttcttatgcttgttgactgcatgtatgtcgtcttttgaaaggtgtctgctcatgtcctttgcccacataatgaggttttgctacatgtgatatatagtgatcagaacggatccaggcaatcagcatatcaatcatctgacacatttataatttctttatgttggggacattcaatatcctccttctagctatttgaaaccatatattactgttaactgtagtcatcctacagtggtatggaacactagaacttaccctatctattaatagctataattttatatcctttaacaaatatctccttatcccctgtattagtcctttttcacactgttgataaagacatatctgagactgggcaatttacaaaagaaagaggcttaatggacttacagtttcacatgactggggaggcctcacaatcatggcagaaggtgaaaggcacgtctcacatggcggcagataagagaagagaacttgtgcagggaaactctcctttttaagaacatcagatctcatgagattcattcactatcacaaacatagcacgggaaagacctgccctcatgattcagacacctcccatcgggtccctcccataacatgtgggaattcaagatgagatttgggtggggacacagccaaaccatatcattccactcctggtccctcccaaatttcatgtcctcccatttcaaaaccaatcatgccttcccaacagtccctcagagtcttaactcatttcagcattaactcgaaagtccatagtccaaagtctcatctgagacaaggcaagtcccttccacctatgagcctataaagtcaatagcaagttagttacttcctagatacaatgggggtacaggcattgggtaagtacagccattccaagtggaataaatttgccaaaacaaaggggctacaggccccatgcaagttcaaaatacggcagagctgtcaaatcttaaagctccaaagtgatctcctttgattccatatctcacatccagtcctgcccttgactcctgtcaccaaggttgcagttgcaaggctttcaatttgaaatcaactgcttgttaaaacataggaatggacccatcctgttcaaagaatgtaggaatatgtgataactctcctaatagttatcagttcctaataggaactggagaatccttgaatctcatcagtttgaatgtggtaaagtatttatattcccttcaaaaatgtctgaaattttgagaaattcatcagtacttgcaagtgagttggagttttagcagcaagctatgtattttatccagagtcaaattttaagtttttagcctgggacctgggaaacatagtgaaaccttgtctgtataaaaaataaaaaagaattaaccaggtgtggtggtgcatatctgtagtctcagctacttgggaggctgaggcaagaggattgcttgatcccaaaactttgaggctgcaatgagctgtgattgtgctactgcactccagcctgggtgactgagtaagactctggctaaaaaaaaaaaagaaaaaaaaatttttattttagttttttttccccaagaaacatatctttgaaatgtaatgaaaatagtgacaaaatggggataacattttaaaagtttctaaaatcattttttttccaagacggagtcttgctctgttgcccaggctggtgtgcggtggcacaatctcagctcactgaaacctctgcctcccaggttcaagcgattctcctgcctcagcctcccgggtagctggattacaggtgtatgccaccacgcccagctaatttttgtattttagtagagacagggtttcaccatgttggccaggctggtctcacactcctgacctcgtgattgcctgcctcggcctcccaaagtgctgggattacaggcatgagccactgtgcccggccagatatataaatttttaacaaaacccaaaaacatttggaatatcctggcattgggctgtgtttaaaaagtatattagactttacacatgtgtactgatgaaaatattttacttctgaattaatagaggaaattaaagttgttaagatccttttattacaattaaaatttgggggatttaaccacgatggtgatcaccgaattctcgctattaattcaatttaaaaaatttttatctctctcctgctcctttttattaaggaacattggttgatctagacctcaggttaagtacaagaacttcaggatgagattggaggtctctgacttttactgtgttactctagcaatgcggagaataatttctcctctgaagaactgctctggtagagctgtatagtgatttttttttgttcagttataggaaccgatacatcttagagaagatctctccctgacctacctaaccagcccacccttctccactccccatcctcaccatactggtaaacctggataaattaacttgtcacaggaggcagaactgacaggcccaagagcctcctatattattggcattccagtcctttgcctctaccttcgcagccctcagcttacttcgacacccatagtgcaagggaacactgttgtgtgaataaccgcttacctcttttctcctctatcactctttcttgttgtctctgtgtacctttccctctccatttttgtttttgtttttcctactggttccatctctttctccttcctgtgttctgatcacttctctcctattgctttaaaaagttttttttcttcagacaagaatgaaaggaatctcctattggtttgtttttccttccttttcctcctttcttagttggctgtcggagttttttgggtgtgtgtaacagaaattgactctgacttactgaagcccaaaacttagtaatgaatttcctggaagtttagtcaaaagagggtagtagagggctgctgtggccttcccttctaataaaaactctttcttcattttaatgggaaatagtattttcctctctccttttgtgtgattcatttgttcattctttcattgaacaaacagtcattgagcacctgggccagacaccccttctgagctctaaggatatggtaatggacaagagagagaaaatccctgtcctgacagagcttagattttgctgggagaaacaaacaaataagaggtcagtgataatggcaagttggtgatgtgctggtgactggctggctacttcagattggaagttcagagatgccctctttggggtggtgatgctgataaagaggaagaacattctaggcagagaacaacacatacaaaggctttagagtgggaatgaactaggaaaggctgaggaaccaagacaaagctgctgtggctaaaaaggctataatgcaggcgatgaggccaaagtctctgctagggcttgtatgtgagagcaagttcgaattttattcttcgtgacctgtgggtctcttagggagctgaaatgacctgacgtacacttaaaaacactttaaaaactcaccttttagaatgtcacttgaagctctccatggtacagttatctgtatcgttccgatttctcttatgctactctgccataatgctctgattacttaacctttaaaggtttttgtgaggagtacttaaagtgggggatctcctgggattagatctgaaatgatatacaagggatatgccatgaggtcaggaacatacttgctttgttcttggtattatccatggtgcttggtactggtaagtctttgctgaatgaagaaatgaattacctggtgtgtagaactgtggaaagctctctgtttttctccttttccttcctccttcttcattttccttactaccaggaaacctgccattcaagtcttgttgctcataggaagatgggggtgagaaattgctggccagggtgaaggggggctgttttctggaagtagtgaggtctgcctacagtagtgagccagaataggagggaagttcccagttactgcagggaaggtgggtgaacttcctgtatgttttatatatatatatatatatatatatatatatatatatatatatctcttatatatatatattttatatatatatattttatatatatatatagtatgtatgcaatggatctgttgattgggtttaagttacttttatttaagctgtaattgtttcagttctgctgtttgtggaagttagtaagctaaagtatgtagggaacatgtttacttaaaaaaatctatgcacatttaagaacgattaattctgcagctacttgggaggctgaggcaggagaatcacttaaacccgggagatggaggttgcagtgagctgagatcgtgccactgcgctccagcctgggtgacaagagcgaaactgtcaaaaagaaaagaaaaaagaaaaaaggatgattaatttctgttatcttctcgaaggacaatactgtcatgtggcacatgtttgaacagttggggctaatgcacagaaaaattgccacagaatcttttctgcaaacacctgactgatgggcaaaactcttgtttctcctgctttctctaagcaacaactcttgtaaatactggaagagaacaaccagttccttgtttgtgtgcattgttagttttctattcttcagtgagttcaaagaacagtagcttacaagttactatgattctagacctgagatttagttcacatgctttgtggcttttgtgttagaagtttggataacatctcacctgtaaacttcctgaaatttgaaaaagaataaaatgactatatatgaaaaggcttcttaaaattttaattttaaaaacaattctatgtacagttccttaagtatatactctagttactaaaataaatacattgggttgctggtctaccaccttctctcttcgaggagatcacagactgcctaaagttgccataagtacatgggaagcaacccccacaagtttggttccatccctggcaagtttggtaggcttcctcctgttattcccagaaagtttatgatctttcttgttcacttttctcctcaattactttccttccagtgacagcaagaaaatttcctctcatatttgccctgctttccactgcctcagatttgaaatcagctgtaatcacaatgccaaatactgaggaaagttatgcattttgaagcagaattgtatataattaagtaccaatcaaaacattagaaataattcagggttcactttaaagccattatagatgtattccttgatttcttcaagtttttctaatttagctttccctcaagtattagcattgagggaagataattaacttaagaaactaacacacttacttaattattttagttttaattttgaaaatagtgtcttctactacattttattttagatatatgattttaatgataatagtgaatatattatcatgtttggactagcttaggaaacttaaaatcctaagattttgtctttgggaaaatatttccagaagtcaaaatattatccttggcaaggcacaatggctcatgcctgtaatcccaacactttggaaggccaaggcggtaggattgcctgagcccaggagttcgagaccagcgtgggcaacatagtagaccccatctctactttaaacaacaacaacagaaaacaaaacaaaacaaaaaaccgcatattatcttttacagataaatgtttggagtataatgtatttgcaatttaaagactttctataattgctaacaggtgttaagaggatttaaacatccagtcctggtctgttacagtggatctgcatcaccatcttcattacaaagttatggttccttgccttgtaaacttgatccaattcagtcctgggtttaaataacatacttttttttcattttctttcttcatttggaaagttttatgaaatgaagctcatgatatacccagaagtaagcagtgaaactcagcaccaggagtttttaacatgaaaccattcagtttgggagtatgtattattcaagtgatattctggagtgagtctgtttttgcgttttatataaggactaccttttgatgatgaatgataaatgttctacagggttatatttagctgcatgttgtaacataacagtattttgctcagcttgcgtaagactaagggactgaggttattttggggcgacacattttctcctttcccccattaacgtgtccttttaggtttctgtgtgttaagaacattggcttggtgtttcctttgtttgctttataaggggttggactagtttactgtcacacaaccagctcagtgaggtctatgctggtacatgaactcacctcaggcagaagagaagcattgtgtcactgagacaatgctagcaagagatgtgcatttgtgctggctgtagctgtcagttctggaaggatatctttttaggctgattatgaaaattctggttgtaatcaaattagatgggaagacacacatggctaatattgtctgccattctccctaaattgcccatcaaaaagctcccactggtttcactctaattatacccatgagaggggtgagagagtatttctattctaaacgaattgtcaaataaataaagtctgctgtttgttgactgtatgttaaatcccagcttcaaattaaactgtaaagagatgtcacatgagggtatttcagagcaaacagcacctcaaacaaaaaacatactcatttctagacctcattctcatgaggattcaaatactgaaaattgttaagtatttttagggtagaaataagtgatgtctatagagacctgatgtcaggttctgcttaacttctatgattagccttgcctccatatttgttaagcaggtatattgtcttatgctttgctgacttcataatctgtgatttataatggactcaaaacttgaagaacaggaagaatgactttattttacaacatgttcaaccaaagactgtaggaaacaaaagacattcattcttactctgttttaattagactatttagcatgatagatttaaaatagactgaatataatacaagttttaaatacagttgtgtttctgatttgtaatcagactgactttcctaattcatatgtgattaacattgaatatttctatttccacaagcaattagaacaaagtggaattgtttatgcatttgagaaatgtataactttttcctatttttaaaaaattataaagttgaatgtagatattgttttctgagtcactggatataatgggaggaaatgattaagaaaataatgttgctaaaaataacaaaattaaacaatttgtttgtgtttgtgtatcacaattaatgctgtctttaggaaaaaacagtttataaattaagtgccctgacatttaagaagtctgagaaccaagttttgggagccaaggaagagactttaaaagttttatgtttcagctttttgcagagttttttgccttgcagtgcatttttatgatggacttctgtttctatgctggacttcttttcatggacttgtgtggttcattctttgcaggtaactggtgagtgctttcctttcctaaaaacaaatccaacttgggaatctaattcttttgttcatgagacattcaaatagaaaaaatgaatacagtgctagtaacagtaactcgcttcttatttcatgtactttgttgcagaaagacatggcccacctcagggatcttctgatattttgataatgggtttggtaaagcagggaccagtggcatttattttatggatgttgatactaaggcatcaggagactagggaggctgtttaaagaggcagaactgagagtaggatcaacatctgtactctataatcagagggttgaactaaatcatggtcttattagggacatttacaacctcatattctgatgtttgtatacatagacgggctttagggtgaaggtgtgagaaataataacagtgtgggtccagattcacccagagacagatggtggaaaggaaaaaaaacattttgggaccaaagtttatctcctttttgttgtcccttgctgtagaagagctatgtgctagatataattttgagcactttacatacattattaattcatttattcttcccgacaaacaaccttatgtgatagttacaattattatcctcagtttatacctaaggcaatggaagcatagagggttagtttcatgccactaatggggaaagaacctgtgtctatgtcatgcttcccctcgtataaaacgcccactatttgtgcaatcgtccatcattttttgagtgtgtgctacatgccaggcatagtgttgagtcctgcagataaaaaagagatggaaaccttgctgtcattagtcttacagcctacttggggagacaggctcaatcaaataaccacagaaacaaactggtatacgaatttgaaggagaaggcagagagctttgagaacataaggcaggggcctgatcttattgggttgccaaaaagactgtctcactttagagctgtgatcccaaggaaacggaggaggtggcatctaaacactgcgatgatgcaaggtaggctcaggttgagtctggtcacttcataggccattcccagccccctttagagtccttgaagtcagtgtctttaagctccataatggagatttcagactatctctgtgccctcgtatatgtgcaggttcctgtgcaaattgtaagcgttaagtaaatatatatgctgattgaattacagtcatctgtggtgatttgtgctctgttccacctcctgctggctgcgttgtatcccatgttggaagtggctgagtgtggcttcagaatagacacagaggaagtgggagagtgaatatttggatgagggagtatgccttgactaaatactttctataagcaaatacaaatcatatgacctagagcttttattttttaaaatcagtctattgctttctcttgaagcacatcattggtgaattgactctatttggcttgatgctttcatacaactgggctgagaaagttcattttacccctcttttgggcattcccactatagttgtagtgatatagtcttttaaaatctcattcaccaattattaattaagctgaattaacccttttgggtagatgcattcttatccttatatgtttaaagtagctgttcattaaacataggttttttgctgagcatctatctgacaggaggcatctgaaggtttataaaggtatgggaagcttggttacttgagctccagaagctttccactttagtctaaaggaaactaattacaaaagagctgtgaggggcccatcaggatgtgcttatgagtttctatgagggagccagactgactgtgtgaccttgagcaactaattctcagtgcttttcctgtaaaatgaaaatgggaataataatggaacctaactcggggtgatgtgaggattaatgaaccaagttatgtacaatgcctagaagagtgcctggcacatggtatatactgttaactttttgtttttattgttgtcattattgtgatcattatcacctatagttgagtgtcatattctggagtctaaagggtaagggaaaaggttctgagttggagaagaaaggcatcatgggacatagtatttgagtttaggtctaatgaaatataggtctaataggtagaaatggtgaggaaagtattccagaaaaacaacaacaacctcaaataccagagatatcaggtatgtttagggaagggtgaggagtccaggctagcgggtagggttcatttgaggaaaaatgacaaatttacctgaaaaggcaggctgggacgatatcttggtgaagggttggcagtctggactgggctttttgagcagggttgagactttccgagccctgctctggaactactggagtaggcaggaggtggaggcagagagaaatggtgttagtcctagagtacggtgataagggtttggataagggtttgaaataacgtgatgatgattgtcatggaagaaaggtccaggtagttcactgcggaactaatgaaatttaagactcagggccttttcttgcttagttccgtctctcaagctgttgaagggaaaattttttgtaaaatatgaaaagatgtttgtatcctccgtctttgctccccaaatgatgtgtttcaggctcccaaacctggatctaccccataattgaaagagactgtggatggccaggagtggtagctcacgcctgtaatcccagcactttgggaggctgaggcgggtggatcacttgaagccaggagtttgagaccagcctggccaacatggtgaaggcctgtctctacgaaaaatacaaaaaagtagctgaatgtggtggtgtgtacctgtagtcctagctacttgggaggctgaggtgggaggatggcttgagccttgggggtggaggttgtagtgagctgagattgtgccactgcactccagcctgtgtgacagagccagaacctgtctaaaataaaataaataaaaagagagagactgactgtgactgtgaagagataatcagtctgggtattgacttgatgtggctatcacgtgatggagaggccaaggtcaaagatgacttttgagattctgggtctggctgactgggaggaacccctcatgagaaagggggatgttgggagcagccagttagggtgcggtagtttcaagccaagtgagtgctctgcactggttagcttcaccagtaaaagaaacattttcttcttatatctgcccacccccatcctcaattgcagttttgcaagcatgataattgtaagttacacagtgctaaggaaaggactcagcatttctgctgattaatgggcttcagcccaaagcacacatcatagtgatgtctttgtaatgtccacagttagtattctgtgtattctaaacctagttgtctgaaacttgtaaatggagtctctccttttttggcataagtcttccacatttggtaaatcatagtgctttaagactattttaaagttgtaacatcagttttctggaaattgtattttgaaggaatttaattgactaagacatggttgaaatgttaatttcaaagctatcgtgccaatgttccagtggcagcacctacctgggaaaggctattgtcagcatttgtttcctctttttcacacaagtaaaatattaaacaaataaaattgaagaatactctttcagatggccaaattgaatcctcaagagtattttcactttccaagtcacaaaatataaatataattaatgtaggggcacagatttcacttttaaatatatatatatatacatatatatatacatatatacacacacacacacacacacacacacacacacatatatatatatatatatagtgtgtatgtgtgtgtgtgttatgctttgctgaaaaggtttttttttttttttttttttttttggaggaaaaatagcacctaaaaacaaagctaaaaacatagtaaagtttgaggcaaatgtccccagagaaagatcattagcaaattcatgacccagagtctggttgagacttctctatgaagccatttattgttttaagaatctccccttgtgtatcagagaggttgaattatctgagtagagaaatacagttgtaaattccaaaatgcttcagaaattcacatattattttggagcaggtattaaggatttaatgactgcaggatttagtttaaaaaaatgatttagaagtatttgcagatgaattctaagaggattctatataacttctcatgttggtctggtgttcctctataaaattagtacagacttgatatttgttacattgtttctcacggtgtagtaaacacaaatatttaaaattataagagttatgcattttaatattcatttatgtatagactcagtggcgggttttcccatttatagcaatgatataaaacattttacatcaaattgatttaagtcaaaagtaaatgtgtgtttaaaaagaatgaatggtagtacatggtggtacctacggcagaagttgggaaagtgcatgattaactaatgggcaacattggcttactggtaaacaatataaattgtgctggtttgtagtagggtaaattttattacgctgtttaataaaacctcatagctgttgataatatatatgttaagatactggctctttaagaagcttttattaaagaaactaaaagttatttaagttcttggtacctggaagttaattaaacagaaaaaagtcactttaattgggtgactcctgctcagttaaaaataaaagtatatgttaaatgctatattattaatatggtttctaggacttcttggcaaaagtagggcaattttatcaaagtcgtgcatgtaccacccactaaaatgatgtggtacaccaaacattatctgtgcaaatgcttttgttaagttgtattagtcaaaagtttggggaaagttctggtttgggtttatatatgttaatacctagcgagaaaagtagacagcatattctttctttccccttaggagcacaagagaaaaaatcaagatatttagaagatgctttgaaattaatttcattcagaaaatatttttatgattctgctgagagaaggcaaaaatatttttagaaatattagaatatctggcaacaaattttcgagcattaaatatggattttatttttagaaagagtacacatttgacattgcataactaatttacttacttcacatttaaaaaacagatttgtgtatgtctgtgaaaaagacaatgtgttgatagtagaactataaggtagaaagttcctctttctccttctgatccttcccctgcccttttcctcaaatgtgactacaaactgttaacagtttgaagtcccctaagttttaaaatcaaatggaatgaaatggcatttaggaacttggaagagtggaaaccttttttccagacctatgctaccaactgagtttatattttcaggcagatatgatgaaattgctgtgggctttggagtcagcccactgttcgaattctgttttcatcctagagcaacaacgcgagtttggaaagttccttacctttcttactaaatgtcacttttcttctgagctttaatctagcctagtctgtctctctcctctctctctttttaataagcagacatgtctaagaagatctggcataagaatatgtgacatattttgtcctggaaaaatcgaatttggtattttaatgacccagcatgcattcatgcagtaatgcactcactcatcaggagaacatttccccactttgcccaaatacctaccttcaggttgtgaaaggtcaacctgtaaaagatgccccaggaatcttcctggaatttagatggcctctgttgggtttcactttgcacttattaataattgagcactgggataaaaataaaaacaaagggtctcatcttgcagtgtgagaacatgggccatgtgtgctaagtcatgcaggtaagatgaggagcaaagccctgtggggtagccaatctaaagaagcattccatgtgggctggtgcctccctcttgcagaatgactccctccaaattaaagggaattaacgtaattgctcctggggaggaaaatgcatttttgcttttcaaaggttgttgtctaagctttaattatctaatccacacacagaagctttctacaagcagccctcccttttagcaaccagtcacctttcaaatactgcggcatctttaggcttaagaaatcactgcattataaccaattctgttatataacctaccccttagggtacagtaaaacctgttgtaatgttggttactgaaaatggtctttagagctagtgttggtttaaatggagttttgtaattatttgagctgcaactagagtgacaattctccatttttagaatctgtgcctcttgtctggcagcacttttagttatttcctttctattgctttttgtttcacactcaataagctttggttggtgtgtgctttatcagaccttcatgtttacttgccaaatgaatatggggttttgttactaaagttagtatttttaatctatttattttatttttctttctttagaaaactcagaatggactcgttttctagtcctgaaatattaataagtaaacatgtaatatattcctagtgaaatagcttaaagctcaaagaaggtctgtaagtagaggaaaaccctactgttaagaaccaagactctgccattcttgtcattgaaatgcatagggttttgatgttgggacatactaaggaaatagtgccactaattttaggtagagaagattgtaggaattaagctcgtttctgactatagaggaaaaggaccaagaccatcggctcagaattaaaaaattaaattgctcttggaataaaattgagctctcccagtggtttgtattgctcttcacattccggccactgcctggctttctcccgccccctgtcctcttctctcagtcctagccacactgacctccttttcctccaacttaccaagctctttcccacctcagggaacttgtctttgtcattctcatgcctggatagccattcctccttccccttagctcttcctgtggttctccccatctagagtctagatcttaccctgaacatcacccagagacccctccctgactaccttgactcaggtagctgctttccaggcccctgtttatttacttttcagcatttaccttagactgtatttatttttgttgattattgtctttgccccacaagcataaattctattaagggaggtgccagtacctgatacagtgcctggcatatactatatactcagtatctatgtatattacctgggagttgttcactggttttaaggaatccttttttgtttgtgtctttaagattagttcatcttgtcagactagagggatttaagtagctttggtatcaaaatccaagataatatgttttccaatactcttacccatacacattttcacccattttattgtgattttattgagtgtctagagagcaacactggctttcctcaagagtaggctgaaaattcagtagataccccatggatattgtgctcactgtgagaagtctttcaaaatttaccaggcactgaaataactcacctcaggtcttcgatgaaggtcagggaggtgtgcgttggtctttggtgagcacacggtatattatgagggtacaactgtcgctgccattgtgtctgttcagtgtgcctttgtaaagagcctgggatggcctcttcatggatctgccctctgtctctaagcttacccatggagaagacaaaggctgctgcgcagcttcatgctgaaaaggaaatgttggcaagttgttgctttgtaaagatcaacactatcaccgtaacagctgtcactcaaagtggaggaagtgaaatgcaaatttggtgagtaattagttttgtgtcattcttgggtgttctaaatgttactatttatctgtcttaggtaatctatttaaagaagacaccagaagaagcctacagagcactcctgtctggctcaaaccccccctatcttccattcaggtataactcctggtgagacttgggttaaacttttgctacagagctggacactttagagttgggttgtagtgttttttaattgtcttaagataataaccattatgttatatggaatgaaatgagatggtagtttttattatttcatttcgtagagttttatccccctagctagcaagaataaaagagctttcttcttgtaggaatttatttttttctttgaatcctttctatatctttacagtttatgtcaagcacaaaaagtgcctcatttataagctaataatcatgtcaagatttgttggatttcagtaatctacatcattgattcatccattcattctttcatttcataagcagtgattgagctctggtcacatgtcagaggccggggatatagaataagaccctctaagattcttcaggagcacctgtttagtggggaccctaaatcaccagtttggcacacaaatctgactggcatccccaggaagcctttctctcattactgtgttttctaagtatcatcaaaagaagatcttttaaaaatttggggtgaacttgagctcatttaaaaagtagaaggggactgggtgcagtagctcatggctgtaatcccagcactttgggaggctgaggctggtggatagcttgagcccaggagttcgagaccagcctgggcaacatggtgaaaccccgtctctactaaaaatacaaaagttagccaggcatagtggtatgtgcttgtagtcccagctacttgagaggctgaagtgggaggatcgcttgagcctgggaggtcaaggctgcagtaagctgagatcgccccactacactccagcgtgggtgacagagtgataccgtttctcaaataaataaatacatacatacatacagtagaagggaccatacatcaaaactcccataacacttacctctgctagaattgtgaatgattctaatatttttgccttttttgcttgtgtgtccaaatctgcaagcatgtgtattgcttattgcttattattattaccataattaaccaacacaatgagcgaaaggaatgggagtgactgagaagactctgcttgtctgtcttcctcattctgctgtaaactctcagagggcaggccccagtgccttatacttaaaagcacttttagtgaatatttgaatgaatacattaagactaaatcccttaagagtcaagggattctcattctgcttctgagatcacaggaggtagctgttagggtaagacatggggagggaagaagcaacacctattgtgcttaattaaagtgaagtcaaggagtaaggcattgggatttggaccctgaggggaaaatattctgaatcaacctagagtctgaggtaatcagccgtggaagggcaaataaaaaatggcagataatgtagatgaaagttttaatggtgaagacaaagcttatttttccttccacttctaatggctcctatactttgaaagtcctttgtaaaatataatcctattttttcagaaaggggtaataatgctgataattctaagttctaagcaaagtggttaggagtatatactttggaggcagagaaacttcaagcagtttgaagcctcattctgcttcttgctgtctgtagtaaataagtatctcggacaaattacttatcctctctcagccacagtttccttatctgtaaaatggcttcaggtctaaactaaggatcaaatgaagtaataaatttatccttctgcctagtgcaatgtttggtttttgtttttcttgttgttagcattatactattattactgttagtaacataattaatagtagtagtaattattattacagggtcttactctgtcgcccaggctggagtgcagtggcacactgcaacctctgcctcctgggttcaagagaatctcctgcttcagccccctgaatagctggaattggaggcccccaccaccatgcctggctaatttttgtatttttagtagagatggacttttgccatgtctgccaagctgctcttgaacccctggcttcaagtgatccacttgcatcagcctcccaaagtgctgggataaaggtgtgagccactgcacccagtcaagaactagaattttaaaataataataccagaatagaagaaaagatagtaagataattaatactacttaacatagaattgatttcaattctacataaatactaaatttatagcctatttttcaaatatttttcactcaaatacttttatgtaaatatttgaaaatataaatacattaacatagttcagaaatttaaaaaatctatataggaaggtttaagtgaaaattatccctcccatccttgatcctcatctgtctagtcctttccaggtaacttctggtattagttgatttgatatcagtctagaatttctttatgcacgtataagtaaatgaagatatgcacccatttcctactaaaagtatgcctttgaatgtaactctaagttctatctttttgatatcttaggataccaagagttgtatttacattaagcttcatttctaaatctagaatcttcataaaccatacatttgaaacagaaaataccacaaagtagtacatttataatttagtgaagaatttagttgaaagaatactactagttttctggaaacttaatttttttattatgctaagataagatgtgagttgtttttagtctacagttcaggccaactaagactaatggacttctatcaagaatcatcctcatactaaattctgggcagccatcattgcgttggccttcattataatctgggttttattatcaccaggtttaaaaaaaaatcccatttcttatgaaattacacttttgtcttcattgtctagattttttcaactgctgatatattaacacttttaattaaaaatgagaagccttaaaggaatttctatttggatgtaattgttttattatttaaaattttttaaaaatgaagatgattttgaaggcttgttgaaggtgtggttggtatgttcatatacacttttcactgaaatgtctgtgttcccatttgtgctatatattttagtttctttctaataaaagagttttatggctactgtgaatttaaataatgctgtttttcaaatttttttcactttgcaaacatttatctgagcagtcacttctgtaaagccttcctcatttttctggagaggcttggcaggtcctttgcctgtgattccctattacattttatgtattacaaggctacatacaacgttaaagcaaacaccttgtattataattatttgtttgcatggctgactcttctcttgagggctgtggttggttcttttcctattgtgtcctgagggagcaagtatactaaaatatatttattgctttttcagtgccagtcactgtgatagtcctatggatcaaaagatgtttaggacaacttggtacctgctgcaggagagctcagtgtatagtctgtatacatgtataggtgtgtaaaacagttacagtgctttgttagaattaggagagaggtgttatgggaatactgaggaaggaggtttaactctgaaatgggggggtaggagaagatgttaggaataggccccatggaatgcctttcatgttaggatgaaaactggagaacagcaattcaggcactgattttaggtgctaattttatttattcgtatggcataggttgtataatggtatgttaggtagtatatataatacgaagttcacagtatgggtacattattataaccaaaagaatgatctgattttattcctacttagattctattcacctagttaaaattaacaaaaaacgagaattgtgtagctttaactgcctattcttgattaaattaagtatagttgactttagagatagttgaatttctggcttgtgtgacagcagtgagtgttgtgatgtcacttgtgagtcagtctcaggatgttctgttgaattggagggtaggtgtgtcaaaaactgtattcacttttactgagaatagccaatgtgttgattaagagtgactttaggtgaaaatcaggggaaaggggtgtttttcatctaccttaattctttgagtcatccattttcagtgttggcttggcagttagccttcaagggaacaagaggcctttcagttctggggtcagactcagcagagtttgaattgacaaactaggtatgaatctttttaggttctcttcctttcagtgtactactaaattatagtgtatactattgagcaaacaaagtcgtattaatctcagcttgtctaaaaccccaggagaccagtgacccttagtggaatgtccagattgttttcatggcagtcagtggcagtggttttcaaatctacattgttggtgctcacaaaacagtatttgtgaaaatttaaagtcccgcaaaacattgaaaagataaccaatctaaattgtacaattcttatttaagatgtctcttgtgcttttaaattcattttatacttatttctttgtttattggtccatatgtatcaggttggtacgttttttagtattggtgataattcctaaatctcctaaaagccagtttttaaaatgacatataggccgggcgcggtggctcacgcctgtaatcccagtactttgggaggtgggcgatcacttgaggtcaggagttcgagaccagcctggccaacaaagtgaaaccctgtctctactaaaaatacaaaaaaaagtagccagccatggtggcatgtgcctgtagtcccagctactcgggaggctgaggcaggagaattgattgaacctgggaggcagaggttgtggtgagccaagatcgcgccactgcactccagcctgggcaacagaacaagactccatctcaaaaaataaataaataaataaataataaataaataaataaataaataaatataaaataaaatgacatatacaattaaacagggaataaaattatgctgacaataaataacatccagggatctagttctgaagacatatccagagagcatggcatgaaaaataatgactaagtctggaggtaaggttaggtagggtaatgtgctgacagtaatggaataaagctgtgaacattcgatgtcttatccctttagttttttcctaaagcttggagaagaggctagaatttacaggtgtttctcaaagttatgttgatcctcaaacttatctgcatacgtggggagctttaaaaaactactgatccctagattctgtgcccagaaattttgctgtaattggtcaagggtgaagtcagagttattgggattttgaaaaactgcatatatgatgccaatatgtgtggtcaaggttgagaactcctgctctgtaagatgtaccatggcaaaatatatatatatatatcaagtatatttatatatatattatatatatatcaagtatatttatatatatattatatatatatcaagtgtgtatatatatatatcaagtaaatttaaaactctccatcttggagatttacaaagcaaatttctgttttaaagattctgaatggttctgagtaatgaagtaacctgtttagctctgtataacccagaattttctttcttctttttgtttttttgagatggaggtttcactttgttgcccagggtgggcttgaactcttgggctcaaatcctgtgtagttgggatcacaggcatgcaccactgcatctggcccagaattttacaaagtactgattttcttcctcctgccccatactttccattaatatccagcagaactcctgttctgaaacactctgaggcatatttcctgatccacacctgtgtggaacaaaaaacatctcttgggattaaaataatatgctagcattttgtggaacattttttttatgctgtttcctgagagtcttggaaatagatggcttatcaaatcatggtattttatttaatgtgaacaggaatatccaagttttcttgctgttgtgaggccagacaatcttctctaacagaggattcacacccctcccactggcaatccttttatgacatctgtcattaaaatggatgcataatgtttgtgttgagggaggtgtttgttgtgttttgggggatgacccttagtgatatcccagttgctgagctctgtggctgagtcttaatgggaaatctcaaaagtaattattttagatcttctgggcatgccagaacttgtaggtctttaaacaaaggctcaaaagggtcaaccactgtaggtctttaaacaaaggctcaaaaagttggtcaaccacttaggacttggcatcaggctgccttctttttcataaagtaaacatgtgctggtagacgttagatgtaatcataaaatatatttccttacataaaacattgaaccagatttttattagcttaaatatgatattgtgatttttgtcgaagtttgtttagcaattaactgtacttcaaagggaaagttctccttaccgtgctttcctcttgagtatcaaaactgtggaaacaatattttatcctcttttaagatgttcctttcattctcaacttttcctcgctgtttctcagtcttgatctttggggtcatttctgccccatggatctttagtaaacttttgcttttggtgcttggtataatggaagctaattcgcgttagttttgactagtggggatgtgccaatttcctgagtgttgaaaatagatggcttttccagtccaaactgttgaatccattcttaacagctggggcatattttgaataagtgtacccccatgaaaaaagactctttgtcagagttttcttgttaaagtgctaagtaagctccgctatacaggacctgagaagagaaacaagtgtaagtgtctccatgacccattaagaactcacatggaggtgagttatattattctattttttgtctgctggaacaagaaggtgctttggtgatttgtgttgcgaaaattcgctcagactactttttttttttttattcctacctttagggttccagatcagttttaccaaacttagtgaagtagggtaggtgccaaagtttttgtactctttacggtatatttccagtagccttagttgataaatatggttttgaataagattgcagtcatttaccttaatgaacatagtaatagttattattttgttgaatgttatgaaaagctcttaaatacctgagttaaaaccaatttgccattatttttatttttaaagaaaaattgttggccgtgtgggtggctcattcctgtaatcccagtgctttaggaggccgaggcaagaggatcacttgaacccatgagttagagaccagtgtgagtaacatagtaagacctggtctctacaaaaaaaaaataaaaataaaaattagtcaggggtagtggcacacatctgtagtcctagttgcctgggaggtttaggtgggaggattgcttgagcccagcagtttgaggctgcagtgagttatgatcgtgctgctgtgacagaatgagtccctgtctctgaaattaaaaaaaaaaaaagaatagaaaaattactggttaaatgggtgtcagtcagatgttgatgaaatgcccagagtacaggtcttggtctgtttttctggtgttattgctagttctagacagattttattctgctgatttcaggtgaccttttaagccatgactttagaattgaattttcatgtatctctgtttctttagatgagtaaaatgattcctgtatagccttatgttaaatctgaaaagctgagattctgtttttttgttgttgttgttgttaggtacaggtcacgttcaactttgggccctgcctcctgaggcatgtggttttgctctttcatgaatgggagatggttttgtcctccctactaattctcaatacagtttcgtcttgtaggtctcaatgatataagctctttcttttattgtagctggtacatatatgtcatagatttgttcagaggctggaaactaggatgtactttggacaactgtgtaaagtattttgggcattgtctagctctgaagtatacggacaatatagtctgcagctgaactgtccagtatgttagctagtagctacatgtgttattgaacacttgaaatcagtctagtccaaactgagatagactgtacatttaaaatacatattggatttcaaagatgtagtataaaaggcggggtgtggtgactcacagctgtaatcccaggctgaggccaggagtttgagatcagcctggacaacatagtgagaccctgtctctcaaaataaaaagatttaatataaaagaaaaatgtaagatatcttatttataattatgttcattaatgctgaaatgagaatattctagatatattggatgagcaaaatacactactaaaatttacttttttcttgttagtttattttaatatggttataaaaaattaaaattatacatgaggctctcttttgaggatggcattatatttccattggacagtgatgatctagagtgtttttgctattgtacatagctcataattaaagattgttctatatactttctcctttatttatttgttttcagaaatagagtctcactctgttagcaggctggggtgcagtggccaaattgtagctcactgcagtcttgaactcctgaattcaaacaattctcctgcctcagccttctaggtagcttgctaccactcctgtctaattaaattttttttttttttaaatagagaaggggtctccctctattgtccaggctagtctcaaactactgggctcaagcaatcctcctgccttggcctctcaaagggatcacaggtgtgagccatcatgcctggacacatttttgcttcaaaaggtcaatagttcttagccaccagaggtgttcaggcataagttgaatgaactcttggtaatgatcatttattcattcctgtattaattcatttagcaacatctataacatactaattttcccaacactgtactatactctgggccaatagacataaaagacacgtttcccgtccttaagaagctcatcttcttgtggaggttgtgaagaggggattcagttcagtgcttataagggttcttagatgacctttatgatcctttccaacccattgctctgcaatttttgcatacctcctaactacttgttacccagagaatttagagaatcaaggacttaagataattgtagatcacagtcatttccaaaatttcttagtctcttttctatcagctctttttgtattttttaatgtagtctccacattgtagacactgtgcttctgttctccattctttcttcttcgagtaacttcattattcataataagaaatgctttcttattttgtgtaaatatgttctttcatctctggtttcatctcccattattaatatttataaggttgcttcattctgagtgatttcttagattctcaggttacaagcagtggtatgttggtaaactggctctataagtaaaaagtatttgctgatttccatggtacaaatacttttaccactgctgatttgggctctcaaaatttctgaatatttaacagttcactcttgagagcctatataagacagtgctgggacaccagtgaaacaagctctttaacatttaattgtggatgttgattctagttttcttaaacttaatttttttcctgctgtttttctgcaaaataaacactaaacacaaaataaacaacaagtcccaattgctccttctatttaaatattattcatttagtttttcattcaagaactatttattgactgcaaattcttcctatggtcatagttgtggatttttataaccactgtataatagctgtatagttcagttgactagtatgccagaagtcacatttagaaagatagaattgtggccaggcgtggtggtttgaaggttgaggagggtaagtgggaagatgagggtgagagggaagaacatgtgacttgcagatgtgcaggttctgtaggaagagcccagtggctactggggagctcagggaagatggggccagatacccccaggccttgtggccacagtgaagatttgaactttcccttgagagcaatgggaagtcagtgaggggttatagctgaagagtgatcagattagatttgccttttaaaaatatcactctggcttcagtgaagaaaaccattaaaaagttttaagagtgggtgtaggaaggcagtggcaatggaattggcaagtgatgcattcaagagatatttaagaggtgaaaccaatggtgcatagtgagggataggataaggggaaagaaaggtgagacttctggcctgtagcttgagtgactgtgggagcttttacccagacagggagcgctgcaagactggattatcgttgcagttgtttttttttggagtgggagcagattcaagagattcttcttacatagtgagtttgaggcatctttaagacacccgaacggaaatgccatgtaggtggttggctgtactatttttgaagctttaagaaggagtttgtgctagagagatttgagggtcattggcagatagatggtaatttatggagatgtctagggcagtgattctcaaaatacatgcctttctagcggcagcctcagctccacctggaaacttgttagaaatgcaaattctcaggccctgcctttggcctactgaattagaaacttgaggtggggcccagcagcctgtgtctgtggaactatccgggtgatgccaatacacactaaagttttagaggccctggtctagagagagagagtatggagtgagaagaattttggtctagagttgaaccttgagaaggtttgacttttaaagactgggaagtgaaggatgactttgcaaaggaggttggaagtagtgtttagagggtagaaggaaaatccaggaaccaagagaagagagcaaagtagggagttacttgttgctgacatattaggctaagatgatgcatgcacaatgttctctgggtttaaaataagtaaatccagacagacagaaaataaattagtggattgccaggggctggaggaaggagaatggggagtgactgcaaatgagtccaaagtttctttttggggtagtaaaaatattttggaattactggtgatggttgtacaacattatgaatacaccaaaccccactgaattgtacactttaaaaaggaagatgagactgggcgcggtggctcacgcctgtaatcccagcactttgggaggccgaggtgggcggatcgcctgaggtcaggagttcgagaccagcctggctgacatggtaaaaccctgtctctacgaaaaatacaaaaattagccaggcatggtggcaggcgcctgtaatcccagctacccgggagggtgaggcaatcgcttgaacccgggaggcagaggttgcagtgagccaagattgtgccagtgcgctccagcctgggctacaagagtgagacttcgtctaaaaaaaaaaaaaaaaaaaaaaaggaaaaggagtaattctttagagaaatcttgttttagagaggagtccaaaccgggtggaagctgaaggaagatgtggagcttggaaaattttggttggcttgttctttttggagctagtagggacctgaaaatgtttaaattctgttggaaaggatccagaagagagataaagagatgaccaatggtgttgtatggtggtaaaacctcagagtaggaggggacttttgggttcagtagtctgctgttttcctaactcctgacctccatttcatgttataatgcaggtgaaaaaaattccttagaagggatcttccaattccaagtttgaacatcatgtggggcaggtatctttctgtctcccagggccaaccattagatggtcccgactatattggtgagttgaggaaaatcaacagggaaaattgacttacaaaatgggagggaatgttgcctcttaaatggactttcaatcttattttagtcatttcctttatcctcacttccaggagaacacagtgctgccaattcctaagccttttgagacttacctggtattaattgtgttggttatcatttttttttttggtttttttggagatggagtctcactctgttgcccagactggagtgtagtggcacaatcttggctcactgcaacctctgcctcccgggttcaagctattctcctgcctcagcctcccgagtagctgggattacaggtacctgccaccatgcctggctaatttttatatttttaatagagatagggtttcactatgttggaccaggctggtcttgaactccttacctcagggatccacctgcttcggcctcccaaagtgctgggattacaggcatgagccactgtgcccaactggttctcagttttttcattgtcagtttagtattcagttttcttggtcttctaacttatttaccactcatctaaatgatttctagctttcaaaattttattgttttgtctcttctcttattctcctagtctttgttggtttccatttaaaaaacaaaagcctttaaaaattcaccttttggtcaggtgcagtggcttacacctgtaatcctagcactttgggaggcagaggtgggtgtatcacttcagctcaggagttccagaccagtctgggcaacatggtgaaaccctggctctacgaaaaatataaaaactagctgggcatggtggcttgtgcctgtagtcccagctaattcaggggctgaggctggaggatcacttgagcccaggaggtggaggctgcagtgagccaagatcataccactgcactccagcctgggtgacagagtgagaccctgtttcaaagaaaaaaaaatctccttttagtggggttcggtagatgcatgggttcaatcttccatctttatcttctctctttctcccccagagaatacataacatgttcttgtgtcccttcactgttatagtattttcctgtgactacgtatgagccacatgccacgattaagccatttctttcttgtccagtctttggggcagattttgagaacctgttggcactatgtggctgtcatgaggattaaatgcgctatgcatataaattacctgacacagtaggtgctcaaaaaaggcatgccgtttccttctctcaatctggaggatatgactaaattctattgcattccttattagatttcaatttgtaaacttctctgtgccttttcagcctgtggtgactgacttgcctagttctgtcggatggcatgttaactttccctcccaactttggaggcctgcagatttgaccaccgggtcaccagagctctccttttagtcactggtaacaattgtggctgtgatggggtaggaggtatcatggaagcctcaccatactttgcagacattcagaaagaataggcctggaactttttctggtagcttacattagtgacattgtttagctgagtctaggggtgggaagacatacttgaaagaataagggatacctctacatcttgtaattttttttttttactttttttaaatataaagaaatttttacccccttttaaaaaacgtaaagcagtagtttttaatctagggtctgtggaagagaattcagagagtcagtgaacttagatgagaaaaaaattatatctttatttttactgaccttaccttatcaattataaagttacatccaattataaatgttgtaaataaactgtagtagcattagcaatataagtgacaatttaatatcacttacagttattatttcttaaaatatttatgctcattccttcctcaaaattgtagtggcagttatcagacttgccactagatcttgttatataatatattaatttgaaaagtgcattttggggtattgcaaatttgtattttagtatatttaaaatacatatttaaactttatttaaatgtaattgaaatagttttctgttaatcctagtttatgcattaaaaacattattctgaggaaatgggttcgcaggcttcctcaggtcactgagagtccatggcacagagactctgaaccccaaagacaagtgtctgcaaaggaatttatggttgtttatataaactaatatttttcttagatccctagtcactcttttctctggcatagcccattaaaatttgctttctaacatatagtttacatttttacaagatatttgaaaagggggctattttattttttgctgacatgtgagttcagatgatatttaaaaacacaaaaacaaagatccctccttttgaaatgagacataaatatttggaataattgaagtttcaggacttaagcattctgttaagttgctttgctaacttcctagttttatgttaggctttcgggatgctgaaactcagggatgatgaagttacatttcacttcatggcttagcagccataggttcaagtgaccttgaatggttgtaaaagttggttttatgttaattataccttaaagcccttaaaggtctattctccccttggaacgtcttctggccccttcctgatggctgccatatgtgcctttcactttgtctagataggtgtctgcctgctctgtttcttgggtcagcagtggaggctgggcagagagcctggagccttgaggtcaagtttcctacctcggacaccttggaacactgtagtgttaaagctctggtgccagttcttgcttaactgacctgaacttgatactttagttttatgttgcctaaagcaggtctgctaaattgctctaaaaacttaaataaagtatgaagcactcaattttcaccacggtaggttcccactccttttgaaggagtacttcatggtgcattagaagctctcgtggctcccagtggctcagaggagattgtttggaagcctgactacattttcctgttttctttcttttcttttcttttttgtaggggaaggatggcatttaatccatgaaaacacctgctaggttctgttggcctacatacattgtctctcctatcttttaagcttgtttttatcatattcctgacaggaggttattcctctgccagaatacctcttgcaatgatgaatgttttacttaatcaaacagttcaattcactgttaataataagaatagtcataatatttatgaagtgcttcctatgtaccagccactatatgaaggactttacatattttaaaaaacataatctgacaacagtcctatgagtgatagctgctatcattaacttcatttcacagatgaggagaccaagattcagcatagaggtaaaataacttgcttaagttcctgtgcagtacctggttgaattggaagtggaactaaggcagtcggactcaggaacgcaggctcttaaatcagcctcttggattaaagcaatttcagaagtgcttcagttaagtgtggtagttaattagtaggatctaatgtattatataagtttaccatgttgatagctgtgaagccaaacaagcacatctccagctgactttggtgttatattttattatttgaatgttctaaatgcaagtttttaatgttgagtttatttatgtttatagggatgcttcctttggaaattgcacttacaatctcaccattctcgactgtttgcagggaatcagaaaggtaataacaattctccttgctgtagttgacacagtagtttaaaaaaatatgagaaaggaataatctcaacatccttatttgttattggagggaagaaaggggagccagtaagtagaaggcttttcacttcttgaaggatgattgatttgtaaaatacaaacaccaggaaaaactgggaggagggagtggcaggggcctttctttgtcgtttaaactatttgtgttccagggcagatttatcaccactatcagctgcagtgcctgtgacattgctttgtcacatgcttagcttcattatcaggcttgatcttggtgtgggagagtcaggaagttatctaagccactgtgctcctctgctgcttggtcccaccccagacccactaaaacaaaaactctgggggtggagccctgcggtctgtatttgaacaacctctccaggtgatttgatgcactccaaagtttgagaaccaagtcatagttatttaattatttctgtatataatggagaagttaaactagaagatttctgagagctctcggaacatgttttagaaacataaattcacaatctgagaagttatataagctatactgtaaattctaatgagggctcaaagtacataatctcgaacatataactatggtttattatcagtcaggaatgtacatattacataacctattgatcataggacatatataataatgtcacatggactataaatatattatcagtagcaattctagttcatttcttggatgtaatataaaactgatttttgctgtgttttgagttgagaaaattggtgtgataaatgtgctacctgttttatacatggttgtttctatttaatttaaaatgaatttaaaccctatcaaactttaaaatggttttcaaatctttttctttctacttaaacaactacagagatactctagcccactcttgcaacaatattaccaaggtgcatttccagtaatgccagttaagagcttctatggagacgttacccaacatataacagttgattatagcatttggaaaatatgcctgagggaaaaaataatttatttatcgtcactattattattttgccttttctaccatctgctacaggccatttgttttataacacttaaaaaatttagaaagttcacactggaatatcgctgcctgtaattatggtaattagtaactcagtatagaaagttgtggcatccttcctgttgtagaggaaaggtatgtaaacttgtttcatcaaatgttggggttaactcaaagacaaatgagattttggaggatctgatagattgtgcagcatgtctttaagcacctgagacatttcctgtaagttcattctcttacataaggcaccatattctgggctatttttgtgtggcaacgagtagtaccattccaagaacctatacagagtatggccacatttttgcctttttagggagcacatttctctgattttaatgtattggcattgtcataagtatagtttatattccatgttatgtgaactactatacatggatataagcaaaccctttgaaaatacagaggaaaaaaaagtgaatccttcagagagtttgtatatttttctcacttttttgtctggaaaggtgcatatggatgaactcagttttttttttttttttagaatggactaatttaaataatttgttctgcttattctgtaggggttgtttaaaccagtgttatcagaattttgcatttctaagaatcacctgggaagctatgctgaaaatggtgatcctgggccccaaccacagcaaatatgatttgatagttctggggtggggcccaggagtctgcttctttcatatgaattaccctaagtgtttctgatgctgatggcgcatgttctgtgttttgaaaaaacactgatagatgtactggagcttggcttgctagtttctttttctatttttaatgacttgatcatgtaacttttaaatgtacctgtggttttgtattctgttgtaatctgtatagcttcatgatttataaaataaaagattctgttctctttaaaatattagatctgagctagctggatagtttttaaaagttctaagtcattgtttacaaaactgagtatgacttttactttgtgataaaaatatgtttttttttttaaattgtaagagcagtcaagtataattctactttgtcagaaactatctcatgaaacagattctcccaaggtagagttttaggaacaaataagggcctattaagtagaaatattaagaaatattacatatatattatgtattgtatatataaatatactatattatgtattatatataaatatactatattatatatagtatatataaatatatactatatattatatataaatatatatattctctcatcaaatattattaaggacctattaagtagaaatattaaggaagaaaaaacagtaaaagatgcagggtttttttggggggctaaatatctccctatgataaaaggaagacaaaaactcataagaataattgatttttcttctcctaacaaagaagttaatcactatgatctattctgtcatagttaggtctagttcccaacaggttctaactataaatttgttttatttcattttgtatacatataattttacatacaaaactgatgtaaattagaaatcaaggcatcttttgtggggctttttcatgttattctaagtgtttttttagttccagtaagacagtcttaatgcagtataaccagttttataaaaagatttctagatatgcattaaacatcaaaggtttcaagctgtctcttcagattagtgaggatcatttctgtaagtaggagttccagaaatgatgagtagagtttatcaatttagcatggaaaaactaattcaaattctgcttttagggattacaacatggattttttgactttgagacatttgatgtggatgaatatgaacattatgaggtttgtacatttaattttttttacaaaacataatttcatgttgattaattttttccccctgtcacactcatgtattgcaaatcgagtgggtgctaaataaaagcattctggagttttccatagtggtcagttttgtcctttcagccttggttatttcctttgaatcaggagtcaccaaaattttattttggaaaaacaacatatctatatatattctctcatttatatacaatcactttgcacctttagtttataagaaaaatctagtagggtagtaaaattatgttacttttattttagaaatcaggttttatttaaaataaaactgaatttgtaccttttatttatttatttttgaggcggtgtctagctcttttgtccaggctgaaatgcagtggcacaatctcggatcactgcaacctctgcctccccaggctcaagctatcctcccacctcagcctcccaagcagctggaattacaggtgcatgccaccatgtctggctaatttttttttttttttaaagacaggatttcaccatgttgcccaggctggtcttgaactcctgagctcaagtgatcctcttgcctcggcctcccaaagtgctgggattacaggcatgagccaccatgccaagcccccttataatatttttggttgtataaattttattttgaaatatggctgaatttacttagttctaaaagttcactgaatttttttttccccatggcatcattacaagacttttgattaatgtcttgactgctcaaaatgcaggcaaaggctatctccaagctggtttgcgctgtaaggagatgttgaagcagagtaggataaggaggagtctagaagtcattaactttttctgaaagatgagaagcctgtacaatgtgagtaggttcaacattctcggaaggtgaactcatccgttgggtttccccagaggagtaatacaatttatctctatccttagtaagataaggacagccctcacatttggggccctagtctagaatagggctgtttggatattctgtttccatgttaaatgcaacatatctgaaaagaaactgatcatcttttacccaaacatggtcctctgctttgtgtgtgttaccacattgccatcctactgagcacccagcctcaaggctagaaacattgctgttttcctccctaacctagtgagtattcggatcacttctactggtgccacaggatgtattaattatatctgtctttcctctctgttctcacttccttccctctgactcaggtctcacgtcttttcctgtggacctttcattttaatagttctctaactgagcacggcccttctcctcccaggctgccttacacacacctgagtgatcctaaaatagagttctcatcttgcttgtcttgttcttggccccaaaccggctgtttctcccattgccctgctgaaatgtggataaactctcctgtcctggcattcttagctgtgatgagctccagcctacccttctagccccatctcctgttacttcactgtacgtactctgtgttccagctcctcaaactgcttagttactgtttcttgaatatccctgttgcttggctgaggttgctttttcccagattcccatccttttaacctcccgctcctccatttcgtttgtgttaaaatcctgcacagattacatctcacctctggagtactcttcttccctgccttcaatttcatgtgttacaatttgtactttccatttttcttatatcatggctatttgtgtacaagcctaattttccttattaggttgcaaattccctgtggatggaattatgaccaaatagaaaaacatatactttgttcttggatagaaagacttaacatcataaagctgctacttttcccaaaattaatacatttaatgcaatttatgaaaaaaacccaaagagagttttttttaataccataaaagcattttagtagtgacaaagtaagattcccctctaaaatccccaagttagaaacaaagggaatatgtacttataagaaagaaggtcagataacttgtagtacatctgaatcactgaatgttatgcagtcattttaaaaaatgaattgagctataccacttatcttggaatgatttctataatgtttgttgaagagaaaggatatggaagagtgctttaataaaatccatctttgtaataaaacaaacaatagtaagacactccctagcccacacatctaggtgtctacattatatgaccagaggtgacttactttgaagctaatgaagcttaaattttagagagcctcaccccctcaacttgtatgggcaccttttacagtcctatacccaattttgtgttaataattttttactctaagatggaccctcaaattaggtgagtttcagaccccaccaaaacctggatctctgccccatgtatatgaacatgaagaatgcaaatggcccattgtattaattattaaatatacagccaaacactaaagccatttcaattaaaggagagatggaggcaggagggggttggaagcggtgagagagaagaaggaacaattcaaggagaaaacttgtggatgttttatttattccttccttccttcctctctgtctaactttaatggtgatgctgagggttagttgaaaaaaatcttgaaaaacctgaagcagacagtgcaattttattcttggaaaccaaccagccaaacaaacaaaaatctgacaagaaggtagtcatggtttcaccttgacaacaaccatctaggtgatgggaggggagcagtcagttttggtgaagacttgatgttgtcaaacaacttcttttttttgagaatgatttatctgttctattataaagcctataaaatagaaaaccactattgtgattggcaggtggtaggtatttcttaatttttagtttcttaatttcttaaatgtttaaggaataaatgaataaaggaactcttttctgacaatctgtgggcccagtcatttcctgtcagatttctcttgctgtttgccctgttctagtgagtatgatatttggtgaacttgtggaatagctgaattcatacattttattagctccagtaaagtcagtattccagtgaaggcagtgtagttttcaaagcaaaattttattgttgacagcaatttgtgagactgtaagccttagatgattaggggatgttcaagatgcaacttttctttgctaaagtacatttagtaaatgatatggctcagaaaaacaaaaaacaaaaaaaccccaaaaaagcctaaaacaataagactgtatctctatgtgagattaaaggggaatcttatagaaagagtgctacttataaatgcttctagtgatgaggtcaacagaatgtgggaaatgctttgttgtgtaaagtctacagataaacctctgcccatcctgcaaaaggttatatgcatcttcctcctgcaattccagggtctaaagcagtgctgtccaatagaaatgtgaaagtcatatcatgaaattagttttaacaatacattttacttgttgtaaatatgttgtttacatatttagtaatatacctaaaatagcatttaacatgtaagcaatacaaaaattattaatgatgtatgtattttgcattttttttgaattaagcctcagaaacccagtgtgtagtttatttattttatttattgtgtttttttgagagagggtctcgctctgtcacccaggctggagtgcagtggtgcaacctaggctcactgtagccttgaccctctgggctcaagccatcctcccacctcagcctccagagtagctgggaccacaggtgtgtgccaccttgccctgctaatttttgtatttttttgtagagatggggtttcgccatgttgcccaggttggtctcaaactcctggactcaagcaatccgcccaccttgtctttccaaagtcctgggattgcaagtgtgagccactacgcctggcctccagtgtgcagtttatactatagcatatcttaatttagactagccatatttcaagtgcatagtagccacatgtagctagagtatggattctgtaaggacaggctagccaatgtactgtcatagtccatcagtgtgacatgaagcctaggttatatctccttgcttcatgtgatctgtggttcacatgagagttaatttcaaagccctgttctatttagaaagctcgaggtgagatacctcaggctcttgctttattttcatgtgacttaaaaatggcccattgtattaagtattgataaacaacaccaggtgttggcttccgtcttggaaaagtatcttccaaaatgtggtctttccaggtcctttagcaagctgttgtggaactgtacagttccttacatttgccccgatcagacatgaaatttgggcagctatgctgggaaggtccacaaaagtaactgtgagatggtggtccaaaaccttcctctaggaatcagtgtcaaaacatttgtacttctccaacagcttcttaaggtattctcaaagaatatgtaccttgagaaccttgagaacttttactcctttgaaatctagccatttcaaatctagttcagaaaaatgaaagttgaccttttgtcctagggaaaaataatgaagatgatagagcttgaacattcaattaaattaggtagctgtaggtatgtgaggaactatgctcttcagtagtaaagttagtggtgaatgctagtgtaggctgatactctgcttgtaagacctggaagtggcacccatatacagagtctaccttcagtcagctttcttctgtttttttggggggtagctgtccttaccaaacaagatgttgcccaaacaccagtgatcattcatgatgctactgttaagcagttattatttatcagagagaatttgaagttatgtctctagtttgttattttgcttgtccccaagggctttccgctatttaccaaaaggcttgccatggtttgatgatggaagtgtgatgcggtagcagtgtcctgttcttagttgggtttgggggaagaaatgcagagaaatggtgcttcagtggcaacatcggaggttcctcatcactgtggcttacatttattaccccattcaaaattcagcccatgcaatttcaaggagtctccttaaatatctatttggggattaggtggagataaaagttgaaaaatgacttcaaaactgagaaagtactttgactttttttctttgagctattttctagctgccattatctgccccctgccataactcattccttttttgggtgtgaaaaacaaaattatgagaatattttccagaatatcaagctattgtggccttgatcctatacttttaaatgtgaacaaacccaggccacttctttaccattgtcttgatagaagttagagccacatttggcctgcaggcctgatgacagaggcacctgttactgccttgacaacagtcaccgcacagggcttccttttgttttttcatcatggcatatggagaaaatgataatatttgctcaacaccctgtgatgatagctcatagctgttggcaagtggcctggggactctggctgctccagtctgcccaggcagctccattctggtcacactggctaggaagctttgttttacagaaataatgatgtgcagatgaacatttcttatttgaaagtcaagtagccacaccatgctccttatggcctcattctcatagcttttcagttcatttgttgaacagatattaaatgcctcatgtttgctccatatatttgctaggcccaatgtttctttttctttttttgttttttaggaggctaccagtaatatcatctctccatgtgtagggttaaagcctttgctcttgtcacctggtaccatagaatccatgtattcttgtgcctcattctgcagaagttgccatatttgagtcttgcttcaagcccctacttttatgcttatcaatttagttgtgatacaaaatttctcactgatccatgacaggctgaaatgtggactattttgttcctgagatattcaagcaattcacaggttatcattattgctatcttcacctaaagggtgctcttttggggaaagaccatttctattctagaaagtgatttcacattattttagccacattacaatgtagcgcatctgggaactgtttgtgaaaaagcatgggttcattctggatgcctgggattgagtctttcttggatcttgggcctcttcgatcaagacttcacattactatcagggtgtaggttttaaaaattaagtctgattatatcattcccctgttttatcatttccccttcatgggctccacactgactaaaggtgtggaggaaatgcagactccttactacagcacagaaggcccttcttgacatgggcttgtccttcctctccacccttgtccttttccactccctccccatacccaaatccacgcagcttacccggtggcggcttctgagcttttgcacatgctcttgctccctcctcctgcctgtcagctcttctttctggtccactgtatttacatggttgactgttaagtccttctcaaccccatggaagctcttctcatgtagccttgtgtggtactctgtttacacatctgtgtctttcctgtatctgcgggtacttttgggcagcaactttgtcttattcttctttgtttgaataagtaacctactagcacagtacactcatagtgggcagtcattatttgtggaatgaaagaactaatgagtaaatgtgtgaataatactaaaaacaggagtatagcacatttcaagatattttatatgatctgttttcagtggaaagtgcctaaaacatgttgattaagaatccattctgattttgcagtaatattccaagggacaaatttaccatggtagacaacttcttcaaatgatgtttcttttatcagcagccaatctatgctgcaagagtgaggttttttttttttgtttctaagtcagttatttacaacacagattgctagatgttttaatctaagaccagttctgtatggaacatcaatttagtttaatatgtgagtggggacctatctccaggttgactctgtcatccttcactgcataagtaaattttcagattgaccaggtggtgtagagtcctaacaattgctctttagcacctaccttgagaaatagtaaagtttgttaggcctcctgtctctcagcaagtcacattgggtcaagagcaggagtcaatattgttgaacactgaagttatgatgcttcaagactttgtttggattagaatttgtacagcaaactaaaatgtaatctggatgctgcttggtctgccttctttacatgttggtggattatggaactggaaataatgggactgccataggactggggtcaagcagtcctcagaatgcaagtatgtgggcatgtcctcaccacctggagcagttatggaagtacgcctcctgtggcaatttgaatattggaagaactattagaagaagcattctcctggagctgtctggtagtgttcattacaccactccaaagcctcaagtttaaggaagcaaaattacttcctggccaccgcaactgcaaaagtgaggggacccagtgtttccgtatctgttacacccattgctggttcaaagctcacgttggttaagtctataaaatgttttgagacttaccctgacctaaacaattccccatggcttttttttcttcctctttaatgattgtttggtatcttttccttctttaatctccaaacttcttaagagagcagtctcgactctaattatggtctggcctctactgaaactgttcctgctaacacaagcgttcgtaaaaccaagtggccatgcttgttcttcttcctacttggtttattctatggtcgctctctaattcgcattccttccctgatttataatgtgctgtcttttggatttctcctccctccatggctagccatctttctcagcctccctctcaaatcctttctcttcctttgcccaccctgatttgctggggttcttgaggacctcatgatttctggttatacacactttgtatgattaagtgcatccagttccaagtttcaacaactatgtttgtgctgctgactccaaatcatctttgcgtcttgaacattggagtggcatctgcaaatgtgcactggatttttgcaccctgctgttgtaccagcagaggtgttcactgatctggacttttggaatgggcctccacatgttttccaaccccactgtctccctgctgtagctgatgctagcagaggtgaagcagtcatccacatgggacactcctcttttgctccaccacaccgtctccctcaaaagcaagtctaaattaataatctagagtttgattattatttaaagccagatggcatgtcaacttaaaccaaataattcaaatatttactttgctttaagctcataaagtgcctgtccttacagcatatttgcatttatgtaatacaactatactgtcaacactgttttgttgttttagaagttagggaaatataaagaaggcactttttaaatgaattttaaaatgccactgtggttctaccttattaaatttcaaaatagtctttgtgtcactgtcattcctcttacatacttttagtatcgcatgttcaaagtgtaatgtgactttttctttaatggataaaacgaagatgaaaataacatctacctcatagggttgctatgagaagtaagttgtatagaatacactagtgtttaacacagagtcagtggtatccacatatttgctgccatttttgttactgttatttgtcattcccacctgcctttggactctgtaaaagcatagagaatgctttttattattttatgtttgacaccaagttacagtccttgatatataataaaggctcagcaaatgtctaaatgaatgttgaattgcgcttcaaaactgtttctgcatgttttcctagaaaacacatctgttgatataggaaatcaaccttgtaatcgtcaacctcaaagactatcttttctatcttattgtaggtttgttacagtagtaaaaaggtcaaatagttttcagtgtttggacagaaaaatgtatttgtgaccattactatagagtcacaaatgcatttcttagaaatcataaaaattggccgggtgcagtggctcatgcctgtaatcccagcactttgggaggctgaggtgggtggatcatgaggtcaggagttcgagaccagcctggccaacatggtgaaacccggtctctactaaaaatacaaaaaaattagtcgggcctggtggtgtgtgcctgtaatcccagctacttgggaggctaaagcaggagaattgcttgaacccggaggcagaggttgcagtgagctgagatcgcaccgttgcactccagcctgggcaacagaatgcaactccatctccagataaaaaaaaggaattgtaaaaattcatgttttttagtcaaattatattttgagtgcaccaggagagtgagttattcaaaagaaagctgtgaatcttttgtagattggagaatcctatagcacagtgaataacaacacctaaatgtatcactttcaggaattcagatttttttattttggatttttcttacagtgaagaacatctatagttttttttgcatagtatttggtaggtagtaggctttagatcagaagtggtaatatcatactcttgcctcatccttgcttaggtatttgtttacaaaatgtggtagggttggaaagtaccttaagttcctgtctgatctagatttctttgaagtgtatgtgtgtgtttaattagaaaaaccaacttgggtcatataaagtattttattattgataaacattgacatttgtataattcactatgaataaaggcacaaatattaactttggaagactaccaaagtaagcgtatattatattaggtcagttaaaagctgtaacttccttattaattttttctcagatttaggtctaagacctaaatctttttgtttattccatcagccttatcctggctgctgaatataacccaatattatctactatttatctttttgggtaggaggatttgcaaacatattcttttggttctgtgaatgaatgtatcttagggatccccttgcctctctccatatgattaattataaaaggttgctatttaaccaaatggatttctgtaatccaaataagcagatattgcagagcgtatttatctaacctacttggtggtcaaggatacagaaatagtgaccgtagaaacctgttttcttttattgttcataaagaattggttttagtctcttgatgattagtgcatacctttattcttggattttcaaatactgtgttaagcttaataattacttgagagatattggataattaatttgagacttttatttaaacaagcaaattttaattgccataattagattctttatttaagttgttataaatagaagctatgcttgaggtttaatttcacatgtgcaatcataacactcagggtttcttagattttacttagggcattttggatattttttttatttcctttgagacagagtctcactctgtggcccaagctggagtgcaatggtgcaaactcggctcactgcaaccttcatcgctggggctcaagcagttctcctgcctcagcctcccaagtagctgggactacaggcacacaccaccacacctggttaatttttttgtatttttagtagagacggggtttcaccatgttgccctgggtggtcttgcactcctgagctcaggtgattcacctgcattggcctcccaaagtgctgggattacaggcgcgagccgccacgcccagctggagatattatgtttattacaactagattaaatgcagttcagatgtttataagatggtatgcacagtttcacatataactttttataactgggaaaaaaatctgcattaaaaaatgacaattatattttatagccaagttttgattttcatggaaatgataatgggtaatataagtaattaaagtaatggctccagtttttttttgatggccatattccaatttgtttaacaaatatttattgtgttcttatggtagagtacagagtctatattgggtcagttttctactgttgaggtccttgccatataatggggggagaaagctttttatatggatggtaacggatggcccagtgaagagaacaacattgcttccctgccctgaggatggagacaaggagggcaagggtaggggtaggtggggagggggtggtggtggtaaagacagcgtaagtgaagaggtgatatatatattttgtgatgcattgcacaaatgccttctaatgactgcaaaatttggggtaaccttactcgtgccccagtgtcccatggttcggaggcacatggggaagggaagaaaatgggggagatgatggagccatgggaatgtgcttggctactttcttggtcttcttaagccttttctgaggatctcttagcgtgtttagactagaggctgataactggtgctcaaagtcagccaatgggcatgttttatttggtttcacaggagttaaaaacctaatttaaaaagtcaacattttaaaaagagagttttcacatgaaaattcagttggaagatcagctgtgttcagttggctttcctacaaggtgtctcattagctggagtggaggagcacctgactctatgtatgtcccttgcttgaatcttgttatcctccagagtacagcttggctgactctggtttgtggaatggatgcgccaatatcactcgctcctgccttttgccatttccccctctaaaaatcagcattgacaagagataacagccctataaaaagagaaaaaaaattggaagtgtattcatcaggagcttgatatttacagatgttttttcattgtttaaaatatgtttactacattcatggaaagttttcatatttcccattttctcttatttatcgccaagacaagcaatgtttgtttccatttcatttctttgcagtggccaggaaacaaacattttatgcaaaatacctctgccgtaaataaaagtttctaaacatttcatacagtctagacacaagtttttctaaagcggattgaattcctaaatagcattttgagaatcaggtgcatgtttttattttaagctatgtttgtctacatgtatgtctaattagtactaagagtgaaaagcagttttatttgtaagggtttcctaaattgtataagaattataaaatatttttcttctcttttcttacaaaattctgccagcgagttgaaaatggtgacttcaactggattgttccaggaaaatttttagcatttagtggaccacatcctaaaagcaaaattgagaatggtaggtttttttttcctttaccatccaaacatttattttgatttatctttctaagtttcttaacttcctcagataattattttctttggtaatattctccaaagaatatttattcataatttaaaaaattgaacagtagtaatagtgtgttaaatattgtatttccagtaggtggagctataatcactgttttagaacttaacaaatttttagcttgccataaataggatgttcactttacctgacccccaattattagagaagaatctgagaaacaaactggtcaaactcataagcagattgctgtattctttcagtggttctcagatttatttgttggtagagtgctacacatcaagatgttctttgggtaacaccatgttgaataatgatgatgaagacaatctgtcatttactgaatacttaggtgctagttacacagatcacagcatttatctcttttaacactcaacacaactctatgagatacagatattgttatctgcattttagggaggagtaaattgagccttattagtagagaatttgcccaaggtcacaaagtaataggcagaactggtactccaaaccagaggagggctcctaaacattgccactacactgatacacttagttccattgtgacaactaggtacaattttctagctgacagtggttaaactacttatttgcagcataatttattgccatgggcatacatatttaggaaaaaaataaaaacaaaactaaaaataaaccttttgaatgaaacatgatcagctatgcaagttttcccattaagacttattttgtacttactaattttttctatctactaatattccctagaaaacaagtaatgatagacaacagaggttcaagaataatttacaagagaagtacataaaattgaaaaaatatccatgaacaaaatatccccccccctttttttttctatctgatcatagaggtggaataccagtgttctgagggaacctaacttgaaacctctggtctagatttattcttcagctgggcatggtggcatgtgcctgcaatcccagcactttggaaggctgaggtgggaggattgcttaaggccagaagttcaagaccagcctcggcaacatagcaaaaccctgtctcttaaaaaaaaaaaaagatttatttttctttaatcatcatattctagaatctagtttcattgtatattgttattcatgcatttaggttttataatttgagctttcataaatatgcttatcatttcatacctgtgacatatttaatagggaactctgcttgaatcatgattttaccatgcgaatgggcaatccaggtctagagagttaagctcacaaacaggatacctctatggtgaagtcagaatttgatcttcttacttataagcttgctaaataatcttttttggtctggacattcaataattaacctctgtcattttgggttgttaggaattacatgttgagagcctgaggaaactgctttctgacaattggcctttcaagataagactgattaaacctgctttctgtgcaaattatctgactcaggcccaggaaatgttagtagggatattgtttcagtagtagttttgttgttgggtatttggcaaagtcgaaagactttcaccatttgtgattcatgtgtttgactacgttttcttaatgagaaattgagagatataattgtaaaagccatttaaaagtttttatgtatatagacattgtatattctatggatacatgcattttgaaaaaaatttttttttaacaaaagtggcatcataacatagttaatatcttacagccaggtttcttcacttaacatatcacgacttctttttatagcagtaaatgaagatccatgtaatcattttccacgactgcattgcattttgttctaccatatgactgtgccatattgtgttaatttatttttggtttttgcttttgtttatttagagacaggctcttgctttgttgcccaagctggagtgcaatggtgtgatcatagctcattgcaaccttgaactcctgtcctcaaatgatcttcctgcctcagcctcccaagtagctgggactacaaggcacagcccaccacacctggctggtttttttttttttttttaatttttagtagagatgaggtctctatgttgcccgggctggtcttgaactgctgggctcatgtgatcctcctgcctcccaaagcactaggattacagatttaagccactgagcccagcctgttaatttatttttggatgagatctaagttgtttatctcttattcttactctttttttcctttttaaatttcatcatctatttaaccagatgaagtttttcactttttaaaaactgctgtggttggcataaatgttcatacatctttttgcagctgtagtttcttctctaaattgttagaaatagaatcactagataaaaggatacgcaattttgtataataagttataagtgtcaaaaatatttaaaacaatttttggtcctatatttaatatggggaaaaaattatagccaccattcgcttacctgccaggaagggtgctaagcctcttgcatatacatcatctatttaatgatcagaacaaccctctggagcaggtggtatttattttatagaagagaagctggaggcttacaggaattacctaacttgtccaggttcataggccagtaattgttggcgtgtggattcaaacattggtctgtttaattctgaattttgtgttgttttaaattttattatagaggatgtacatgctcactctagaaaatttaagtaatataaagagtaaaactctttaaaaacatcatataatcaagaaataatcactttaagatatcgctctatatgcatattttattctatgcatgtattgtgccctgtcatattgacataaaaaaatctgaaagtacatttatctcacctttgtcagcttttatgatgcctagaacaatttcatttaaggctgccattggtaaaatattgctattttactggaatttccattttaagatctaatattcactagaagcttcactatacttttttgtaaagtactttaactttgtaaatgctttttgaagttgagaaaataattttgtgatggaattaataaacctgatccaattacagtgacgtcttggtaatttttttttttttttgaattgagaaacctgtgtttttctgaggaggctgaaagtcattttagaggctcgttagaaaagctgaggttttaaagaagtgatcaagtagctgttgctaggaggtagctaaaggaagctctaaaatcttgggatctgggcagaatgtattataagagccttaagtgtgtgtttgtgtcaatagggaacactaggagtttcttttagccattttgattcacattgttttgacagtggggaagagaagagccctacttttttttgttaaacatttttgaattgataaatgatggataacagcagaatgaaacagatattttggatttcagattttctgtaaaaatgtctcttaagtgtcactgtcattctcacttctatttaaacacacacacacacgcacacacacacacacacacacacacacagagagagagagagagagaaagatagcttcagactgagaatcccgaccatttgaggcatcagcctgctcctttaatgagagaagcccagtgtcccgtttagtaaagagcctgggcaggttgaagcctggctccattcctttttggctgcgtgaacttcagtgagttccacagcttctctgagcatcagttttcctatatatcacagtgggagaaatatgatcctcactgcaggcacctagtgaggattagagatgttatgtgaagtgccttgcagagtattgggcacacataataggcgtttattagatagcaggtattatggttacatttttatcattagctggcctaatcaacagattttatgtctttctacatttgcctgctcagtttgcagtttttacttttaataatgactgagtgaactagtcatttgactctgctgttcttcagttttcgaactttaaaatgagggcctgggaagagatgaataaaaacatctcttttgactctgataccgtgttcatgtgtttggtcagcttaactccaggactttgttgtggttcagtgatgccagcgcaccatcttgtggccagatggagtaagggtcggatgaaggctccataagttctgggtcggcacattatacacattgctaaaaccaatctctcgcaaaaagcactcacgtacatccgtaaaagccacaaacagttgttcacaggtcataggacatttccattgttcgttataatttattctaaacagttttaaggatttttataaaacctactcaccaattctaaccgctcatgttcatatcatgttctcttatttggagtcttaacagatagaatcaagttgaatcttacttgaaattagccccagcatgggtgttggaatctgactgccaggattgaaatactggctctacctcttactagctgtatgtgtacgggccagcttttccaggcaccagaaattgagtaattgtaggttttaatgagataatccacataaagcacttagcatagtggctagcatatagtaagtgcttgataaacgttaggtgcaattattgttgttattattatttcagtgccctgttgccatatttggacaatttctgtccagtgttttcttctcaaaagatgtatacatcgtttctcttaatagtctatttaggcatgttagctatgctgccatttactcatgatggaaattcatatatgaaaagagagattcttgcagcctttgttgcagggaggaaggggataggcactgaaccaattgctaacacaacgtgtgacaggtgctgtcatggaggtcccaggcatgctagcaacccagaggcagaagctctcaccagcccgccacaccagggcaggctgcccaggtgtttatgagcccttctcctccccattcctcacatgatagaaaaaccgttacttcttaatgccaactacagttctttttttgctttaggctataaatctgttgcagggaaataatttgagcaagtaaaccaactaggaaaacagacttgatttttgcagttagaaaagcatgttttctccatgtttgtgtaggttattgtttctacacagaagattttaaataagctctgttttacctgtttgctcaaaagcaacatagcctgtgaaaatcacatatctgagctgtggattaattggtcctgccttccaattctgtcttcatcctttgtgtgacctggccaagtgtaccagttatggctgtccaactctggtaaaaggcagtttttggaatatgttgggtagctcatagactttaagaaaaggctggagaactaggcttagaagatgaacaggacccaagtgggaaaatgggaaccacactaggcatttcaaacataaagcatttaatacaaggagtttatttcaaagaagactaaaaagtaaaaaggcaacactgaagaaaccagaatatgttggagaaaacagctagtacctttaaggctggggggacaaaagggacaaaagtggagttagcagaacctgctcctgttttctgctgctgaagtgatgctgccaggaggacaggaagaattcccttcctcctcctcaggttgaggtttagtgcctcccatttttacaaccaataggaagccagatagaaaggtagtctgggaaatgtagggcgtagtatatggactccagccccagtgtcacagagcataagagtcggcttggagctgagagctgactagcataacagggatccaaggcagcaagaaatacagccaagcacacagcgtggaaacagtctggttcactttgctggctgccgccacccctggaacctcccatcatgaatgggttccaactgagataattgcactcagctggtatgttagggttcagtgaattctgaatgggttacagatgtggccatcagtgtgctgggaacttagtcccctgaacttttggagctgccattgcaaggcctgcaaaggccaaagcccccagtggttgccttggctgattagctaaggctaggtctgtaacccagctgactgtgtagctcccaggaatactcacatgatggtggagccactcaaaaataaaaggggatttaaaggtggagcatcttcctccctcaaaaaaaggaagtgtccacaaaagttattgtttatttttaactaaaaaaatttatattttaattgataaaaattatatatttatggtgtacaacaacttttgaaatatgtatacatcgtagaatggttaagtcaagtcttacttaagtattcacatatttatcattttttgtggtgagaagacttaaattttactttctaaatgactttaaagtatataatacattgttattatagtcactatgttgtacaatagatctctgggacatactcctttctaactgaaattttgttttctttgaccaatatcctcccaacaccccctcttttagtttcttaatctgttaaatggaattagccatacttaagagatggttttgagaatttgaaatgatacgcaattgtgacttgtacatagtaggtgcttaataataattgcttctggggagcattgtactacaaattaaaactatacatatggcaaaaaagcttcagctgtagttgaaaactgtttgtcaagtagagaataaagctcaagagagaataaagtcaccattctaggtctgttatgcacatttgattacttcaagaatgcttttgtcttgggagtgggaagagtatgctcccaggattcgaatctagaggttgagattttgaactttaatgatgtattttcagtacttacagaagttttctttttaacctcctgtggtgcttacagttatgcagattgatgcttgtaggagcttgctgtgacctcttctctcacacaacacactttcctcccaagctttgttgagatttatacacttcattgttgagagttttgtatttctgggttgtggaagatgaaatgcatgccttttgcttactgctcctttgttcctttaggttatcctcttcacgcccctgaagcctactttccttatttcaaaaagcataatgtgactgcagttgtgaggctaaacaaaaagatttatgaggcaaagcgcttcacagacgctggcttcgagcactatgacctcttcttcatagatggcagcacacccagtgacaacatcgtgcgaaggttcctgaacatctgtgagaacaccgaaggggccatcgccgttcactgcaaaggtgtgtgcaaggcctcggtggtggtggctgtgcttatcgaaggggcgggccaaggaagagcaaataacataaaacaaaacctgtttagtgtcttagaaaaacaatgaggttttaaatttcagacaactgggacacaaactcattttaataaccccttcttaaagaaacgattgcttgggtgtggacaattggtggtggtgtggctttcttgatatgccagtttttcagaccttacctttccaggcccacgtgccacaatgaggggaaacacagtagcagtgtctttaggctgcaggaacacctttaaacaggtaaaattctcaagagacaagggttgttagttttcctctctcctttgttttttttcagaattgcccatctcttctccatcctcttgcactgtcgtggttctgttttatgacccagttatctggacccccattccagtctctgcttttccctcccctcctagtctttggcttcatggagcagagcgtcttccatgcctgttgctaggggcaatccgctagcttacaatgctgctgatgtgatgctgcctcatggaataaacttaaagagtttgttttgcaaaaatctctgatctctgggggtggatactttggggcaggaattgttcagactatagaaggtttaggattgccagatttagcaaataaaaatacaggctgcctaattaaatttgaaagttagataaacaatgaatacttttaaaacaaaaagtataaatatgtcccaaatattgcagggaacatgcattctgtattttatctggcaaccccatgtcagctactcagaaaatatgacatgccatttgctctaagcttgtttgacttcgaggaggcttaaaatccactccattccagatctttcggtatggataatactggaaatattccagatattttactgggtctttgatttcagcgaggagaaatcactagggccgccctgggctggagcctcgagttcctcatgtgcagctcctcctagtgtcgctgggtggtgctgtgcttatggttttgggtctagacccggtttccctctcattttatgctaatcatctagtaggtgttggggagggtgctgttcttttcatgtgcctagtgctgctgtaactgacttattcagacgagtatggctttggttctgacagaaattaaaatgccgttttgtaggcccttgtttctatgtttaagatttgagtaggtggaggtactttgtgaacatgtgagcaaaaatgggaagctgcggtttcccagagacccagagagatggaaatgagcagcacgtggcctgggtttggagcagggctccccatgccaggctccctcctcctgggtgggcagagctctccctccccaccctccccattagctagcaggatgggccctggctttgtgggatatcttgtctctggcgtggagtctgttaggaaggtgtcacttgctggctcatttgtgggtgctgctttcaggccacagtggggtgccagtgtgttggcttgtccccatgtgattcatttgcaccctgtttgcttttccattgcattttgttcagtattgcccaggtccaagaaaaagcccacatgtcacgtattttaaacagcaatagaacttgagagctaatgggaacgtttatatcaacgtttagcaggagataatcctatcttctctttcaaactttagttttgtgccataaaaattgtattttttcctgagattaatttggccttatttcttagttcaagtagttttattattactacgtcgtagagtttatctgtggattagccatccgtatcttggattgacacattcaaaggagaagaactgcaaagctttcattaaaactcagtgtgtttcttgatagtatttctcacctgagagaccttgtgcaaagaaaactctctggtgttaaacattcttattacagatattttctctatatccttgacctgtgaatgtttaccttttaaaaaatatatgtatttattttatattgcaaatttcttttcttttcttttctttttttttttttttgagacaaagagtctcgctctgtcacccaggctggagtgcaatggtgcgatctcagctcactgcagcctctgcctcccaggttcaatcaattctcctgcctcagcctcccaagtatctggaattacaggtgcccaccaccactcctggctaattttttatatttttagtagagatggggttctgctggccagaactggtcttgaactcctaacctcaggagaatgttggccaggctggtcttgaactcctgacctcaggtcatccacctgcctcagcctcccaaagtgcggggattacaggtgtgagccaccgtacccagtctgtattgtagatgtttttattttaaatcagaacctttaacattgaagtcagttcttgtataggatagtcacatttacatgtggtaatatctttttgagattgttatttcattttcttccacttgcacacacacgtaggattcttttataaggattacacctttggtttaattacagctgtattgcttttcacagcatacttatctactataggcttattaattattttgacatctgccctaattaagtcagcttagttttctgggaattcaagcagcactcagtcttttaattgaactaaaagaaggaaggagaaagaatcttatcctatgtcaaatgaactttggtggctactgaaaagggaatgaatatgtcatgcctcaacgtaaagtattttatacagagataaactagaaaccaatttgctggggattacatttcaatatctgcatttcactttgtggttgataaaagagatggctatgaattcttgaaattctctaccacaaataataatctaaaatacagcaacgttgtgatagtccagtatgtgattatcgatgttctatagggctttcagaaaatgcctggaactataaagcaattggtgtttgacttggtataaatagaacacttttcaacatcttgtcatgctgtgccagggagccctttaattacaaatgcttaaaaaattttgttaaagtttttatagaaacttagtgaaatgttcctattcagttcagttgtggtaagagctcctaactattgagtgctaagtgcgttctttttatagatcaaaattatagactcttttttaaaagggggaagctgctttagtttcagagaaattggaaaatttcctgcacctcctttttggttgtgagtgtgaacaggagcctaagtgagggagccatccaggtctttgcacagtggggagcagtgagagagagtgttgtctccataaggaaggcccttttctctccagatagacacccaaattggtgacttgaaggaagaactctggaaactcactgggctctggcttctgctccaggatgtcacctgtgttttatctatacggttgcctatagtcttgccaggcatctagggaattaacaacgataggcactgggtgaaatagaaggcaaattacgcagaaatcttaatcataaagggagagccccactgagaccaaaattaaacctcactcttcgaaagaacattgatgtttgatctggggcaagggttccttcagattaaaacagaacacacacacacacctcatctaatgaaacagagtatgaatacttcttaaaaaggaagggttagccgggagtggtggcccacgcctgtaatcctagcactttgggaggccgaggagggcagatcacctgaggtcaggacttcgagaccagactgaccaacatggagaaaccctgtctctactaaaaatacaaaattagccgggcatggtggtgcatgcctgtaatcccagctactcgggaggctaaggcaggagaatcgcttgaacctgggaggtggaggttgtggtgagccgagatcgcactattgcattccagcctgggcaacagcagcaaaactcggtctccaaaaaaaaaaaaaaaaaaagaagggttaatgggaaggaaatgtcaggcatctgtagacacaaaattgttgttttagtgggatgaaaaactttttttttttgtataaagcacagatttacataaacagatatgcagtctatctgtgacagtgaaatttcatggggactgattaggaataaaatatctaaagaggctcctggaaggaacaataatgtaaaaaaggttgaggaacactgatttaaagacatacatttttcatattttaacatttctgaagttagaatggatcttaaaattgatggcatgtcatagtttaattttttctttcttagtggaacttacatactacacgactgtagttttagatttgctgaaatgctgtgtgctcccaattactgggagataagagaagactacctttattgtttgatcagggaaagctgacaaaaggtcccctcaaaagcagaagattcttgaacatgtaaaaaatgaaactatcaatgtttccctactttgttttgttttacacacgcgcgcacacacacacacgcatatgcacacaattttttttctttctttttctaactaaatgttttcatggatgaagtcaacattgtaccagttttctaggtcagaaatgtcacttacctataactttccctgtgacccagtcctaatggatttctaattgagctttacatctttgttgcagttgctcaccctcatccctttccaccctcatcccaaccccccagccacccttgcttccctgccccagccttccatctcatctctcttgcttccatctctggcttttccactccagccagtaatgctgctgccagacccatttgctttttatcacatcactttcttgcccccaaatctatggcaccttcattttgcccttttcattgtttaaagaaaaattgggttttacatgatagcagttatgtttactagctgttgataatatcatcacacttgaatgcagagcagtttctgggcaaggtttgatttcagtgtttttgtggtagcatttgctagactttatatttcttattctgtttcattctcttacagctggtcttggaagaacagggacattgatagcctgttatgtaatgaaacactacaggtttacacatgctgaaataattgcttggattagaatatgccggccaggctctattataggaccccagcagcacttcctggaagagtaagtatattgtccccattaccacattatatcctgttcttgatcctttctacctcttgttcccctggttgtggaccatgtcagcctgtggttataaaatggctgcattgttaagagaagtgtgtgcctctaatagaatattgttgatttgacagctaatgcattctaactttgtaccttttatatctcttagatcaggtgagagtgagaagaaaatcacagagccatctctgcctaccctttttctgtcattttctatgtgtgatctggctacagtgcaattttcttatgacatcccacttggcacttttcattcttttcttttgtttgcatgtcttaaagcataatgagaaaaaaaaaaccacaattaaggtcactcagtgattttggtaagattgctgctctcctgacaactaactaactaaactgctaatgtaggtacaacttatgaatatacccaagaagttaccacagaagaaaaaaggaggagaactgagttttagttctggctctccactaactagctttatgaccattatttagaagaatacttatgtattcactcattcatttattcccacagccattcattcattaactttttgtccagcctcagcccaagagagagagatttaacctgtaggacacaatcctttcttcttagaatgttagaacgtatctcaatgtactcattaataaaacaagaagatgaagttagtactggttgatctaagtccagctctaaaatactatctattagtgatatcttttactgaaatttcatttttttttctttttatgctgggttgactctattttattttaattttaattttttattttttgtagagacgggggcctcactatgttgcccaggctggttttgaactcctgggctcaagcaatcctcccaccttgacttcccaaagtgcagggattacgggtgtgagccactatgcctggctgatggctctcttttgaatagcattcttttccatataattatttatttccaatttaaatataattattcctttccagttttaatgatcatgatcatgtgtgaattcgtaaagaaatgatcatgaatttcataggaagatgccataagtaaactcttagcatctgaaatgattaagaggatttgagcctgctgagggattacttactttagttgccagtcctagaggtaataactgattaagaagtgctgaaaaatgagtggttatactttagcttaaaagaatgatgcagatgtctaatgaatgcattagaaaaaatatccaaggacaggatcattacaaagacagggatttctctctttttacccgtgaggtacaaataagataattctgttattttggagctttattcttgatcagattctcattgtcttcctctatttctctgttttgcattttatgtgcctgtagcctggagctttgtgccatgtatctgccaggttctcattatactaattgctgaagttgaagaaatggtcttagggttaaaaaaccaaatactcctaagcctagttctttaagccatttaatcaatgtcttaaaattattgcttgtcatttaataggtattgctatacctattgccccaggcattctgctaagtacagctcgcaaggtgaggagatatagcagagaattctaccagtcaaggtcacctagctttctcagggtgtcagataacacagccctcatgtttcatggctgcatactccctccaacctccctattatactctttctctctgccatatctcaaaatagtaagagaagaaattagagttatgaggcaaaggcactctaggctgaagaaaggcttttaaatttatagatacttaagctgtatataaagaactctcaaaactcaagaaaacaacttaatataaaatgagtaaatgatttgaacagaaagtcctccaaaatgatatacagatggtgaatattcctcatgatcataaacacagagttcttaaagaaacattgcatatcaaatccagctgtataaaaaagatagtgcatcatgaccatcatggctcaatattagaaaatcaatataattcaccaaattaacacaaaaagtagaaaaattatatgattatcccaatagatgtacaaaaatttgacaaagtttagtacccatttttaatagaaactttcaataaactagaaatagaaggaaatttcctcattcagataaaaataatctatgaaaactctatagctaaaattatatttaatggtgatgcttttcctgtaagatcaggaacaaaacaagggtgtctactctcactacttctaatattatactggaaatcttaaccagtgcaatgaaaaaaaaagaaagaaaaaaaaacttagaactaaagagtgaaattagtaagattgcaggatacaaagtcagttttcagaaattttagcaaaattttaaaattctgctaattaaaagacacacagtatatatatctgacaaaagacttgtacacatatattaaaaagtataaataagcaattttaaaaattaatttttgaatgggcaaaagccttggccagatatctcatagaaggtaatatatgtatatgaaaagatgtccaacatcattagccatcagggaaatagaaattgaaaccacaatgagatactattttatgtcaaccaaaatggcaaacaaaaaagaagttttactacaaaatgctggcaaagatatggagcaactggaactctcatgtgttaaccaattggtgtataattgtttggccatttctcataacgttaatctatatttaactctatgacccaatgatttcatttctaggtatttaaataagggaaatggaaacatttgtctacaaagacttgtacaagaatattcacagttgctttattcatagtagcccaaaattagaaatcatccaaatgtccgtcaacaatttatgagtgaatatatcataatatgttcataaaatgaaatactagccagcaataacaaagaatgaattactgatatactcaacatagatgaatatcatattattgtaagaggaaaaaaaaagccagacacaaaataatacatgctgtatagataaagcccaagaacaagcaaaaccattctgtggtgatagaaatcagaaagcaattgcttctgaggtgtgtcagggaaaactgaccccccaaaaaagcatgacagaactttctagagtgttggaaatgttctgtatcttatcttgggttgtgtttacacaggagcacaatcagttgtaattccatatactagccttaaacaattagaaaataaaacctaaaaaattataccatttacaatgtatctggtaacttcaggttagagatgtgcaatatctctacacagaaaaccgaagaattttttttattgagagaaattaaagaagatataaataagtgaaaagataaagattatcttgaataagatcaaagctggaggatttacactcccagatatggattcattttaaaactgcagcaattatgatattgagatattggtgtcaagacagacaaattaaccaatagaatagaatataaagtgcagaaacaaattcaaaaatatacagacacttgatttatgataaaggtgacatgttagagcaacaggaaaaggtctttttagtaaattctgctgggtcaactggatatctatatggggaaaaagaagaaccttggctcctatctcacaacctattttttaaaggaattcctgatgagttgttgattcaaatgtgacagaaaaatcagtgaagcttctggaagataacataaaataatgtattcatactttgaagttaacaaagatatcttaagtggtacatggaaagcattacctataactgagttgaaattgtaaaattctcttcatcaaagacactattaagagagtgaaaatgaaaaccacaagagtaggagaatatttacatcacataataatgggcactgtacttgtacccagaatacttacactcctacacattaacaataaaaagacaatctgataaaaaatgtgtaagaaacatgaaaagacatttcatagaagagaatgtacaaatggccaataaacatacgaaaagcgattcaccctcattagctatttcttatcttttggtacagctatctgttggagatatacctgtgagtggaacagttgggtatgtgtgcattcagagttagaattattaaacagttttccaaagtagatatgcctgtttatgttctcatcagcaatggtttgtcagtctcttaaatttaagccattagattttttaagtgataacttgctttatagttttaatttgctttttcttgatgactaaggtcaatctttgtatattctagatactagtcctttgtctggtaaatgtttttcaaggtttttttcagtctataacttgtcttttcatcctcttaatagggtcttttacagaataaaagttttaaattttgatgaaatcccttttatcacttttttctttttgatattgtctgagactcttagtttagccctagactcaatgatttctcatatttttttttctaaaaagtttatagttttacattcacatttaagtctgtgatggattttgaggtttttgtttatttcataacgtgtgagacttaggtcaagcttctttttttttggcctatgcatgcccagttgcttcagtaccattttcgttgaaaattcagtttctccactgaattttttctatagcagcatcaaaaatcatttggatatatttgtgttgatctatttctttgttctctattctgttccattgacctatgtgtctccttccttcaatgccacactctcttgattactggacctatatagtgagccttaatattggaagagtgattccttccactttctccttgtttaacaaaatattcttagcaattccactttcttttccttttcatatacattttagagtaagcctgtctaaatctacagataatgtttctgggattttaataggaagtatgttaatcctctatatcgatttggggagaattgacatctttactattgttgagtcttctaatccataaacatgatatgtcttttcatttatttagatcttctttgatttctttcatcagcattgtgtagttttctggatgcaagtccttttttgttaaatttacacctaagtacttatttttttttagcaattataaatggtatttatgtccatatgttcattgctggtatgtagaaatacaattgatttatctttttctttctttctttttttttgagacggtgtttcactctttttgcccaagctggagtccaatggcacgatcttggcttactgcagcctctgcctcctgggttcaagtgattctcctgcctcagcctcccaagtagctgggattacaggcgtgtgccaccacgcccggctaattttctgtatttttagtagagatggggttttaccatgttggccaggctggtcttgaactcctgacctcaggttatcctcccacctcggcctcccaaagtgctgggattacaggtgtgagccaccctgcctggccacaattgatttttctgtttattttgtatcccgaaacctaggagttttatatgggagtgtgtgtgtgtgtatgtatgtgcaaattcttggggattgctttttcatccacaaataggacaattttattttctttctaatctatataccttgtgtttccttttcttcccttgttggacaggctaaaacttccagcgctgtgatgagtaagagtgataagagcagacatccttgtcgtgctcccagtcttggaaggaaagcatccaggcattcacctggattaagtatgttaattgaggttttctatagatgttctttatcaggtcgaggcggttcccctctatttctgtgtttctgagggttcttatcatgaatgagtgttgaatcttgtcaaatacttttttggcattgattgatatgatcacatgattttcttcttaagattgttaatatggtagattgcatcgattgttttttgtatattgaagaaggcttatgtccctggaataaacaccatttggtcatggtgtgtaattctttttatatattgctgaactctgttagttaaaaatttttatgtccatattcataagtaacattggtttgtagttttcttttttttgtctgttttgtctgggttttgtgtcaggataatactagtttcatgaaatgaattgggaattgttcttctctgtttcctggaagggattgtgagagctggtgtgaattcttaaaatgcttggtagaattctccagtgaaattatctgggcctggggatttctttttaaaattatgaattcaatttccttaatagatataaggctatttgaataatccatttcatattgggtgaattatggtagtttgttttttgaggaattagtccgtttcatctaaattgtcaaaattatgtttgtggagtgtgtttttttttttttaaagtattcctttatgtttgcagagcctgtagtgattttcttggcttcatttctgatgttagtaatttgtgtatttttttttccctttgtcagtctccctagaagttggacaattttattgatattttcaaagaatcagctctttgtttcattaattttctccttatatttttgtttttaatttcattggttcatgtttttatatttattatttccttctgcttccttgtagttttcagtattttggcaatgtgtctaggtgtggatttcattggaattatccttttttgaggtttactcagcttcttgaatgtttaggtttatgtcttgtcaaatttggaaggttttcagctattatttacttaagtgctttctcaaccctgtcctctttttcctttccttctggaactctgttgacatgagtgttaggtttttgttatagtcccacagctctctgggactctcttcatcattttatttttagtttattttctcttagttattcagattgggtagtttctactattctatcttcccctttacaaattctctcatctctccattctgccatttaacccactcactgaattttacattttggttatatgctattctaaactttctgtttggttttctttatatctatttctttgctgaaacttcctattttgtcagttgtttcatgtgtctttgtaattgtttgttggggcatttttatcatggctacttttaaatctttgtcaaattattctaacatctctgtcatcttggtgttggcatttagcgatcatctcttttcattcagtcaatgtcaatgtgagaaaatgttaacctggacattttcctagtatgttgagactctggatcttactaaaacattctgttgtatctggcttcttacactgcttcagcagaggaaggtggtggcagctgggttggggggcagggggttgccacattgctactaccaggtggaggcaggaatctggattctgtactcagcctctgttgatgtccaaggctgaggggcttcttgttgctggtgggtggaggtgggagttctagttttccatcgggtctgcactgacactgtgataggggtcaccttgttactgaagggtgttggtgaaagtcttcactctccactaggcctcctgtgacaccactccagctgacagaggagggttgctggtcactgcctggttgaggtggacttccaggttccaccattactaccttagtgaggagtggggccgaaattgggggatctcattatctgactcccaacttagccttctttgacacttctgtggcgagggattgacaaagggtaaaggggtgcctacctatagcctggcagcgtggaaatccaggatcccctctcagtctttgctggctggcagggttagggccacagtttatttcctgtggggtttggctggagaagagcagttgttgaaatgttttgttgtctactaggatacccttttcctgttcctttgactagacagagcaggcttttcttcgggctttaaaaatatcagctctgggctgggcacggtggctcatgcctataatcccagcattttaggaggccgaggcgggcagatcgcatgaggtcaagagtttgagaccagcctgatcaatgtggtgaaaccccgtctctactaaaaatacaaaaatcagctgggcatggtggcatgtgcctgtaatcccagctacttcggaggctgaagcaatcaattgaaccttggaggcagaggttgcagtgagccgagattgtgccattgcactccagcctgggcgacacagcaggactctgttgaaaaaaaaatcagctctattggcatttttgaatcatatcttcttcagccctaagactaggctatataaggcaaaaggaaaactcgaggaactcaccaccatttcgttacttaggtctcaaggttccaaccaatctgcctttttcttttctatttttcagagtcttgttttttttttttaaatatatataggattttaaattttacttatgggaagaatagggaaaagtacatctactttattttccagaaatggtgttattgccttatattttaaggtaattagtctgcctataattttcggcatgaaatctgctgtggcagtctgaataatgtctccccaaatacaggcatattttaatccctgtgaaccagctgtgaatgttactgtatatggaaaaagggactttgcagaagtgattaagttaaggaagttgatgtggggagattatcccggattgtttgggtgggcccaattaatcacagtgtccttagaagagggacccagggggagccatttagaggagaagccgatgtgatgactgaaacagattggactgatgcattttaaagatggagtaaggagccataagccaaggaatatgggcagccactgtaaattgaaaaaggcaaggaaacaaattatctcctcaaagcctccatatggaaccagctctgcctactgtcactgctttagctcagtgaaactgatttcagacttccaactccagatctgtaagaaagtaaactggtgttcttttaaaccaccacatttacggtaatgctttacaatatccataggaaattaatacatctgctttgtatagatagcaaatatgtacagcaggagatgcagatcctagtgatgaacatgcatattctgaacttctcttattcatcatactttctaatttggagtatttaattccaaatactccaaattagaaagtatgatgaataagagcatatagaggagtcgtgtgacttaagtgttatttaaggaagcttgagttgcaacaatgtgtaagatgaattgggtggatggagattggaatcagagaggctaaaaaggaggctattatcatccatctcagagagacaaggacttatcaaaagaggatagaagttggactgaagatttagagatgggtaccagggacatttcaagaaaaaagaaaaaaacaaggctttgaagactaactaatgatcagagagatgaagagtatgaagtcaatgatgacgcaaaagcatgaataagtaacgtgttcattaagcaagaaataagagggtaaaaacgttttctgttaggttttcacctgtcaaaaatgactgaacaagttaaagtgattgtattcttttaaaggtgaaaagtcaatcagtgctttttagagaatgttaattccaaatctctgactttagaaaggctggtttgtcatatcctcctagtccttgaggaccaaaatatgtccaggtgcttgattgccatgtcttaaacaagcagccctcttattcactggcagtaagagagatgtttattagcatccttttgagttgttgatgaatttacttattggctgacctctcctttgttacagtctgaaattttatatttaaacttttaaaggatataaagctctctatttgcaaaacaaccatcaggtgtttttcttctatttaaagctgaagttcttaaaccaaaaataccattctgaatcccaaatgtgtcttctatcaaacatcctcaaggttcttaaaatgatgtaaaaatacatctttttgtttttgagccaactctggactcaatgtcctccgagacaacctttagaagtataaaggtggagtcaggctgcttttacaacttggttgattctatttattgaacatttgctgtgtgaatgttcccctgaccttgggtatcattatctatctgtgatagataacctatatcacagatagatagatctatctgtgacagataacctatatcacagatagatctatctgtgacctcggggatcatcatctgttaaagctttcattcattataaagggatcattgagggactagtgtggggctcccacggggattttcagctcacggagatcctttatttatgggtctcaatatggcattgtttttgttttacatttccttctgagacagagagaactcacataaagcctaaatctggctcttgcaggaagttttggctctgtaaagcagagcttccattttgaatgaggttatctttatgaagcacagtattatggttgaactctttttcattcttaaatccataaatcaaaaattcccctgttctactttattacaatagatgttttcatcagcttctactgagttggatattttcagaattctaactttgttgcaagccttccattgtcttcagtgcttctcaaacatgaaaatgcctaggaattgttgggggatcttgttcagtgcagtctctgattcagcaggtctgaggtgagacctgagagtgtgcatttctaacaggctcccaggtggtgtgctgctgctggtccctgaaccatattcaataacaagggtgtttggctcatccttactctgtaaatatcaacttaggctacatcttaatttggtgccaatagtatttcgtaagtttcacaattggattgagctagatcagaaattaatagttaaaccattgcttttttatttcaggaattagcaaaaataagatgaaaaacatctgtttagaaaatggaaaatgcttgaaaaagtctaacactaatggtttgagttttagttgagattgacttctatcatttccttttaaaaaaagttaattcttttttaaatttcaatagcttttgggatacaagtggttattggttacatggatgaattgtatagcatgaactccgagattttagtgcacccatcacctaagtactgtacattgtacccaatatgtagctttttaatctctcttgtccccgaccccaccttctgtgagtctccatagtccgttatattcactctgtgtgcctttgcatacctgtaccatttccttttatggttttcttttagatacatgcagtaggtcaaggaatataggctaaaaaattttaattatttattttaagggtttaaaattttgtgtttcctaaaatacagaaattataatctgaaatactataaaaatcagaatttaacaaaacaagatacagtgttttattagaattacaagcatactgcataggtttgagtttacactatttactgaaaatgacatttttgtagtaacactcaattatagaattttctgattttcaacagttactgctgcattatctgatccatttgttgactgccagttgatactggaactactgactaagcaaaaataaaatcctaatatgggttcaagtattaaggataattaagtatgtatcagaatctttggcagtggttgcatcagaaatttattattaaatactcatgccagttattactctagatagaagactgactttttaaattaatgttttattatggtaaaatatgtataacataaaccttacaattttaaccattattatatgtataattcagtgactttatatatgttcacaatgttgtgcagccatcaccactatttccagactgtttcatcattccaaacagaaactttgtacccattgaacaataaatcaccattatctccaccccctacccaagtccctggaaacctctattctactttctgacattatgaatttgcctgttccagattcctcatataaatggaatcattcaatatttgtcgttttgtgtctggcttattttacttagcatatttgcaacattcatccatgttgtaacatgtatcagaatttcttttagaggctcaataatattccattgtatgtatatatcccattttatttatccattcatttgttgatggacgtttgagttatttctaccttttggttgttgtgaataatgcaactgttctgaacattggtacacaagtatctatttgaatccctagtttcaatgattttgggtatatacctaaaagtggagttactggatcatgtggtaattctatgtttatctttctgaggaactgtgaaactgttttcctcaacagctgtgccatttttcattcccaccaacaatgcacgaggggtccagtttctctgtatccttaccatgaatggtttttgtttattttgttttgtgtgctctgaataaaactatatgaaaaaggttagagatgggggaaaaggtattgtaagcagtaagaaagtaagcagtgatatattaggcttagttatgaagtttgcattttggcatgacactccaatgatctagcttctgattgtagggttctatacctaaactagatttagttagttgaatcttttggagaattcccttcctcagttttttgcttctagcttcattttctagtatgtttcacaattaactgccttcccttatgctttcagaaattctctaaacatcttcctagtgaatcttccacttgtaccacagcatttgaagaactccttgaatacctgttgccttcccgccccctgcatcttggttactgcttcccatctgtcttcctttgatagcaaggtagaccattttgttagcccacttctttaggccaggaactgtctctgtttccataatagctctgggctggtggaatagaaggtacacaaaacagattggtactcaagtcatggctagagtaggcctaggccaagctagagagtgggttatgtttctatttggagtgaccaaacagtggctttggatggactttggggtcagggttgagttttttgggaaaattgtccaggatggaagaaggataaagataaagagttcggttggtgtggagatgggattgggctgggcttagggaagtgaaggaggacaggtcagccacacacagaagcctgcacaacagcttccattgtgttctggactcagaactaggaatattcactataacagtgtgactgacttgaatttcattagaggaatattaaaagcagatgtaaaaaaagacctgtgaaggctctagatcagaatcaactgtaacttggctcataataagccaagttatttcgttattttcttatgtcccatgcctggctagcctaaacccaactaacccagggcaaggacatggctgaaaacaaggaccccagcactggctatacttcttaaggctctattcaaaccaagacacatctcttcctgtcattttaaagcacatgccctttttagcagagggtcagtaaatttcatgctgtcttagaaaatgcactatattcttggagaatgtactttgagctggtgtgttggcttcataagatttgatttttaaatactaaatgcttaaaaatacatgttttacttcttttgtttgagatgaggcttttagggagtaatagacaccacaataaaagctagcatggtttgcattttcaataaaaaggaatttgcgtgaagtgctgctttttctcaagaagcacttgcgtacagcattgcttagcaacacacaaatcagctctgacaccttattcatctttaatattcaggttcaaatcaagcctttccagagatgggacagattgcgtctttcaaaccaagcaagtgaaagttgtcactttgtaattttcatctttaagttggcagcagcatcagaattttcattttataacttcttttgaaattggaatttttttcaactagcctcttatgtccttctcctctgttctcactttgttttttgttcctaaagactcttaaaaggtctttcctgtatttttggtatcaaatttaaattccttaggatgacatgcaaggcccatctctcatagcctctgcttcagccaaattaaacaattcatgttcataaacatgctgttttctttgatatcactatttttccagcccacattgttttctttgcttggcaatactcttagctgggtaagtcctgctcatctttccagatacttctggaatgttggggaacttctttttgattccatcagattgagtaaggggcctcttttcctgaggtcctgtgcaaatcctgatcatagggtttataatatcggacttcatttgtttgcttttctcatcctaaactagaaatcccttcttgagagacagggattcagtctttcatccttatatcctgtcctacctgtgtgtttcatttatctgaatttcttactatttatgacagagctgaatcttctctttttttaaaatcatgatttttattcttttcaacctatctctctctctctgtgtatatatgtatatacagagagagatatcgaaagatatagatatctatatatatatttttttatactttaagttctagagtacatgtgcacaacgtgcaggcttgggaggctccatccgtgttcccataaatgacatggtcttattcttttttatggctgcatagtattccatggtgtatatgtaccacattttctctatccaatctatcattgatgacatttaggttgattccttgtctttgctattgtgaatagtgctacatgaacatttgcgtgtatgtgtctttatggtagaatgatttatattcctcaagatatatactcagtaatgggattgctgggacgaatggtaattctgtgtctcactctttgaggaattgccacactgctttccacaatggttgaactaatttacactcccaccaacagtgtataagtgttcctttctctctgcaacttcaccagcatctgttattttttaactttttgataatagccattcttactggtgtgtggtggtatctcattatggttttgatttgcatttctctaatgatcagcgttttaacctgaattttatgtgatatgtgaaatctttgtgagaaagtattactcaatcctgttgctttaaaaaatatctatgttcttactggtggcgtctccttgatgatgcaattatttcactagatgttgatattttttatgacgaaccacagtgtttttagtttaattctattctgtacagtgtgttataggatagaaataaagtgattttatggaatagtttatcttataggaaatgtatgaaggtgatcccaccaataaaaataaaatcctcagaatgtcattttgcttacatattttaaattatcttcatataactttgaaaacagttgtgattttgccttaatgaatgaaagaaagtttatacatgaacttcaaacacattttcttttctaaggacaatctaattgaggatataagccttgcttttagattctaagagtaggtttttaaagttatgtgtgagggcctttcatggtaccacccaaaagtaggtatgcaatacttttttgggtaatatctccatttaactcaagttctttcatgtacagttttgagtccagttattctctctgtttttataaataggcatatcaaattgctatttgagaaattgaaggtttcaaatttatatttaaaagacaaatgggctcataatctttattgctgtggaatttgttctaagcatctgaggacttcagcagtcaactatatagacaaatattggaggatgacatttgtgtttaatatagaatcttattttggctttttgaaagtgacttcattgttctttattctaagatatcataatctttctagtctgatttgtaaatgcttatttgctaaatcttttcctttataagacatcatacctttgagatgagagtagattgttttaaagataactttttcttgtcgttttgttttgttttgttttttatacagaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggtaagttttccctaggagattctatcttcttaaaactgatgttctgcatttgtttctcagttggacctatataacatagcagtgtcttttctctggatgccacgagtaccaagtttttagaagtagagccatccgtctatatagcaagaagcagaggaaagaaaccaattgcccttaaaaaaaaaaaagctataatttaaggagtaaattataaaggaggctactctggtaaggggtaatatttatagaaaggaaacagaaaagcaaactttctatttgaaaattaaaataaatatcaagaagaaaaattttaatgtgacaattgaggaaataatacataccacaagtggtgctttgaaagcctcaaattcatgctgatttctaaagtaagtgccaacttgaaaacatgattagggcacttttttaaaaaaaaattaaggctctactgtaaacaaaccactgtaaatagttgatatatattgtctgattaatattcataactacctggtgagttaggtaatactatctctattttataggaaggaaattgcatatcagagatgttctaacctcagtgtcaaacatggttcaatccatgtctgtctgagtccaagcttgtgtttttttatatcacaccctgttacctctgaataaaaatagaagtgatttactaagaattaggattatgagcatttttggaactagaaacaacgttgaaacaccatttgtttggttccactattgtagagacaagaaactggggtcccagaaaatttgtgatttgtgtaaagttccagggttgtttagtagtggggccactttgacaactgggcattcaattcctagtttaggtctttctaccacgttatacctgaggtgaagctaagtatctggtttatacttttatatctttaaaggagaaaaaaagaaaagaaaaaaaggacctgttcaaaatagtggaacaagctaggcagcgtgatgtgtgcctgtgtggtcccagttacttgggagactgaggtgggaggatgtttgagcccagtggtcgaagctgtagtgagctatgatggcgtcactgcactctatcctgggcgacagagcaagcacccgtctaaaaaagtaaaaaagaaaaaaagagaaagaaagaatatagaagcaacaagtgtagatttacattctattagacagtgacccattagacccggacaagggccttaaaccaaatactgtggctcaagcttagcccacaaggagcccagaatggaaggaacacatcatagctctcttaggttaatgactggcatcccaaacagatttctttttagcaagaaagatagccagagtgcttggagattgggagcatgaattttctttcagggacaaaggatggagaccgttggaagaaatgatttttaagcccagtgctctgttctccaggatggctgctgatgaggtgactaagtttacccattcgagtcatctgtcctgatgaaatgtacaccttatccaaggtcatgttgatgttagagcctttgttgacttttctttgtctctgtgttccagtttcacctattaagagcaaataaaaagaaagggtctgaactaagattttaacatgataatatagctaagcaagaatacctttttcttgctctagtcagcatttcctccccaggttgagtacaagtaaatagggctttgagttatgaactctgaaaagacaaacataaagttaatcccgttatctgagaaacatatttaccttgcaggaacatagtactttctatatcataatcttgattaagttaacatctggtagttagaacgttttattctcatactcttttaatccccaatttgttgaatttaagaaacttaacatttatgtatcactgtgagggtaaggaatgcaatatgattggaattttaaataagacagttttaaatataagtgtatataagtctactcccccgtcttagtccatttgggctgctgtaacaaaacactacaggctaggcagcttataaacaacagaaatttatttctcacagttctgcaggttgggaaattcaagatcaaggcatcaacagatttggtgtctggtgagggcctgcctagtggttcatagacagcaccttctgcatcttcacatggcaaaaagggcaaacaaactcttaatgccatcaccttgtggggttgggatttcaacatatgaattttgggggctacaaatattcagaccatagcatcccccatcattattttagttttagccattgaaatgctattgtttctgaaattcaagagcagaaatgaaagaattcagagatgccagagaatgatggtatggtgaatattttacacagcatcatgtatgggccctaggactactttattagctagttaatggctttgtgcaagtaactcttacaagcacttttctttccatgcttatctggtgccagctctggaatatcacatgaatatggaaaattcgcttactcaaaattggtcttaacagagttaatgatgtctttattattcttataaattgcacatgggaaaatagattgagaatgctgtaagaatttaatgtgtttcaagttgcatgtgggtaaaagtctatggaatttctggatttacttagtttgtatatatagaaagtgcaaaaaggcagtattcctcttgagattgacttttaaaaaaaagattaaaagcagagattctaaattattattttctttctaggcctacagtaattttcttgtgattagttactaggaagctctgtattaccagatttggagaattcgaatagagttttttaggccgggcatggtggcttacgcctgtaatcctggcactctgggaggctgaggcagatggatcacttgaggtcaggagtttgagaccaggctggccagcataacgaaaccccatctctactaaaaatagagaaaaaattagccaggtgtgatggcacatgcctgtagtcccagcttcttgggaggctgaggcatgagaatcacttgaacccgagaggcggaggttgcagagctgagatcatgccactgcactccagcctgggcaacagagtgagactcggtctcaaaaacaaaacaaaacgaaacaaaacaaaacaaaacaaaacaaaacaaaaaacaaaaatacagttttttagtgcttaggatgtaggtgaaaggaaaacaaccagaatgttgcaggtcatagtgatggactaagttgtggttttactgaatgttctttgccaacttagagttatgagaaataaaatagaggcttcacctttattgagcctggacttcagtgctgggctgggcactatgaaatatacacagcccatcctgtgggtctaggttaggctccctgctccctgctcctgccttgcactatacttttcccccacagtcctcatgcctccttccctgctcggtgatactctctaggaaggcagagacttttatttgtcttcatcatgattctgtttttggcaaaaggccttaataagtattatgtgaatggatgaagaaggcttatagtttcagagaaaaaaaaaggacagagacatgaaattggtaataatctaagctacacaagtgcattatgtgctcaaatacaaaatagtactagcaataagtgctcactttaacatttaggggcctatgggtccattatggcttggagttattttaaaagatagaatttaaagtactttatttaaagtgcaaatattaaatcaggatcttagcatgaagttactgtatgccagtaactgttttaggcacttgacattaatgaactctattaatccttacagtagccatatgaaataggcactgttattaggcccatttacaggagacatacctgaggtagaggtcaaaccatctggccaagatcttgggtacatggtgaggtggtcatttgaacttctgtgctctggctccaaagtttgtgccctcagccaccctcccgggaggcctctcactatactctgctaactctctatgaggtcttcattgtggctttagtaaattatgtacagtaattttgagcaaaactgtaaccattccttactaataaacttcttctggaattacaacggtttttacattttgtctttctactctagggctatagtccaatattagcataccaatcagtagatgctcttgacttagtgatattaattagatacaggtgctgctaatattcagccaagttcatacaaattgacaatcaagtagacaagaatgtagtgttttaattacatctttgagacattgtgatttataaaatccatcaagtactcataagcagggtacatcttagaaaaatctatgaagtaaaaattaaatctctaatgtcctgctttttaagcacctttctttcccccattatgacagtgaagaccagttctaatctgaatgccattgggatccaccagaggttattaagcaggggagtgacagcacacagaatcatggtgctgagagatcactctggctatggtgtcatatagggctgagggtggaaggccagggagttggtgatggggaggtccaggttttaaaggacccaaccagtggcagtgaatggggcagccagaagagagatgtgggcagctctgataaattcaaactttttattgatcagaagcagcttattataaagatgacatctttgcctttccccagcacttacatctcataggttcaacatctgagagctgaaaagaactctagagatgacccagccacctttcctagccaatttattaaaatctgctaaaaattccattctcatctttatcttccagttcttggacttctatttttactcatttctatttaaactgtctatttatgtcatttttctattaggactcttccatctttattccctagtgtgctatattctatctcatagatcttttcttaatgagactttccacagcctttcctatagcttactgtgccacgattttgtttaggttttggtcagcaattactttatctagctgaaatctgtggacacgattgtgcatagagaaaacaactggtggaataaaatatttattcttcatgttgttgtttgttctttcactaggtcatcactcatgttttttttttttaattgtacttcttttggtacaatattttagtttactaagtgatattactaaaatatcattttcttgccttcatgtagggcagcccagtatccaaaaggaagagagttgctgcttaatcctccaaagggcagtggggcatctgagagcagacccctttcctgtgggggacaaagataggagggtcttccctggactaggtagggttcttcattgttgccagcatcagccaagtggttttgtttcttttcagcagattccagggaatctgcctctcctggactagcttaggacaagagagagtctgctctggcattttgtagggagatgggctggagcctaagggcagaatggaggcccaggttgggttctcctcatttgtcacttgtgaatgtgttctttagtcatcatgaagaatgaatctggtataaggaaggaggcctaacagcacctgatgagaaaagtcttcaaacactcccctggctaccaactcatgagattgatttgtgccacacaatatctgcatttgctaataaacattttcctcccacaggctcttatgacctggtacatcttatcggatcaatcccctaataaatataaggcttattatatttatgtctgtgtgtcttattcagtattccaggaggccaaagtccttttccatatagctttttagtttcttaattctgtaatttaatgtaaatatgttttgaataatgttactatttttcttgagtttgaaggctatttattaatcactgagaattttatagtttatatgttctatctctcatagtcctaaaaatgcccacactttgtacaatggccacagagaaaaaataaaagaagattagtttagacaaaaatagtacggtttacattttagtagattttttcagacctatattgcctgtctggatctttcctccttcttccctctccccaagtctgaactccgatgtggtttcccgtaccctaatccagtccatcatctctcatcagaccactgtatagccgcttaaatgtgtccctctcccgagtcttgacctccaattcattctcacagtgatcaatgggaggaaatatatgcaatatatgcaaatgaggggggtcgtgtgggtgtaaagaactcttacaaatcaccaaaatactatgtgcacaaataaaacaatatgggaaccctcctggctggtaaacataaaaaaattctacttccctagaaatggaagagacacaaatttaaatgatgagatgctatttatgcctatcaaatgtattaaaaatgtatgcagtattgacaaacgtttagggaatacaaagctcttaaacattgctagttggaatttacaatggtacagccttttggagggcaatttgatcatatgtggaagatgactttaaaaggaattccacttctatgaatttgtcttaaggcaataataagtcttcataaaccatgtatatataagagtatgtttgttgaggctgtttatagtgatgaaagacagagaacagcctaacctaggctatcggttaaataataaaattaggcatatctagacaatggaattttatggagccataaaacgacagagatttaaaaaaatttgccctgaaaaacttccactatatgttttttaagttaaaaaagttacaaagcagcatatgtatataatacaacctctttttgtaaggaagaagtaggttgggggttttatatagcacagggaaaattctggaagactgtgccagaatgttaatgtgtgttgcttttgatggtaaatatataggtggttttaatattttttcctgtttacctatactttattactaatgacaaacatatggtaaacatatctccatatatatggtaaatgcatatatatttaaatacataaaaatatatcataaatatatctgcatctctctctctctctctctctctctctctatatatatatatatatatatatatatattttttttttttttttttttttgagacagtctctatggcccaagctggagtgcagtggtgcgatctaggctcactgcaacctctgcctcccgggttcaagtgattcttgtgcctcagtctgccaagtagctgggattacaggcacgcaccaccacattcagctaatttttatatttttagtagagatggggtttcaccatgtgggccaggctggtcttgaactcctggcctcatgtcatccacctgccttggcctcccaaagtgctgggattacaggtgtgagccaccgtgcctagccagataccttttttttttttttttgagaaaaaacacctctgccctcgtggtcgtcaccaccgcagccacccgagaggagctggggaagaacagtggcccgcgaggctcatcacagacaatgcggtggctcctgtgagggtgtttaagtaaacttgaggggaggaagtaaaagtatgttaaatctgggtagttaagtgcatggctgtgtattgtagtatttttgttcttttctgattttgagatgtatcataatttacagaaatatttgacctttaagattcacaatagaatgagagaaaaatacatgcaaagtaattataatttaaaatgtactgttatttaattttctgtttaactgtatatcttttaaaatgcttttattcttttcaagcaatatatgatcacagcttaaaaaatatcaacaagcgttgaattctagcaacaaaaaatatcagtctcctttctcacctttctgtatctctggacccacttccaaagggggaaacctctaggaaaattatactattatttttagtgccatatttctattataaatactttgcttatgttgctgttttttaattgatcaattttggacatttttgtattgcctcctggttgttgtagacaggatgcagctcttctagctcactgtcaccaccacttcccaatataactatattcgttaaatcaaataatgtgcacattattactatgtaaacattgttcacggttgagcttagtagtacactatgactgttttcttttttgacgctctctttgtgtgtcctagacttaattgcctttttaaatttgcatagttttctatgcatttaggaaaagataatgctttaaaaagttgtgccaaacaattttaaattttttcaaaatttcaacacagcaaaattccattctaattccattcttttcctgaagacatttctcccttctaacttggactggttgttcttagccctgctgtgtgtgtgtgtgtgtgtgtgtatgtgtgtgtgtgtgtgggtatgtgtgtgtgtgtgaagtcctaggatcagaactatatagcctgattctataactcttcttcatattcttcagttagatccctaattttcttggatctcatgttatctttccttttttcctgaagagcatatcctgtaatagttttctcagaaagattgtatgggaggtaaatttttatatctgttttacctttatacttacctgaaaggttgaattttagaattacaggttgagaatcattttatatttagaattttgaaggtgtttctagtgggaaacataaagatcctcctagttggaggaacaaataagctttcctggtacaaaagcacccagttgacaatgaaactgattgtggcaaggattctgtcaggtcctcctagaagctttcttagccattctcatgaggacctatgtgttttttggcctcacctcatattcaggaaactctggctctgtgctaagtaactgctaacatcccagcacgttgagtcgttactgcagcctagtgaagctaagctcaccttctcaggtgcaccatcccactggcaagcctagctgtcagaccttcctgatttctgttcttgcaggcttcctttgatggtaataagttcctcccccattggggttgtatggatagaactgaatggtaaaactgatttctggagattttttagaagtgcaacttgagactctaagagaatcctctgtcatgaagactccatgatcctgtgactgttgagctggtattcttgcacaggacgacctttcctgggatcttgggctgcgtcacttgcacccattctttaagggattgcctctaggaagcttttgtccttattctttctttcccactggccttgtgctttgcatttctttatttcttttttaaactcagagatgtgatggtgaggtttgatctttttactgtggaacccaacataggtggccgggattgaggaggtattgcgatgagaaatgactcaaatgtgacttgatggaagtacatttttcatcaaacaagagttctagttttaaataggggaggggactattacggctgggagggattttagcaaatccaagcactttgatttttcagttgaggaaaaaaggcaaaatacagtcttcactggtgcaatgacagtgtgctatggcatatattttagaaagaacattgcatcttgggacaagaaatctaattttgaagtcacacaaaggtcattaagagcttatgggagcttgggcaatattcctaacttccatgagtatgtccttttttcatcgataataagggtaccagtgcctccccctgcatcagggctattgaagagactagcatttgaagagactagcatggtacttctatttttcaaactttaaagagttatttcagaaggtaagatctagtgaacatggtcctttaaatccttctgaaaagggcttgtgtgcttttactagtgttacatgattactgtgttaataacttactgtataaatatcctaaagtatttttatcttgtatttttgtaaacaggttatggaatttgcagtgatgggtcctggtagtatctaaaaacatatttgtactgcatctgtgggcccttctgtatctaggctatattccaacgtatgattgtgtctgcaggagagtctcctctgttgctgtccagtgtaacaaacagctccttgtatattctaccacatctattcccatgcttcattgatttggaatttgacttgttgcctgttgaactggcaaatagttgagtgttcttttgtgtaaactttgacaatgctgattcacagtacctttagtgacttaatctatattaagataatctgtataaaatgtatctatatatgtagtctgttaagaaacctatataaagccaaattttgacctttctatggaacgtgtatttttttccaggataacttagaagatgatgatgtggaaatgaaaaatggtataacccagggagacaaactacgtgccttaaaaagtcagagacagccacgtacctcaccatcctgtgcatttaggtagatctgttttaaacacttcaatttatagtgtgcttccctttgtgaatagaacatttcatcttctctttaatctgtaatcttctgttttgaattttgttctacaaatactaagtttactattttgtgttgtttattgattattttatcactgttgggagtagctaaagtttagaagtttattgaaagcaactgctgccatctcagtctctggaattctaccttaagctgcaaagcagttatctctgggactctgtttcaaattctgtttggatttctccccttctgctgtgaatgagtttcttgtcctgtgttggatcctcacaggtgtgctgaggctgttgtattgactcatagtgtatataaaagtattgtatgccagtctctggcaatctaagctagttcctcagctttaccttctatttttgaaaattgaataagcaattcttacctgtgcctgtaaagttataagccatcttgactttgaagtctcaaactactcaccagaatcaatgatgggacttgacttctgatcacatttgaaacctgctgatagctcagattgggtttaaaaaaaggggaatcaaaaggtgcaaacgtttgtaaatatcatcattttttaaaattacaatatactgggtggcaaggccccagtccacaaattaatataatggtaagcagcaacatttttttgacttataaataagagatacacatagcagaaggatgttttgccggtatggtaaacaccaaacagattcacagggaatttagttttcatgtgtaatctgggagaaactataacactgtagtcagattgggtctttactgagttcctgatctaaggaataaaggttcatattgctcaaagatgaggttatcattttctgcagtattatgagaaaaggggatagcaagcctggttctgggtagtctaatatccatttgcaaggtttctcccttttgctaatttaatatttttactggtttgataccatttgatgtgccttgtggtctttgtgaaaacgtgtgccctggtgatatgtgagcatctgtctttgatttccgcaggtcagatgatacaaaaggacatccaagagcagtgtcccagcctttcaggtactgccaatgaggttgaatgtctagtagcttgtaaatatatgcttccttttagccatgtttcccaagcctcaaacacgaaaatcaactgtacacagctttttgctttttaaattgcttcctttctcttccatattgtttatgccttatttttaatgctcaccatgaaaaggatttttttttttttgctggcatgcccacaggactgtgtggtggtggtagagacatcaatgtattttgtgctcttagcacattgtggaggggggtctctaagaaactacaggtgctctgcatttctccttttgatctagtgatagatctagcttaaattgttttcatttttattggtcctctttctattttttcccaatcagcatgcatttgttcccctcctttattttctagtcttattttcttctctaccttccttttcaagaggaaacactagttttgttctgtggaaaaatgtcccctgaaacctccgggagtggtaccacgatctggtgtggcactcagtgagagcagcagagatgtttggccaagagtgttgatgaaataggggaaagaagctcttcacctgctggttcttattcattcttaggtttaggactgtttagtgagggcagttcaaagagggcttaagcttctggagcttctggagaagcttgaattgcttctttgtagaactttttccatttttattttggaggcaaaacatgagcttaagctgctgtttggtgggtggataatgaagaaaagagtctacaagtaaataagcttttctctagcagagaggaaaacagagttcagctatattaaatgatttatctaggatcaaacagatttggtattaagattatgactgggccctggctctccagatttgagtcagtttttcctttttgtccacttggcaaatatttattgagcacctgctcagaatccagcattgtgctagccactgggaattgaaatgagagagaagtctttgccctcaaggagcttacatcaggtaacggagatagacaaatatcagatgacgcaatatggtataagagctatgatttactatgagaatatatgatgaaacatatattgcttgggaactcagagaaggcttgcttgatgaggtaacagctgattggaccattaaaggctaagtgtgatagaagtgggtcaaatggacatggaagataagaggtagaggatgggaaggagatgagaaaatgccatggcagggaaatagtctgtgcaaactggacaaacgtgtggacgctacccattcagggaactcaaggcattcttatgtagctggaatagagatgtccaatgggaaagtgtggaaagaaggacctgtccagattttggaggggctgcatatgccaagccaaagagtttctataggcttgtgggcacagaggaaagatgaaatggtttaaacagtgaagtgacatgattcactgaaggctattcacaatttgaattgtttaggaataagattaaaagatgccacttgtagtcaaggataagaaataaagatggcctcgcctagggtagtttgcagggtgaaaagaagaggatggatttgacatataagaagtggaatctaaggttgtgctgaggaatgaataccagtggcaaagaagggcagtggcccaggaagacaggatcatggctaagagcaggactttgactcctgggtttgaatcccaggtctgctgttcactaactgagtgactggatgaggaacttttcctctgtgtttttgtttcctcacttgtaaagtaaggacagcaatattagctacttcgtagggttgttgtaaggacaagctgagctgacatctttaaggttcttagaacagtgcctggcagttagtgctgtgtcagtggtggctgccgctgctgtcatcactattaggacctgtcatgatatctttaagattgattaatttatcttgtcctagttagttgctgaatgtttaagataagactactttattgtgacactttgccatttttctccgcaaagattaagttcatccctgcaaggatctgcagttactttgaagacatcaaaaatggcactgtccccttcagcaacggccaagaggatcaacagaacttctttgtcttcgggtgccactgtaagaaggtaatttttctctccctcttctaaggtgctggtttgaggtaaaggaagcttgcagcaggcgatgagtttagctgcagttttgtcagaggaggggacaagggagaagaggagaaaccacggaagaccctgtgatgttctggggcttccgttcctgtcttgggaaggcaggagacaaggttgtggagggaatggtgcaaagcgtgctcttcttctagagagtgagcagctggcttagtgtgatccagaaaatggagttcagttgtatatacaaatgatattgtcatttctcagctgacacgtataggcaagggagaactaaccaaaatgggtagggatgtttgatgtagtcatgtgattgaatatgtacttaagtctgcttttaatgctccccttacatggcccttttcctttacttcccaccccagggtaaataaaactctgtgatgttctatttcaagatctgtagtcaaagtgttttagccagtttcttgggtcctagttaactgcttttgacaaagcaacttgatatgtataactcaaggctacatattatcataacaccaagggtgatgaggaagccatcctgacatcattcacattgatcagattcatcttcatcatgttcccctaatgtcatgagtatgtgttttagaaacgtgagctctgtgtgattgtacattgttgtctgttttttccctcctcacttgtgttttccattcagcttttccataaactcccggctagccagttctctagggaacttgaatgctgcaacagatgatccagagaacaaaaagacctcctcatcctctaaggcaggcttcacagccagcccgtttaccaacctcttgaatggcagctcccagccaactaccagaaattaccctgagctcaacaataatcagtacaacagaagcagcaacagcaacgggggcaacctgaacagccccccaggcccccacagcgccaagacagaggagcacaccaccatcctccgaccctcctacaccgggctttcttcttcttcagcgagattcctgagccgttctatccctgtaagtgcgcagacaccacctcctggtcctcagaaccctgaatgcaacttctgtgccttgccttcccagccgaggctgccaccaaagaaatttaatagtgccaaggaagccttctgagcgatgccttccctctgtgctgtgaaactgtctatgcactacattctgctagctcctcttcaagtaaacgccaagtcacaactgggttttcttccttccttctttttcttcttacccccaactcctttttaagtagtttctcttaaaagggaaatagctttcattcttttgattatgggcattgttgacttcagttacttttcagttatgtttccaatcactctgaatatctggtgctaagccaggagctgattcatacagtggatagcatttgctgggggtgcgctggtttggggaattatggctttttccgcatcatatatcagtgaattaattttggagtattgaaacgtggaaggtgctgagtgaacagtatcttcctagaactaagcattaggcccttgaatatttcacctcctgcaaggaactgacccagaataaaataagtggcaagtggaagatatttctaagaagggcttataggtaggtacctgggatgcaaggtggggagcaagcagagtatcaggaaggtgtttaaaagtagccagcactcttctagagaaaggtgggaagacctccaaacacatcttaccaatgagatctctatttaggttaccaagctctctttaacaatcaacaatacctggtaaggtaaactctgttggtaaactcctattatgaattactttaataacctgttttgattgcctctaggggtattgagatctataggaatgtgagtttcgacttgagaggaacaaggacaaataggaaggagaaatcaatcctatgtattaaggaaatatgaagcatggtacatatacatacagtgttgcaacactgatcgtactcagggcatgaacaagccctgggtgtcttggaaggctctggcctggtgtcgcttcacacttgctattcttgaaacatttcctcagccgtcatctagggagtgcctgcttctgtagagaagaggggaggaggaaaggtgctggtggcagtgtgctgcgtatggcccactcagcaaaacaggagccccatggttcattcttaatgatatctactttctttagttgacagtttagaaaccatgaggatgggccaggctcagtggctcatgcctataatcccaggactttgggaggccaaggctggtggatcacctgaggtcaggagttcgagaccagcctggccaacatggtgaaaccccgtctctacaaaaaatacaaaattagctgggcgtggtggcgcgcacctgtaatcccagctaccataaggcaggagaatcccttagaacctgggaggtggaagctgcagtgagccaagatcgtgccacggcactccagctgggtgacagagccactctcaaaaaaaaaaaaaaaaaaaaaaaagaaaccatgaggatgaggatgttttctaacatgagaatgcagtgtgtgtgtgtgtgtgtgtgtgtgtgtgtgtgtgtgttcatgtgtggttgcattagattcattaccactcctgtccctacctgagacctcttttaaaacttttaccctctctgtccactctcaacccattccctaagaggagcctggcatatctgatgttccctgtcctattttacaggcatgagccaccatgcttggccttggcattagtttagattcttttacagattagggtcccaggaaattgccagcccatctaccccttaatctgattctgatcccatgatcccactataaaaattgggtgtataggtatcataaaaacttaaatccatgtaactaaggattagatgtaaaaagataatatatttacattttcctaactatatttataaatcatatactttccagcaggcattgagttcagtcatcattttcacataccgattgtggatcagcctcttcttttggatcagaatgcagatctttccattttcagaaaaagtgctagagatatatagataatcatacagtcatgtgctgcctaatgatgttttggtcaataacagaccatgtatacaatggtggtcccataagactataatggagctgaaaaattcctattgcctagtgacgtcgtagccctcgtagggttataactgcagtactcatgtgttgtggtgatgctggtgtaaacagacctactgtgctgcagccatataaaaatctagcaatacaattatgtacagtgcataatatttgataataaatacctgttactggcctatgtatatactatactgtactttatatcgttattttagagtatacaccttctccttattaaaacaaaagttaactgtaagcctcaggcaggtccttcaggaggtattccagaagaaggcattgttgttataagaaatgacagctccatgtgttactgctcctgaagaccttccagtgggacaagatgtggaggtggaagacagtgatattgattatcctgacctggtgtaggcccaggctaatgtgtgtgtttgtgtcttcattttaaacaaaaaatttagaaagtaaatactaaagatatttaaaataaaaaaaataggataaggatgtaaaggaagaaaatacttggtacagttacacatacaatgcttattttaagtgttaatttcaagtgattgggagttgataaagacattaaaaaatagtaaactaagtattattacaaaagagtcaaaagttaaaacaattaagtttataaaataaaaatgttacagtaagctaaggttaattgattattcatgaaagaaaaatttttaatatagatttagtataacctaagtgtacagcatttataaagtctacagtagtgttcagtaatgtcctaggccttcatgttcactcaccactcacccactgactcacccagagtaacttcccttcctgcaagctctatccatggtgagtgccctttacaggtgtacaatttttaagtcttttataccatatttttattgtctattttctatgtttaggtatgtttagacacacatacttaccactgtgttatagttgcctgcaatattcagtagagtaacatgctgtacaggtttgcagcctagaagcaataggttataccatttagctcaggtgtgtagcaggctctaccatctaggtttgtataagtgcactctatcgtgcacacagcaatgaaattgcctaaggatgcattctcagaatgtatctttgtcattaagtgatgcatgactatgtaaataccttgcagattacatacgtaaaggtattgtgtaatccacatttatagctgaatgccagtagcattggtagcttgacaagaataatgttctacttttttgttttcctctttgctggtagaaccatgggggcaattctttagacaattgttaatctcccctaatgatgtttacataacttgatttgggtctcgttccgtattttgttatttcttttcacttctcctcctcctcgtccctcttctggctagaatagagtgatttttaaataattcaatttaagtaatagtctgtgtgggcagttgctgccacttcccttctcctccctcctaaatttatcatcttattgtaaagaaaagcatttataaatagaattatcaacacaacattttcctccctctcaccctccctggaagtaagaagcagcaggtctttgtagcagaccttcccccctttaactttgcttagaaaacctcctgtgagagggaaagctccaagtcctacttctgctgacttgtggtcaaaaagctaaattatgatgaaaattcccactttgtgtggaataagataggagattatgagttatttttgtttatggtccagtgcagcttgtctaattatactgggtttattgtcgaaataagatcatacttctagttctagtactactgaagatgtgagattaggagccttgaagaactaggaaaatcactcaataaaaatgttttaaaattcttaggtaggaaaatgaagtctgcatggcaatatcctcccagaacctttaagaaagacccagaaactcttaggggatgggggttatgggtatttagagggaatctaatattttaaaagctacaattagcatctcttttgaaagctgcaattgctcactcactttttgcagcagttcagcccccagaaaaatgtaaaaatgatttccttattctgtcattaaatcgtttaacacagaaaacaagaacaaatgttaaggattccttatggttgtgacagaatgctgaggaacagtcagattttatttttattaatttgtcctcttttgctagtcttgcagtttctactgccctgtgcaatgcacacacacaaggttacatttttgttgacccacttactgtaaaaaatgagtttcactccctgacactcagaggagttttcaaatgcttaagaaatgagggacatgtgattatggtgtaggtggggtggaagtattttattaaattgaaattacttgtggtatctgtcttgaatatttgctatgctttatttttatgacacttaatcactggattactagtcatctacattgaccttacctgacccccaactctgagttagttcatgttgcttctcccataagcctctctacatcccaccttggtctaaatcagaatactctttttcactcagaatttgcataatccactagactatatgctttgtgagggcagggatggtgcctctggtttttatagttatgtgccctgtgcatggcatatattaggcactcattaagtatttgttgattggataaaatgatggatggttaaatgaatgaatgctctgtagctttaataataaaactatacaaataagtgaaacttattatagcctgtaataagctttgttatgcactcttctatcttaatcttcaaacatttgcagggatattctcatagtgaaggttgtaggtaatgtcagtggtgccattgtctcttggaatttttcctttcttctccattcagttgcttcctcatccctgttgtgtttgagtctttgatgatcttcctaacttgtctctttccacctttaattcttactttaaagtagggttggcaaactttttctgtaaagggccagatagtaaagatttttagctttgtgtcccaactattcaactcaatacataaacgaaaagtgtggctaatattaaataaaactttattaacaaaaataggtggtgggttgcatttggatagtgagctgcagtttgccaacccctgctttaaagcattgccagataagagatatagatttcaacatcttatttccctgttcagaaatgaccagtggtcccttagtgctagaacataaatactgactttctttgttgagctttcaggccctctgtactgcatttctgtagtattgtatctttgcaccagcatttaccttgcttattctcttgttttcttctcccacagtgttcatgcctactgctagtctttaggaagccctttcttggaagccccctgctctccttaccaatttctcatctttaaataaagacatatattacctcccatgtcttctgtgaagctctccccagtaagtggaatccaccctataattaatactttattttatcatgtatgctattatatacatgaacatctatatttgtttacatattgtctgtgtatgtaagaattgtctccaaatttaaacttcttttgcagacatttcaaaaagttcttttatagttcatggtttctaacacagtaccggtcacaggagggaattaaaaattaaaatactcatttggttgaaagttgaaagcaaaatggaaatgaaatattgtgtgcttcctactttccctcagcattcttatatgatagttgaagttggcttaaatgtagttctcttttctagtgttagtagcatttttatactcagttggttaatgctgctctttggttatgaagactctgtggatgttttccacctcaaatttgacaaacgtaagaacaatcttggtagcctatgaataggttaagttcttctgtgttctaacatcaggcagaatacgtatgtgttttaaggaattattggtccttaaagtaggacctggaatgagatcaaaatattagaatctagctttataaaataaccagtttgatgaaaatctgagtgattggcagtgcactaaagcatggttcatttgtactttgggataatgttagtgctgacagtgataagctacttactgattgtttgaatatccattcccagtaaagtgctgatactttccagtggtatgtagtagtgtttcccgatatcaacttgttgtcttttccctctgcctgttctccattttaaaaattggtcatcttgtcctgattttaaataggacatttttattcgtctgcttttgtcgctattaagaaatacctgaggctgggtaattcataaagaaaaatggtttatttggctcacaattctgtgggctgtacgagcatggcaccgacaacctgcttggctttgcgtgagtcctcaggaagcttacaatcatggtggaaggcaaaaggggatcttgtgtatcacatggcaagagggaacaagagaaagggaggatgtgcgaggctcttttaaaccaccagatctcatgtgaactcatagagtgggaactcactgattactgggaggacagcacaaagccattcatgaaggatccaccgccatgacccaagtacctcccactagccccacctccaacactggagtcacatttcaacaggacatttggaggggataaaacatccaaactatatcaatattcatttattaattcatattaatattgttaaatattaactaggtgttaatatttattacagttaaaggtactagctttctatcctcttgttgtatatttatgttgctgtggtttttcatccttcctctttgttgtggcattgctttagatttgatgtaagttttcagctaagggatactaactacatatcaagaacatgagctcaatctcagtattgaaccacatctttggccttcattcaacattgcgattttttttcccttcccaaggggacctgagaatgctacttgacaaagcatcaaattgttatgaggtcagcatggttcggatgatgcctttaaatatgcatataaactgtttatatgtttgcagtatttgtagatatatgtaactataatttaagtttccagtgttaaatagtagtttatgttaattttctgtataaagcctgtcagctgtttttgactgtacatttgaaaagacttgaaaacataaaacttgctttaagtgataaggttgatcagaaatatataataggtaaggattaatttatattttcaatgtattagagttatgaatcaccctggttgttcagcttaattttatactttcttatgtagtgtcaataatactactaggtcaatagaaaagagtcttattttaatcttgcgtcttatttttttggctaggagtaaaagaaagcaagtgctttttatatacctataaaagctggctaggtgcaatggctcacactataatcctagcactttaggaggctaaggcgagaggatcacttgaggtcaggagtttgagaccagcctaggcaatacagagagaacccgtatcttaaaaactgaaattaaatgaaatggaaacttatccaattaataaagctatagctaatatttatgtaagtgtctagcttgagcctagtatttttttggtagagcaaggtgagacaaatacatacaagccattgtcctccactagattaaaaacttcatgcaggcatcttctggtagaattgatttgctctcatttttctggtcctttctatttttgcactgctgccagaatccacttaaaataccagtttcctaatgtaagcctttgtttaacagcttctgtggttgaagaataagaccaaatattataagatttttcctctttttcctgaaattctgtagtttcaccataatatagctatatacagattcattattatttatcttgcctggcatcagtgtgtactttcaatcttagggctgcttttttagttatggaaaattctcagccatcattcttctttttttttttgtagagagagtgtcttgctatgttgcccaggttggtctcgaattcctggcctcaagtgatcctcctgctttggcctcccaaattgctgggattacaggcttgagccaccacacccggctccactatctttttggatattgctttactgcctttccccttatttcccttattttctccttttgcaatagccccacaatttttttttttaatagaaggagtctcactctgttacccaggctagagtgcaatctcagctcactgcaacctccacctcccaggttctccacctcccaggttcaagtgaatctcctgcctcagctttctgagtagctgggactacaggtgtgcaccatcacgcctggctaatttttgtatttttagtagagatggggttttgccatgttggccaggatggtctcaaactccttacctcaggtgatctgcctgccttggcctcccaaagtgctgggattacaggcataagccactgcatccagccaatagcccccaaacttatattggagactttcaatctgtcctcaatatatcttaccttctgttttatatttttcagttcctaagctctagctgtattctgattgaattcctcctattattttcaattcgtgaattttctttaatgtgtccattctggagtatatcccccaatccactgacctttgatttcaggggctatatctttcttttccagcatttctaatttgatccttatgatagccatctgttataatttgggcccgcctgtttttgttttatggcttcttattctttttatatgtgtgtgtatatatatagatatatatatatatttttttcacttgaaggatctcaggtgataagccattttgatattgctttgctatttgcatttcatcctgtgagagtttgccttgtggttgcatacttcgtcagttctcataatgttcatttgccttgtgtgttagggaatttggttggtaggttcagatgggatgggagtgttggtgtgtttctctcctctttctctctctgtttttccctcctcgtctgctggccttcttgttggctctgcccgatcatctaggcctttcagtctagaaacagaccttaatgacccaggcttccatctcttggtgagctcctcccaggctttcttctcaggcagggatgtggctccatctcagccctggcccgagggcaatggtcccaatttctctcagcctccttccccatgtgggagagcctgactccacccctgatttcaggccaggggctttcgacctatgtacccacatgaatggaacacccagccacttctgcaggcttccagctgtgtagccagagtcccaccactgtcttgattgtttctgggtcacaaagatgttgatcttgcttttaatttctgctgtgccctttctttcttcttcatctttaaaaaatatttaatgcatgcatccagagggtagtttggagtgtaccatctcgacatgaagtaggtccagtctctgcagcttgctgttcagtgcctttttcagctttccccaaccagctttccaaactcatatccctccactcctgagcatgaaccttctgcttctgccaggcagtttcttatgtccttgaacgtgcatggctcctcctacctctgtgcttttcttacatgctatgtccccaacttggtctcccttcctccctccctttgcttctcacctcctttccatcaggagttgggctaagtctaacctcctcctctgtgaagccttccttaatctcaccagaccatagcaatcatgatgttttttgaagtcattctgtttgtattggttattggccttcctcatccctcttttgtgttgagagtcacctatcttgtggatgtgggccttgaatccccactgaattccttgattgaggttagaaaatgtcttttatttttgttatctccaaagcatctggcattgagctatgcttacctgtttgattgtgggtatactcagtccatacttgcatcttttctaatactgtgtaggtcatttgtttcttccaaaaatttgaattttactgtgtgtgcacatgtgtgtcagatctttaacttagaaaggcatatttttattgcaccttcctcttacacacacatacacatacatgtggatgtgcatgcatgtgcaaacaagcacagacaccacgtgcacattgcttgtaaaatcattggatttgcccgtaacagaaacctttggtaaatgacgcaggctctccttgatagtgaatgtctaaacaactcaaaggttgatatatgtgggagagaactgtttttatcagtttagaagtagatatttttctctcttgggcagactgttgtgagtccttcagccttctgttatgaaaaagcagtagactgtaagagaaaatcatgaagtctcaatttgaaagtgagcaaaataaggttgacccattctatctcattttcccttatttactctttaagtacacattacttactctctggtagctcctgaatctttatggttaagaagggaaaggctgtgttcccatttcctattaggaacctcgtttccatgctctcctgtcttttgaaaacatcatccaaggatactcatatcgttttgtcctcatcactgttatcacctcccttcatccctggaagacttttgcttctactttttagctgcctgggcactgccaacattctggacaactgtaacatttttctaatcattatcatcatccactgtttcttgaataccttctatgtgcctggcatggtattaggtactttatatccattatcttatttatttaacctgctatttacagatggggaaatcaagactcagaatggcaataacttgcccaaggtgtcacagtgatcttattttaaactttcttaacctcagttatctttatttttgttcacttgaaaattcattgaataaaccttcttattgcttagcacattgcttctgacatcttgaatcctgccagcctcctttaaacatttccccctcctcctaactctgctccatgacctctttctgaccctgcctgtttccccagccatctcagttcacctctttccttctacagcctgcatagtcatttttgcttcctttttccaacattctcactgctacttggacattctgtaaccacttgattaccagcctccaaaattagatcaattcaaccatctgttgtatctgttcctcatctctctcctgtgagcactgttggagaaaatcctataactttgccaattggctccatctcaaatgtgtttctaatttacccggcccttcagtgctcctaattagttgttttatccctttttggctccttttctcttccccacctggctgttccaaaactttttaacatttttcaccaacacaaccccttcctgatctccagagccagctgaccctgctttgagatctgctaagaacatagaatttatcagaagtaatttcttctaacttccctcttctctgtctcaaagtttatctgcatctggactcatccatttcttccttcccttttaattccaaagaaactctactgttttccaatgataactctacctacctgtactgttctttccagaatctttcatgaagttgccctaaccacttccttctccttttgtatcttcagcctcttaccctccgtttgcaggtctcctcaactgcaaatgtgcacatccaagttggtaggctggtgggggctggggaggagtcttcccttggccctgtcttcctctcacagtttctcctttatggccacacttggggaaagagaagcctgcacttccccctcccttgtctctttgatactcctccgctctacagctgggaggtggcccctcattctggtgaaagtctctcccgcagattactgccgacttcttcaaggccagatctgatgggctcctgttagtccttctactcctaagcctgccccttaatgattgtccttacattggctccttctctttgggtaacctcctgagcattggacctacactcccagcttcctctgggtgttacctgggatagagagaatacaggttccttccattgccagctcctctttggtttcctagccgaataatctcatctttattcatccagtcatccaagctagacatttggagtcagctttgacactacttctgcctgcctttcccttgtcacaccagtcactaagtcctatcaagtctccctctaaaatgcctctgtccttccattcttaccactgctgccttaattggggtcttcatgaactatcgcatagccctttctgtcttcctgtctcttacctttaatctttcctctatactgttgccagtgttaaatttctgagacacagagctaatcaaatccttctcatgtttggctttgttcagtggctgcactctgcctactgggtcaagtctggctcccctggcttggcattcagggttcttccctgtcgggctgtgtgcctccctgccagcctcctctccagcagctctacctggcacgacctgccttaagcctgaaccctagcacttgcagtccactctgctttcccttgtttctctgcttgattttgtatttcttgacctggctcgatagttatctttttgataagcatttgtgacccatctaaacagaatggctcttcctttctcgactctcctaggagcgctgacactctcatattatagtcagttatacatgattctctctctcctctgctttcctttaagcttctcagaaacatctcttgtttcctgaggttccacagtacagtataagtgcctaataaatacttattgaactaaaagtcagataatgtatctgggttcgtgaatgttaaagtgtttaggagcctgggtctcattgttagcatatgaagcactaacagaaaacaaacaagtttccagctttagctttaatatacggtaatctgggagttgtgtattttttttctagaaatgtggctttactaaaataagagaaaataaattttaactgagtttgcatcaatataattttggtgttcagatgaactgaaaacactcatgtaatggttggctgagtcaagctgggtgtcaacaatctgtcatctaacaattgagctctttgtgattgttgaaaagcatatattaaatttctccagaaaaaagaatctattaaaaatcatgtaggaaggtgaaagactattttatatagcattataatgagcccaaattggctttttaagtcttgaagtccctgaaatgcacagagaacactatggaaaaatgcacacacacctttcgaacctgattttaacacaaaccttcatccttttatcttaatatgatgccaataaaaccatacccagctacatttcatctagtgttattggaggaaatatgtatcatattaacagaggcaaattctttcagtattgtacatgttgggtacaatatacactacttgggtgacaggtgcactaaagtcacagacttcaccactatacaattcatccatgtagccaaaaaccacttgtacctcaaaacctattgaaataaaaaataaaaaatactttcagtattgtgaaaccacagttatggaaataagtatcaatgcacacattttatgtgttaatttgtgagcaatacaaaaactggaaactctattacaaaggcttaaagagacataggagtacagaggcagttatgggtgtatttatttttccccagtgttgtatttgttcattaaaacttaaaacactatagttatgtatataaaataccatgttgccaagcatgtattttttcctttaatttcaatcacattaaaacaaaccatttttattttaggttctttttgcctctgtggttagaacttaaaccagggataactagtacactattgtttattccttaaaggactggggaaaatgtaggaaagaaaatgtcagtgtggcaaaaaagtccatgaacattttgaatcaggattttgaccttagtaggatgctaacattccaggccattggatcctttggttcaagttatttgaacattaagacatcgttacattcatttgctgtcaaggaccttaatctttcattattctttataatttgctgtttttgatagctaacatgttttatttattaaccatctgtacaatatttatatctgtaattattagacatgttcctgccatgattaggtaactgggctgtttaaaaaagaaacacctccagaatagctaaaattttaaagttactacctacatctgccaaaacagattagtagcagatttccagaacagaacaaattgtcttgatctccttacctaacactttgttttatgtcaaatcttactgctttcagggaacaagacttcttgatggaagcttatattttgacataaaaattttgggggctgcaaatgtaaggcaattttatccttatttttcaggttgaatattgctacattattaattttatggtattcatacaataagaataccacatattcataataaacttgatctggtcctaactcactataactctgttgagcttactaattaaatgagcttgaatattatatttgagaaattaaaatctcttgttatataaacaagggctaacttctaaaataatatttgtacttcaggtataaaaattattttcactttataaccatcttcactgtcattgttataatttattttgtatttcagattcattaattcattattgtaacaactaaaaacattggccaatcagaattaaaactttaatcaactcataatacttaagcatggatgttcttataatgaaaatttcttttaaatttagaatattcctgaaaattctttgaattcaggcctgatgaaaatcattcaaaaatgtatttatcttttaatgcaacaaatattttttaataattttttttattcactcagaatcatatcttgcctaaggtcattatttgtctatgttagggtgatagagaatgttggattgaatatgtagtgatcacaaggcaaatgctcgctgtcttgagacattaaactatggtagctaagggtttgagctttagagtcagactgctagggttcaaattccagctccaccaattcttaattacatgaattggggctaattactgctttgtgcctcagtttcctcatctgtaaagtgggttgtctgaaacatttaatgcgtgaatatgtataagatgtttagaactgtccttagcatataggaagtactcaaatatctagttcagaataattgatgtgtcaagtaatatatctaatttgttaagaagttcagctagttgtatttaatctatttttgaatacgaaaatcaatagcaataatattgttcatggaattcaaaatgcaaatgcaattttactataaaatgtaattttactataaaaattaaaaatgccagtaactggctatagtcttttctgggatattagtaattttacaatacatggacatttggaaaacattgtatatagttggtagtcctacctgtgactacaaaaaaagcatgaagttatgctttgttacgatgtgtattaggtcccaccaggcactcatctggcttatctatctaacctgtctaagatttgaaatggagagtacttgtgtttttccttgaggtttcctcaactgtggctgagtacaaatgacccagagagaccgtcagcacaaccccgtaggataaccatgtgatacctgaagtttaaatattcctgtcatccaacactgttgctccctgaatagaaaggtctcacagtgttagttatgcttttgttaagtgaatagatcttggagacttgaacaattctcttctccccttagtgcatttctttctttctttttttttttttttgagacggagttttgctgtgtcacccaggctggagtgcaatggagtgatctgagctcgctgcagtttccgcctcccgggttcaagtgattctcctgcctcaacctcccgagtagctgggattacaggaatgtgccaccatgccctgctaatcttttgtagttttagtggtgatggagtttcgccatgttggccaggctggccttgaactcctaacctcagatgatccacccgcctcggcctcccaaagtgctgggattacaggtgtgagccactgtggcccccttagtgcatttgtattaagatttttattttagattgaaaatgaaaggaagttaatttgttacaaaatactgatgtcagaataatttgctgaaccctttttactgatctttcatttcacttttctttataccatataaagaaaccatggaacatgttttgttttgaggactttggtattgtatttttatcctctagtgcttaatagatacaacttatgttcagtaattatttgttgaatgaattgaactggtgggacagaaggtcaattcgttggccaaatggtgtcatcatttgtttgcagaggcctgcagggccagttaggcaacataagagagcaaactagggggttggaaaaggaaatagtggggcttgtggtgagctgtatctgagcctagattaaacaccagccagagtttttgagctctgtggaagtaaaggctttggatagaagactaatgaatatattctccatatgaataatagaaatctttaaaatgttctagactatttctgttttccagttcactgggtactgtgattcactaaataaatacgtaaataaatgaatatatatatgtgtgtgtttatatatataaatatatgcacacacacatatttgcccctctatattgatgtacatatgaaatactttaccctataaaaaagttggtttaacaaaggtcgcttgtctaatgtttatttgctacatctctgtttattgataattgatggagcttgcaaaaacaactttgttctaagttatatgcagtttgaagaatttctgatttctgttagtgataacatgcacaactttactaatcggaacaaaagtaaaagttaaatattctcaagaaagcactagctgagctacacacacacacatacacgcacaacatacctttgtggcattcttatagctgggggacttaactggctctgccctctgactgcttgccagacttagaagaaaccgagaaaaagcaggtagaaaaatgtttatgctctaattgcgagtgtggtagctggcgtccctcaagtggaatgtatatgggcttcaaggcttttgaccaacttcactggactttcttagggtcttacctcttttattcgcactgtgggttcaggtatatttatagtatagtgctctgattcttgatcatctcacacctattttgaagtattagcatgaaccacatacaagaaagtcaatagccaaaccttttccattcttcctacagctcttgaaactggcagccttgagaaccacccatttcccttactacctctcacctaagcctttcctggtgcacgatgttaactttacactatgtatattactatttaatgtcgacaccgctgtcttttcatttcacatctgttatgacattgtggctttcgccctttgcggtcagggaccataactctttgacatactgtgttaacagggacttactcaggaacagccatttggctgttcatggggtgtaaaattcactgcagttttgaagctgagaaaagatagcttgaatccttttgtaagttctttggaaaatggacagattcttttttactgataacctatatcatcaccaaaatggacctgtcttataattgactagacctgttaatgaaatgttacagactaatttgagaaataattattgggtgggagaaaagggcatttactagaaaatcaagtaaactttgttatcctcaggtatttaattggaagaattgagcaaaaaatttgttaatgtttagattgatttatgttcctttttctaatcactgtttcctgctaaaaaaaataactgtttggcaaactttctgtaactctctatcttttcctggtttatgtctgttgtcccaggcattctgattacatatcccaatcacaatccttttatatgttagtatctaatgtgatgtggaagaatttgtatggtttacttgaaaattgcctattgtttattaaattccgacagcaagactcttctgcataaatgtttttgggtcttaagatcagatttcaagctggtagtacttcatttccccttaagggaaaggatgtgtaagatatttataaattcaagcatgcttaaggaatttatttaaatggctgctaattctactgcattagaagcatgccattgatatgtactgaattaaatttaaggatatatcatctcaaagtatattctagtaatctttaattagttaaaagtatcttttaatattgttaagtaaaactcattaattgtagaaatgcttagagatgagtttaggctacctaccgatttttaaattaaaacttaattttttaatcactataaataaattagtaaaccttttaaaatataaagttttcttacaatcactttgcataattgaatatctcattcttacctagctaatgctttgtgtctcctgtctttttgtttctgttttggcttagtttatttcattgatctctaagctgtcttgtgtggaagggagaagctgcatgacttgctagaagttttacatgtgatggaatttaacctcagtttatgtctctccctgcacagtcccttcagtctgaatatgttcattactaaggccttgccactccagtgaaagctgttcttctcttagacacaatttcttcatctggacgagcagtggagagggaaagcaacttcttgctggaagaatatctctgccttcttaccttaaattaaaaagagcactaagataacaccttcaagagacttgaaaacagaaaactggttaatgactactataaatgcactgaaactatgtttatggagatttccatacttttaaagacagttttaatgttgaatttggtactttgaagggttatttttaatgtattttggtaatacatttattattatatttacatgtacagtgttacattatatatgtattgtgaactttaaaagactattttgataaatttataaatatataaaattatgtaaaaactacactatattttgatttagattttcctgctgtttgctaccaaaaatttgtattttaaatctgtttagttttagtatggttttgtctctaatgaataaataattccttcttattaagaagaagtaagggagaaagtttttagaaagtgatttttatgctcgcactataaatatggcaggtcagttcattcttttgggaagtcagtttagttacactgagtttatccaagtttatctctaccaagagtataatggcatgggatggcttatttaggacaattccctttcccattgtttttgttgctgagccaatttgagttagttttgcatcctggggggctttaaaatacagcatgcagtgaaagatcagaattcactgaatatttcttctgagagcatggtttcatggtttttctctatgaaatgactcaatattccaaatgtttttttttccttcctcctttcaaaagagttcttaacccaattaggatatcctgctttgggtatgaggttgttgttgcctgtaatcacacatggtttgacatcagttttaaatcaatggagagaaaaaactgaaaaagatgctgctaagtagttctctgtattaaaggagatatttttaaaacagggtacaaccccctgctgcacacgctagcatatctggaacctactatgaaaatgaaaggacccttataggtactcacagccctttcatgtaagtatgatctgatatttaggtcttcagaagcctgtaggtttcatttctatgaggaatcgaggagcgttacatcctgatatccttccaggctgcttaagaatggactgcttcgacactgaaagtgctagttaaatggattcatatgaagtgctttactcccaaccattgagttatttataatgtatttattaggggagggtaccttgagtctattatatatgcttcatcaaaacatcttgttcatgttttatgtttttaaaaaaggcatttgaatgaatgtttgactcaggtttgttaaattaaccttcagtaactgcagtaccaaaaattacactcaactgatgaaaaaaacgaattgtatgatttaggaatcaaaaactaaaataagtggaattatgtatcttttctaaagttaaaaaagtaaaatattttattatgagttattataaaaattggttaattgtataggaagatgacagtatttttttcaagttatcataaaaagtaattcagatgacatttgagaagtaggggaaagggaatcatgttgacagttttagttctgtgaacactaatttgtgtgaagctattaaaatgattgtaaagttgactactgtaaatttcccataattatgtgtgtatatgtgtcatatgtatgtacatgtatatgtctaaaaattactttacacatgtgcctacatagacacaccaagaagtggatgtatataatatagaaagtatatagcaaagtaattttactctgataataaaaattgtttgacatgtattttgttatgaatagtttatcttccaaaagatattttgctctattttaaagtgtagaagaatacactgctaataaataataaaagttttattcaatttacttattttttggtgtttataatttgaatttttgagttatcaatgtactgaagtctctttataattttatttttggttcagtgtggtcagtgccttgagtgtttcaagatctctattctggattttagtttagcttttattgactttctaggttgtggccattgcctgaaatacatgacagtgagctcacagaaaccttatactttgaatttcacaaaaatcatataatgttaggttcttgcttgctttccctttattttttttactgtcaataaaatactgatcctgatcagtgttttgggtcctgcttagtcatttatgactactgatgactattgtgtgattgatcaccagttccttttgaaaaagaatgccatttttcctaaatgagaaattatagaaatcagttagaagaaacctcacacctgttggatctatgccctgaaaagtcagtttgggaggaagaagctacactatttattggagatattttatatagtaaactggatctctttgggttatgatgtttctgaggtttttttttccttaaattttttttttttttttttttagaatgcaaaggaaagtttgtgggtgagaaggtagttttacatttggaattgggatctgcaaatagctgtcctaacaacactgcatgaaacaattggggtaccaaggttttcataggaccacatcttaaagaaggagatttcttatgaattaatgaacctgtttcacagggcagaaggaaatctttttttgtacagattgggtttttatgaaaaagaaagtaaaaaaaacaaatcaattagctggtttcagcagatttctcacctattgagtttacctgtttcttttttatccttagatgtaaaatgatttataaatctcaaaacacacctgggaaaactatctatgtgattcaaatatagcaggaacatgaatttaccaactatacacaaatgtattttgaaaattgtttttacttctatgctttcttcagtgacatgttaaaccattaatatgttgagtctaattaaaccagttgttagtatataagctgaacaggactccgtgggcttcatgtcatataagaagtctgtactcgttccaaaagtcataaggcagagtcccctttgcaacacttagcaaagcaagaatttggtcactgtatgtctcctcagaagattaattagggacaattccaattacagaagtatataatttacagcagaaaactcctttatttacacataggttgcatagggttgacaactatggcatataatggaaagtagaaaataattgtattaagttattttgagctgaattgaaatgttaatatattcccacccagttccctctctatggattgaattatgataatcatatcaagaaggagaaaaatagcttttctcaagaattttaaacttttctttgctaagtacaagtagaaacttacattaaaagactagttttaatgcgaaatgtatttggaacaggttttaagtggacaaacataaattagctgaacttctcactctgcatgcctcgttttaacctgcacgccaccaaaatcaaagtaaatcacatcaccacttgcggtgtctgctttggtttgaatcaagttgaccatgcatttttgagaagttgtactccaagtgaagaatggggcatggtaataactgtagaaatgactctacctgcaaatatttacattaaaacttaagatttgggggtagtaatctatcaaatatgtagtcatccctccatatccatgggggattagttccaggacctctgcggataccaaaatcagaggatgttcatgtcccttatacataacggtgtggtgtttgcataaaacctatgcacatcctcctgtatactttaaatcatctctagattacttataatatctaatacaatgtaataccatgtaaatcgttattatattgtttaaggaataatgacaaaaaacgtctgtacatgttcagtaca

SEQ ID NO: 15836 - DNA, 45587 bp, Human
tggctattatgactaatgccttgatgaacatgagtatataaatatcttttcaagttcctgctttcaattcttttgtgtatttacccagaagtggaattgtggggtcacatggtagttctatgtttaattttttgaggaaccaccatactgctttccaccatggcaacttcacatcattaaaaggccatttatcagtgatttagatcaagatattgtgatctaatttttttttttttttttgagatggaccctggctctgtcacccaggctggagtccagtggcacgatctcggctcgctgcaacctccgcctcccagattcaagcaattctcctgcctcagcatcctgagtagctgggactacaggtgcgtgccaccatgcttggctaatttttgtatttttagtagagacaggatttcatcacattggtcaggctggtctcgaacccccgacctcgtgatccgcccgcctcggtctcccagtgctgggattatggcgtgagccaccgtgcctggccttaaaattctatatagaacttttagcaagacagcatgtacaatgaaggattagtaaaaaatggtgtttcagtgctttttcttgcttctcttcagaaataaacctttaaaaagatgtatataggtgggctaaaagaaaaactattttttcccctcaggtgggggaatttaaagtgttaagggccaggcatgttggctcacatctgtaatcgcagcactttgggaggccaaagtgggaggatcacttgagtccaggggtttaagaccaatctgggcaatatggcgagaccctgtctctctgaaaaatgaaacaaaaaaagtgttaaggcagtcaaagtgttgtgtccctgaccactcaccttgttctctaaatcccagacctgaactgtgtttcttagggccaaaatgaactgaaacataaattgcctggacctacctcagactagagacactcctgagtctggagaaccaacccaggagaaatagcacagccatctgacccgagttatcatacagttcttctcattgtcctattttattttctctaaagcacaaatcactattttatttttttattttttgagatggagtcttgctctgtagcgcagtctggagtgcagtggcaccatctcggctcactacagcctctgcctcctgggtccaagtgattcttctgcctcagcctcccaagtagctggactacaggtgtgggccaccatgcctggcttacaaatcactattttaaatgatcgtgttttttttttttttttttttttgcatgtttttcagctgtcttcctccatcagagcgtaagctccataaaaatcaagactgtgttattggctgggcgctgtggatcatgcctgtaatcccagcacgttgggaggccgaagcaggcagatcgctttgagctcacgagttcgagaccaggctgggcaacatggcaaaactccctcctcttaaaacataacaaaacaaaaaccaaaaattagccggacatggtgctatgtgcctgtggtcccagctactcgggaggctgaggtgggaggatcgcttgagctggggagacagaggttgcagtgagctgagactgcaccactgcactccagcctgggcaacagagtgagaccttgtctgaaaataaacaaataaaaaataaaattaagtattttaaacactaagaaaagctcccattatccttattaacacatcctaagattttaccacattgcttcacattttttttcttttttttttttaaaggatagagacaaaaatatataggagatggagaagtggctaatgtggcaagtttctgaaaatagacagtctttattaactcataagacaaatggttcacatgcatctcttatataaactcaaactacagatcccaggcagcactgcaataatagacacgtggactgttcttttcttctctgtaaacagccaatgagaggcagagtttacaaaggtctaggatgacatctggtgtattgactgtggccagtcttaaagctagtttttgctatgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggtaagacagtggataatatttttatcacaacagtattctttttcacaatagtatttcaagtttttatttaaggttttaactttgaatttttagtcacattgcctacaaacctaaccttgtgttgttttaaagcacttttggctcagagaaagttaagaatttaaatgtatgttgggattttacttgaatagtgtcctatgggaattttacggaagcttctgattaaatatgtgtattctggcacatggccatatgctgtttcacaatatagtatattaaaaataaatatttgaaattttattgtaatttctgatggcagtgtttcacagtatatataagctatacctttattatggtgactcataattgaggtgaaatgaaatttcttataaaattagggattttaatatattttattaaaatgtgtactcctatgtgagcagtcaaaatagaaacaaagaagcatccctttatgttaatatttcaaattgtgtgacagaaattacttcttgaaagggtggcttctgaaacaaaacatgtgaaaactctgtagctgttcactggatctgtaagaaaacaaaatttttaaagttctcaataaacaattataaaggttgtagaggttttttaaattatggaaaaatcatttataattctctctcccaaggataacagtattaatattttggcatattaatctccactattctttctatgtatattctttaaagacctgtttgggaggatattatatgtacttgttgattcctgctttttacccattcgtattataacaaggaattttccatgctattaaactttccttgtacactttttagtggttgcaaaatattttattttgctgtgttaccacagttgaattattctcttattgttaaatattttatttccaatttttcaatatttcaaataatgttgagattaatataaaatatattcattattaaattatatattattaaatcatgttattaggatatatttatgttttataattaatgtattttattttatttatttttattaaaatctaagtagtaaaattaacattgtaaagcaaaatgtttttatatttattgttgtttcataaaggcagtagttcattaataaaatgtgcttagttttgttttaagaatagaatgcattactggacacaaaggattaaaatctctatttttgccatgctgaggaagttatcttagacacgttgaaattaaaaaaactgccccgcccccagaatagcttataatggtcttttagttgcatatttcttctcaagaatgtgttactcttgtttatgttggtggtgatttgcttatagcaattgagaaagcttattaccatttttaccatgtgttattcacagttgaaattatactattatcaaacaatttttgaaggaataatttaaaatcaaaggaatataatttaacttgataaggctgacaatttggatttaaaaaaatacatgctagcttatacagtaagggtcattatatctccataatcttgtgacctatttagtcagtccttttttttttttttcaattttactttaagttctgggatccctgtgcagaatgtgcaggtttgttacatagatacacatgtgccagggtggtttgctgcacctatcaacccatcatctaggttttaagccccgcatacattaggtatttgtcctaatgctgtccctcctcttctcccccaccccccgacaggccccggtgtgtgatgttcccctgcctgtgtccatgtgctctcattgttcatctcccacttatgagtgagaacatgtggtgtttggttttctgttcctgtgttagtttgctgagaatgatggtttccagcttcatccatgtccctgcaaaggacatgaactcattcttttttatggctgcatagtcagtcttttgaagttatgctgttgtcttttcaatctacatagaaggaggattcattttggacagccttacagaaaataatctcgttgttaatgtgtaatattcaaaatatggttaccaggtggagtcatacttccttgtctcaacattccttttactggatgtattttactggtctgtcaatggcatatcatatctagataacaattatttatttttaatgaaatgtttgtcataatattgtcacttctttatatatatatgtgtgtgtgtgtgtgtgtgtgtgtgtgtgtcattttttctctcttttttttgtttttttgagatggagtctcactctgttgccgggctggagtgcagtggtgcaatctcaggtcactgcaacctccgcctcccaggttcaagtgattctccttcctcagcttcctgagtagctgggactacaggcacatgccaccatgcctagctaatttttgtatttttagtagagacggggtttcaccgtgttggccaggatggtcttcatctcttgacctcgtgatctgcctacctcggcctcctaaaatactgggattacagacgtgagccaccgcacctggcttttctcttctttttataggtatgcttctcatttcaaaaatatttttatgacatttttgactaatatgacatttcctttacttgatttgtattggatagattgcctttacttcaggtattccttcatttgatgctctaaaattaaccagaactcatcatgcccgaaagcattttagctgttataatttcaaaacaatttgatattctaattttacttatcacaattgaattgagacacccacataatacttttgctttggtatatagttcttacaatttaaagtttgtgctagaaattgattaaagtaaaattatgtattttctaatggttctagagcagtaatcctgaagcttttccttctcagagagtttttaaaattatctttcagaaattgaaaatacaaccatgaaaacaagcaatgagactaattttctagtttacataatgacatatataaattatgggaggatttccatgttatatagaaaacaatatattccccatttcaaaacaatttaacaaagattgattccaagacagttagcctttctccctatattggattttttttttaaatttttgtttctttgagatgaagtctcactgtgttgcccaggctggagtgcagtggcaggatctcagctcactgcagcctcctgggttcaagtgattctcctgcttcagcctcctgagtagcagggattatacgtgcatgccactatgcccagctaatttttgtatttttgtacagatgagctttcaccatgttgtccaggctggcctcgaactcctgacctcaagtgatccgccgccttggcctcccaaagtgttgggattacaggcatgagccaccgcgcccggcctctattcctcagttttctaacctgtaaatggaagtaaatagtacccacctcacagagttgtggggattaaataatacgtgatatataaagtactttgaacagtgcctggtgcagagcgctaagttgtggtggttgtggttgtggctgttgttttggcccccacagtgttactgtgcacttggaacttagtacacttatcctatccttgagtttgcattatttttaagatgttttattttgcaataatttttgacttacagaaaagttgtaaaaatagtacaacagagttcctatatacccttaacccagcttccctttatgttaacatcatacctaatgaaagtataatgatcaaaatcagaaattaaaaaaaattatagctctgaggcattttattataaaagcttggtactcatatacataaactaaaatgaacttaaaattcatcatacatttacttcattttttagcttgaccttctagtaaatttctagcttcactgattttggctgctatgatttaagagtataatttatcaatgagcatctcttattttcccttttttggcagtagggcttacccctagcattaatgctgcttcttgttttgtcattttgggttcaaactcacctcagtaatagccaccactgaaggcagattttgatagactttgaaaaacttgctttacttgaggctccatgtgctccatggcttgcaaaacataatggcctgcaaatcctgcagcagcaatggtcagtccaactgctaccattgtactggccatggctatagctgggctcccttgcctctaccgagagcctggatcatcccagcccagagatcatggcccaaaactgcacacctttaccagagtgacgcagccaccgatcgcaagcacaaaccaccaaaaaatcagaaaattaacattgctatagttaaccctaccatggtccagcaaacatttttttgtaaaggactagatagacagagtcaggactagaatgaggcaagtagggtgtgtaggatgcaaaatttaaggaggcactaacatttagggttgcgcatgtacagaaatttgagagagacagagagagagagagagagagggagagggagagagagaggatatttccttagacctaggtgtcctgcttgcctcacctaatgctgatcctggcatagcaaatattttaggctttgcaggccttacagtctctgtcctaactactcagctctgccattggagaaaacagccatagacaatataagtgaatgatcttggctgtcttccaataaaactttaattaaaaaacaggcagcagcaggccagagtcaatcaatccctgatctaaattataagtcttatctaatttcatcagttttcctaataatgccctttttctgttctaggatccaagccaggatcccttattacgcttaacccttaatgacctccaatctgatgctttcttctaccttctttgtctttcatgacctggacagtatgaagactactgtcagtattttgtagaatgtccctcaatttgactttgatattttctcatgattagattgaggttatgcatttttggaaagaactcctcagaagtgatgttgtgcctttcttagtatctcatgtgggggtgcatgaaatggatgtgctttattgaccttgagcacttcgttaaggtgatgtctgtcaggtgtcttctgctaggtttttccaaggtagggttattatttttccttttgtaattaacaaatatcttggggaaggtactttgagactgtcctgtttcttctcaaacttttactcactaagtttagcatccttcagtggatcttgcctgtaacagttactactatggtgtttgcctaatggtgactttctttttctcattaattttacatttattagtattctacagtaaggaaattcttcagtaaggaaaaactatcccttctcccacatttatttgtttatttggcttagttttatcactatcaattaatagttattgtattttaagtgttataacccaaatattaccattatttattttgtgtctcaaattgtttctatgcctcatgacttaattaattatcatttgattagagtaatgtaggaggatctctcatttatttcagggatattgctaatatctggaattttgtgggaaaaatctagttttaaactgagtgaattaaaataatatatatcaattaaatcagtattaaaatgaatcttcttttctttcttttcttttttttttttttttgagatggagtttcactcttgttgcccaggctggagtgcaatgacgcaatctgggctcactgcaaccttcgcctcccgggttcaagcaattctcctgcctcagccccccgagtagctgggattacaggcatgcgccaccacacccagctaaatttttgtatttagtagagatggggtttcaccatgttggtcaggccggtctcagactcctgacctcaggtgatctgcctacctcggcctctcaaagtgttgggattacaggcgtaagccactgtgcccagccaaatcttctcttttctgcagcacattttgcatcatatgaatttccatcactggaatcaattcactcttaatgaattagccataattttcagaaagctcctattacactatagttatgttacttgaagaacatctgtcagtctatgatcaagtatttattgaacatttcctgttgggccagtactagaagtgacatagggtggggaacaaaacaaaacaaaacaaaaaggtgagacatgatgctagtgtataaagaacctggtatccaattgaggagccaaagctaatacacaggaaacaatttgagaacaattaagtattgtgctctgtactgtctataagtgcagcagaaattaaagaaagaatatctgaatagacttcagaaagagatggggcttgaaatggccttactagatggccataattttaatgcactgtgggagagacagggcatttgtatggctaggaaatcttggagaagattcatccaagtgggaattggattagtctccatggcacactggagtatttccttgcttagacaaaaatattttgctagcagaatatggaaaagataagtttctaagttttaaaatttaagttctaaaattaatatatgttcaataaggaaatgtggaatacaaagaaagcacaaataaaaatgttaacctacatgtttaacattttggagtatgacttatacatgttaattatctgtgcatatatgctatatctgtatatgtatataaataagtaaatgcatatgtgtatatgtatgtacgtatgtatgtatttttgagacagattctcaccctgtggcccagactggagtgcaatggtgcgatctcagctcactgcaacctctgcctcccaggcttaagcgattcttgtgtctcagcctcccaagtagctgggactacaggcacgtgctaccacacccggctaattttttgtatctttagtagagatgaggtttcaccatgttggtcagcctggtctccaattcctgacctcgtgatccgcccaccttggcctcccaaagtgctgggattacaggcgtgagccaccacacctggcctatgtgtatgtatttatatgtgtatttttgtatgtatttggagtcagactgcatgggttcagttcctagatgtgctacttattagctgtgtgaccttgggagaattccttaatttttctatgtcttgatttcctaatctgcaaaatgagaataatgatagtattaacctcatacagttgtgggaattaaatgaaacattctatgtaaagtgcttagaaaagtgcctggcacatattaagtatcaaaaaatttatttatttatttatttatttatttatttatttatttatttattttttgagacggagtcttgctctgtcgcccaggctggagtgcagtggcgggatctcagctcactgcaagctccgcctcccgggttcacgccgttcttctgcctcagcctcctgaatagctgtgattacaggcgcctgccaccacgcccagctaattttttatatttttagtagagacggggtttcactgtgttagccaggatggtctcaatctcctgacctcgtgatccgcccgcctcagcctcccaaagtgctgggattacaagagtgagccacagcgcccggcctatttatttattttttgagacggagtcttgctctgtcactcaggctggagtgcagtggcgcgatctcagctcactgcaacctccgcctcccaggctcaagcgattcttgtgtctcagcctcccaagtagctgggactacaggccatgccaggctaattttttaatttttagtagagacagggttttgccatttggcaattggccaggctgttcttgaactcctgacctcaggtgatctgcccgcctcagcatcccaaagtgctgggattacaggtgtgagccactgcacccaggtcaataaatttaaaatgataataattatcattattatatacatatatagttacataatcccttttgagataagacatggatttaaattgcacataatacttacatattattatatgcagtataacataatatattgcacatatcttaccttttctcatagaaatatttaaattttctcaggttgttaaaaatcttttatgacaagataattttttaaatgagtaaagtattctaacctacagttacattacaatcaactataacaaacatcctattattggacatataggttgtaagaattaaagaaagaggagagaaacacaaagggcggcttgacagtcaacagggacagatttgtttatttatttttattttttattttttatttttttgagacggagtctcactctgtcgcccaggctggagtacagtggcgcaatctcggctcactgcaagctccgcctcccagattcacgccattctccttcctcagcctccggagtagctggaactacaggcggccgccaccacgcccggctaatttttttgtatttttagtagagacagggtttcactgttttagccaggatggtctcgatctcttgacctcgtgatccacccgcctcggcctccccaagtgctgggattacaagcgtgagccaccgcacccggcctgacaggtttattttgaataaacctgagaggggcggctggctgagttaggttagagacacactctcctacagactaagagtttctaaggcttcagggtgggagagtttatcagaggcttggactgcttctctgtctctttgttgtgcttttctgggagggagagttgtgtgtctgttcccatccatctttctgcagctgtaggcataccccgcccgagtctgctttttgcttccctatcttggtacacctgaagggaaaggaatgtgcttattaagtaaggctcactgttttactggggcccattttgtgagggtgaagtttggcagttgctccagagactttccccccacctccctctgcgcccgagctgtcttatttgtgttttactgtctgctctttctggctgcttgtagttcgaacagaagtgatttccttgaaatgcatgagactagaaagggaactggaatttaaagtggcgatgtctgtctgagttgatggtgctcttgctctatcataggtttttgtttaaaatttatattttattcttggaccttcttacagctattcttttcttacctctgattatctccttagacaaattcctagaattggaattgttgaatcaaaggctaggaaataaattaaaggctcttcatatatatgtgtgtatatatatatatatagagagagagagagagagaaaatagaatatttaacactttaaaatttaaaaacaagtctagatctcagttttatttgttatataagcaggttatggtgactgatggttaaagacagcacccaggaagaggaaacacatagttaattacagttcctaacaggaagtcatcttttcctattattcgaaggtgttctcagaagtttaacaaagaaaataatagttattagtctgggttttatacatatgcctatctaatacagcctgactttgattgtaaaagtgaagacattccttatgagaattgactaaggatgacatggagctgatctacatatagagagatagatacacacatatatctatatatagagagatagatacacacacatatatatacacacacatacaaacatatatgtctcaatttttttcaagaaagtctatacctatttacatcctcgccagcagagcatgaatgttaatttcttcgcactctcagtaacactggtcgttacaatcctttggatattttgatttatttgattatgagtagagttgaaaattttttgtatgtttacaagacaacagggtaggcagttttgcagcctactggacttgggtcaggaaggcaggatttagtggaccttgacatcgggggtgtcagctccaatggactgcacttggcagtggtcacatggagtagggaggccagaagataaatacaatgtgttcaagataaactaacccactttaccagtttacatagagccagctctatggaagctttgtaataaacttcatgatagtaaagctatgaaaaataatgaaagaaagatatagactttcttaatttttaaaatgtgaaattggtaaaacctagaaaatataaagaagaaaataacagtcacgcatgtaaacaaactgagaatcaaccattttgacacatttgcttccatgtactaaataccagtacattttttttttttttgagatggagtttcactcttgttgtctaggctggagtgcaatggcgtgatctcggctcactgcaacctctgcctcctgggttcaagcattctccagcctcagcctcctgagtagctgagattacaggcgcccatgaccacacctgggtaatttttgtattttagtggagacggagtttcaccatgttgatcaggctggtctcttaactcctgacctcagataatccacctaccttggcctcccaaagtgctgggattacaggcgtgagccactgtgctcagcccagattttttttttttttgagacagagccctgctctgccacccaggctagagtgcagtgtcaaaatcttggctcactgcaacctccacctcctgggctcaagggattctcctgcctcagcctcctgagtaactgggattacaggctcgtgccatcatgcccacctaatttttgtatttttagtagagacagggtttcaccatgttggccaggctggtctcgaactcctgacctcaagtgatccacccacctcagcctcccaaagtgcagggattacaggcgtgagccaccgcacccagcccagaatgttttctagtgggataggaattaaaaataaaacaacagcaacgataaacccccaaaactttctacctttgatatataggtataattttatctatttaaaagccctaagagatatatatataatatatcatgatatatataaatcatgatatatattatatatatcatgatatatatattatatatcatatataatgacatataatagatatcattagacatatataatagatataatagatataatatatatcattagatatcttatatatgatatatattatatatatcattatatatctgatatctaatgatatatattatatatcattagatatcagatatataatgatatatattatatatatcattagatatcttatatatagtgatatatataatatatatcattagatatcttatatataatgatatatataatatatatcattagatatcttatatataatgatatatataatatatatcattagatatcttatatatatcattagatgatatatattatatatattattagatatcttatatataatgatgtatataagatatatatgtgagatatatatgatatatatgcatatatataagcatcttatatatatatatgcatatatatatatgcattaaaagtgcatctttaggccaggcatggtgactcatgcccgtaagctcagcactttgggaggccaaggcaggcggattgcttgggcccaggagttcaagaccagcctggacaagatggcaaaaccccatctctataaaacatgcaaaattagctgggtgtggttgcctgtgtctgtagtcctagctttttgggaggctgacatgggaggattgcttgagcccaggaggtgcaggttgcagtgaaccgagatggcaccactgcactccagcctgggtgacagagcaagaagctgactcaaaaaaaaaagaaaaaaaaagatatgtcttcaaggatataatctgttctcttgggtatattccttggatgaggaataaaaggattttgacttttttactttttttctgtagtgatagaacgtttttcaaagagagtttgtatttataaatgacttactaatttaaaaatgcttactactacactgtatagaatatttaatactttaaaatttaaaaacaagtctagttctcagttttatttgttatataagtaggttatggtgactgatggttaaagacagcacccaggaagaggaaacacatagttaattacagttcctaacaggaagtcatcttttcctattattcgaaggtgttctcagaagtttaacaaagaaaataatagagttattagtctgggttttatacatatgcgtatctaataccgtctgactttgattgtaaaagtgaagacattccttatgagagttgactaaggatgacacggaactgataaaaatatgtttctaccatgaatcttatgacagaattcagctgagttgcttgagatttaatttatcgaacaggagctaagttagtttcattaattagtggttagtaaatatggaaccccatgagaatttcctaagcctgatgaatttggccatagggcgtggtgacacatgtctgtaatctcagctccttgggaggctgaagcaaggggattgcttgagcccaagggttctgggctgtagtgctgtgccaacggggtgtccacactaagttcagcatcaatatggccgggagtgggagaccaccaggttgcctaaggaggggtgaacctgcccaggttggaaatggagcaggtcaaaacacctgtgttgatcagtagtgggatcgtgcctgtggctagccactgcacttcagcctgggcaacatagcaagactgtctctgaaagaaaagaaaaagaaaaacaaagtttgactgctaacttaacaaaaaactcagctctttttagtaactagctgaatgactttggataggttacttaaccacttatatttaataatagccactattattgagttcttattatgatcaggttttgtgttaagtgcgctacttatattattcatctgatgtaaagatgagtaaacctagacacatggacgttatgtaatttgcctaaagccttgtagcagaactgggatttcaaaccaagccgtcttcccaggtacggtggctcacgcctataattccagcactttgggaggctgaggcgggtggatcacctgaggttaggagttcgagaccagcctggccaacatggtgaaacccccatctctactaaaaatacaaaaattagccaggcgtggtggtgggcacctgtaatcccagctacttgggaggctgaggcaggagaatcacttgaagccaggaggtggaggttgcagtgagcggagatcacgccactgcactccagactgggtgacagagtgagactctgtctcaaaaataaaaataaataaataaataaataaaataaaataaaaccaagcagtcagattctagagccacataaccactattgtttcctgctgctgtaattgcaattacaattaataaagccaagtcttaataattcatgataataggaattagatgggtaagtgaaatcaaatcaaatcattgatgcctctcacatctcattttagtttgggctggagtttctgttttcccagtcaaaatctctaatgaagctcctaattggtaacaaaattatcaggtttgaattatgttctttttcatttaattttgaaattcttaatataaaagaaaaagaccaaaagacaggaagaaggagctttataatagataatttataaattataacttataattcagagacagttatccttgagtaatggtggctaagcatctttgaagaatttggatattttatatattactaggagaaacctacctgatcattttgggtatttaaatatttttttttttttttttttaagacagactcttgctctgtcacccaggctggagtgcagtggtgtgatcttggctcactgcaacctctgcctcccaggttcaagcgattctcctgcctcagcctcctgagtagctgggattacaggtgcctgccaccatgtctggctaatttttgtatttttagtagagacggggtttcaccgtgttggctaggctggcctcgaactcctaaccttgtgatctgcccacctcagcctcccaaagtgcaaggattacaggcgtgagccaccacgtctggactggatatttaaatattttgagctcataggtatcttgggccatcatttaaattaagtagttaaattgtcatcacaacgactatttcaataggagcgtttattggatgctttctgaattttattatttcttagaggaaaaagtcaaaatagaaatataaggatcaaaaaaagttgggttgatcatggctgttttgggttggggattgatgccccaacttcttccttcatgccatttaagtttgaccttttttttttgagataagatcttgctgtgttacccaggcaggagtgcagtggtgccatcatagcttactacagccttgaactcctgggcttaaggggtccttctgcctcagccttccaagtaactgggactactaacatgtgtcaccatgcccagctaattattttatattttgtagagactgggtcttgctttgttgtccaggctggtcttattcctggtgatccgcttgcctcagcctcccaaagtgttgagattataggtgtgagtcactgcgcctggcatgactctttattttaaacactgatttttgtttcaggttgaacaaatcctggcagaatttaaagtcagagctctggaatgtcacccagacaagcatcctgaaaaccccaaagctggtaagaacttaataaaggctacttctcaagaaaatgagtagtatatagaaccaaaagccagtgaatagtaacttaattttctcaattttctcttgtctattatgctcaaccgtattctttctttgcactattggatgatagaaagggagagggctgtgcaggatcttttctaatagtagtcgtttaagatctatttttctttctgctgtactgtgttgctttgtggtttaaaattcttctagttcatgctttatttcaccagctattgagtgttaacataacttaagtatatttgtaaccaggtggttgtcttttttttttttgagacagagtctctgtcgcccaggctggagtgcagtggtgcgatcatgtctcactgcaacctctggctcctgggctcaagtgattctcctgcctcagcctcctgagtagctgggactacaggcgtgcaccaccatgcccagctaattttttttttttgtatttttttagtaggcagggtttcactatgttgggcaggccggtttcgaactcctgacctccaagtgatcccccacctcggcctcccagtgctgggattataggcgtgtgcccggctaggcggttgtcttcatgagaaacttgttgtgatttcttcattactggggacctgaatatatccatatattcatacttttgtttctttccttcactatcacttaagcatgcttatacctatccaagcttgggaaaaatatgaacaaaccaataatccctctgcaacctgtctctcttctctactttcctgcctctcttcttctcttcagacccagacttcccgaaaaggaagtccacagttgatgtctctatttcccttctcgctatttttccatttgttccactctgacttccctagtttctcagaaatagaccaaggactgcctgagtatcaaatctagtggttaccttttggtacttatctcccctgaacttgcatcacaatttggccctgttgaccataccttcctccttgaaacaaagtttttttcttttagctgtcaggatactatgcactcatggttctcctccagcctctttgggctgctttctctcagtctcctttgtgactcttctgttgccccaaggttccctcctaagctctcttctgagcccactccccattttctcctgaagccttgtccaggtctgtagcttaaatcaccagctcttttgatggctcccaaatctatccttaacctagttctcactccccatcttaagactgtggttttgactgcttctgggaaatttccatttggaaacatttcaaagtcaccctgtcaaaaattagactcattattttcctatcacctcctctgaaatctcgcttatttttctgtgttctcccatctctatgaaggacaccaccatccattcagttggtgtcatggaagccttgtctccttcctctccctcatgtccatatctgggaaattgccaaacactgttgatttacctttctcatctctctctactgtgtcctcctcgcttcatgctgggtgccattgctgtaggtaagcccccatcatttcatgcttggattgctacagcattctttaagtgcttctcattgcagatttttctttttaattatggaaaaaaataatatgtacaaaaaggaataaaaaatactctaacagatgcccacatatgttccgcccagcttaaaactttaccagtgcaattgaaatctcttgtgttttcctactctgattttatcctcagggtagataatattatatcttaatgtttttttttgagacagagttttgctcttattgcccaggctggagtgcaatggcacgatattggctcactgcaacctctgcctcctgggttcaagcgattctcctgcctcagcctcccgagtagctgggattataggcatgtgccaccatgcccagttaattttgtatttttagtagagacagggtttctccatgttggtcaggctggtctcaaactcccgtcctcaggtgatctgcccgccttggcctcccaaagtgctgggattacaggtgttagtcactgtgcctggccttatatcttaaatttgatagttatgtttactatatgcgtatagcatgtgtgtataagtgctttttctataaggataatatcatactaagacctatctataattccatattgcacaaatccaaactcttctttatttagaaaatgttttccttggctgggtgcagtggctcacacctgtaattccagcactttgggaggccaaggtgggtggaccacctgaggtcgggagttcgagaccagcctgaccaacatggagaaactgtgtctctactaaaaatacaaagtgagccgggcctagtggcgcatgcgtgtaatcccagctacttgggaggctgaggcaggagaattgcttgaacctaggaggcggaggttgcggtgagcagagcttgcgccattgcactctagcctgggcaacaagagtgaaactccatctcaaaaaaaaaaaaaaaaaaaaaaggaaaaaagaaaatgttttccttgtcccttgtcttaaggttctttattaattttctctagaaatcattgattcctttgatttgcaaaaacagatcattttttctatatgtgaggtcatcttttgttagatatttaactattgcttctgctcatttgattttttttccctttttattaacttgtttaaggtactatgagcaaataataagtgtgagcttgataaatttgtgcatatgtatatccaggtcaaccactgcccagagagatgtggagcatcttcagcaccccagaaatcccttttcccttcctgttcaaagtcagcaccctctctcattttttgatctctatcaccattgactagttttgcagttttggatttcatataaatagaatcacacagtatgtactcttttgtgtgtagcttctttcgctttgcattatgtctgtgttatactgtgcagtagttcatcctttgtcattgttgagcctttaggcacaaattccttcatgctgtgtaccttaattctccatccccttttgctctccttcaccatgcctagaatttcatgtttcagccactcagaattacattagttcattcatgtgctctgctctttctacactccagccctctatgcttgatgctttctgcctgaaacactccatggttcacacacatccctgactacttggccagtttgtgcttctgtgtcaggtctcagctgaccatcagttgggaagtcccatgtgtcccatctaacaagagcaccctgtacgtcaggcagtagactgtgtgtcacactgtctccttattgcatgtttgcttattagtcattctggaagctcagtaaggcagacgccctgcttgtcttgttcacagtcgtatgcccctagcatggcacttactgaagaggacacctattctgcacaatttcttgaataagtgaatgcataaacattccttccttccttccttccttccttccttccttccttccttccttccttccttccccttccttccttccttccttccttccttccttccttccttccttccttccttccttccttccttcctttctttctttctttctttctttctttctttctttctctttctttctttctttctttttttgtgacagtctcactttgttgcccaggctggagggccgtggcatgatctcggctcactgcaacctctgcttcccaggttcaaacaattctcgtgcctcagcctcccgagaagctgggattacaggcgtgcgccatcacacctggctaatttttgtatttttggtgcaaaaggggtttcaccatgtttgccaggctggtcttgatctcccgacctcaggtgattcgcctgcctcggcctcccaaagggctgggattacaggcatgtgccaccgagcctagcccgaacatttctttttcttttttgagacggcttctcgctctgtcgcccagtctggagtacagtggcgctatctcttggttcactgcaagctccgcctcccgggtttacgccattctcctgcctcagcctcccgagtagctgggactacaggcgcctgccaccgcgcccggctaattttttgtatttttactagagacggggtttcaccttgttagctagggtggtctcaatctcctgacctcgtgatccgcccgcctcggtctcccagagtcctgggattacaggcgtgagccaccgctcccgacccctggcccaaacatttctttaggattcatattaactacctgtctgaactggagttaatattaagataggtgtcctagcataaaattataaaaatttagatcgggctcggtggctaatgcctgtaatcccagcactttgggaggccaaggtgggtggttcacctgaggtcaggaacttgagaccagcctgaccaacatggtgaaactctgtctttactaaaaatacaaaattagccgggcgtggtggcacatgcctgtaatcccagctacttgggaggctgagacaggagaatcgcatgaacccgggagcagatgttgcagtgagccgagatcgcgccactgcactccagcctgggtagcaagagtgaaattgtgtctcaaaaaaaaaaaaattataaaaatttgataaacacttaaaaaccaccaccaccccaggttattctttaactgggttcttttcagtgaagcatgactgtgagttgtttctctgtccctgacaaacaatttttattcaggatacatgatgaatcactgtgtaattattgccatttctagttgccatagtgatgggggttttcatgtatgggctgcctcaaggcgtcttgttcagagaaacagtggactgtgtaaatattgtttaaaatgaaaaggtacacagacatcaatatcttctctaggcaggcatgcatttgatatatgattcaacctttgggtagaggttgttttttaatctatttaagcatccgtttactcagttttcattaatacaactttctgaacgtttatgtggatctttacacacttggatgattaaggttactgatgaaaatatttcaaatatatatatgagacaggatctcgctctgtctcccaggctggagtgcagtggtgcgatcttggttcactgctggcctcaacctccaggctcaagcagttctcccacctcagcctcccaagtagctgggaccacacatgtgcgccaccacacctgagtaatttttttgtatttttagtacagacggggttttgccatgttgcccaggctggtctcaaactcctggactcaagtagtctgccttccttggcctcccaaagtgctgggattacagggataagctgctgtgcctggccagactatttcaaaatctctttttttattttttatttttttggggggatggagtcttgctctatcgcccgaactggagtgcagtggcacaatctcagctcactgcaacttctgtctcctgggtttaagtgactctcttgcctcagcctcttgagtagccggagctataagtgtgtgccaccacgcccagctgatttttttatttttagtggaaacggggtttcaccatgttggccaggatggtctcaaactcctgacctcaagtgatccacctgcctcggcctcccaaagtgctgggattacaggagtgagctactgcacccagcctcaaaatatctttaaaaattcacttggatactgaagtttagcttgacagaaattcagaatgtaatggaaagattttgaaatgtatctaattaaggtgaaaagctagacagtagaggaactttgggtaggataaattaaacttatatctatacctttttcgtccactaaatatagtctcaactgttgccattgaaattactgatgtggtagcatgatggagtagtggatataaacacaggcttgtttgtctggattgctcccattccacttacagtctagttgatcttgggcaatctctccaagcctcagcattctcgtaggtaaaacaggtagactagtagtatattacttcatgcatctgctgtgaagattaaatgaggagtcctgcatgtggaaagtgcttaatggatgctggcaattttaattcagtggattgtctttccttgttttatgtagcagcccaaggtaaacatttaacgtgatgggatagttttctctttttataagtaatgattagatcattcttttattccctgaaaaaaaaaaaagtaaatctaaggccaccagaaatcccttcccctctccagatgtgggtgctgcagacaggactgactttgctataaaaatagtgtcactgagccccagagctcctggctggtgctcatgccagcgctctgtgtgggtgacagtaactgtttcagattagcactatattaacttctccatggccatgaagaaagtagacttaaggccggtgtgatggctcacacctataatcccagcactttgggaggccaaggtgggcagatcacatgaggtcaggagtttgagacaagcctagccaacatggtgaaacctcgtctctactaaaagtacaaaaaattagctgagtgtggtggcgggtgcctgtaatcccagctactgtggaggctgaggcaggaaaatcacttgaacccaggaggcggtggttgcagtgagctgaggttgtgtcacagtgctccagcctgggctatagagagagactctgcctcaaaaaaaaaaaaaaaaaagaaagtaaacttcagactaagaacctgtggaatggtatttttgttactgatgtgcaaacttcaaggacatttggatattagaagaaggggagcaatttgtcctttgttaactaacatcttttaatgtctcaattttttttttactttatagtctttactgtttttccccatataataaaaataacataattaataaataatgttggaagaaaaagtttgcttttatctttccctgatagagaaccactattaacagttggtatattttcttccagattttttcaaagcatattttgacatcatattattatttcttaagtaattgtaaatggcatacatttaaaatgtgactgttgtaatacaaattctattgcaaaatatgaatttaaaataacctctatattttgaaggtagacccaggagttaaatcagaatgtctcgcaagacttccagcatcatttgctcctataagcttacaaaatgagatctctcttcccagaactggcaagtgtttaccttgtgtggctcatttgattagttgctacattaatggaaaaatataaacccaaactcacttttgttaaatgtggtgaagtggatggaacaagagaaaggtcacattataggaaagataaggtttcttttttctttctgcttatcaactgttgttgagggacttacatcagaataattctaagcagcttctttcattctgggaattctagaaagcgaagccaacaatgatgtgaaaagagaaggtgactcacagataaatacataaatctttacaagccccacatgagtagcaactggcatgtgcatccttggtggtaatttaataagctttttattcctgttggaaaaagtgacgtatcatttatacaatgggacatttacattgtcgtcagcaacaggaagatttgctctcgctggaccaagctgctatggcaagatacttttatttgttcatttgttttcctgtagctttcaatagccccatctttttttttcttttctttttttttttttttttttgagacgaagtattgttcttgttgcccaggctggagcgcaatggtgtgatcacggctcaccgaaacctccacctcctgggttcaagcgattctcctgcctcagcctcccaagtagctgggattacaggcatgcaccaccacgcccagctaattttgaatttttaatagagatggagtttctctatgttggtcaggctggtcttgaactcctgacctcaggtgatccgcccaccttggcctcccaaagtgctgggattacaggtgtaagccaccgtgcccagcctcatttagcatattttcaagactcattcatgttgtagcacatatcaacatttcattcctttttatggctggatgataattcttttaggtggatataccacattttgtttatcaattcacagttgatggacatttgtgttattttcacttttggctattatgagtaatgctgctatcatatacaggtttttgtgtggacatatgttttcatttctcatggatatatacctaggattataatagttgggtcatatggcaactctgcttaatatttttgaagaacagccaaactacttttcaaagtgactatataccactttacattcccacctgtcatgtgtgacagttccaattttttcacattctagacaattattatcctttaattttagccatcctagtaggtataaagtggtatctcactatggttttgatttgtatttcctgaaggactaatactgttcaggatattttcaggtgcttgttggctatttgtatatcttctttggagaaatgttcattcaagccctttgtccattttgcatttgggttatttgtcttattattgagttgtaaatgttctctataaattctagatataagtaccttatcagatatattatttgcagatattttttcccattccatggtttgtcatttcactttcttcatggtattctttgaggcacaaaagttttaattttgatgtagtccaatttatctatttcttcttttgttgcttgtgcttttggtgtcatatctaaggagctcttgcctaagctgaggtcacaaagatttattcctatgttttttttttcccagttttttatggttttaacccttacatttggatctgtgatccatttgagtcaatatttgtttatagcttaaggtagaaatctaaattcatgctttttatatattgatatttagttatcctagcaccatttgttgaaaagactattttttttcttcattaaattgtcttggcactcttgttgaaatcaattgactgtaaatgtaagggtttgtttctggattctcaattctattccatttataagtatgtctatccttatgttagtaccacactgttttcactactgtagctttgtagtataagttttgaaattcagaagtgtgaattctccaactttgctcttatttttttcaagagttttttttttttttggcaattctgggtcccttgtatttgcaaacagattttaggactagattgtcaatttctgcaaaaaaggcaactgggattttgatagagattatgttgaatctgcagatcagtttggggggtattatcattttagcaatagtaaatctttatgaacgtgggatgtcttttcatttatttagatcttctttagcttcttttgacaatattgtgtagttccttcttttgttcaattttttaaaaatattatattcttcttgaagcttttttttttttcttttgagacagagtcttgctctgtcacccaggcaggagtgtaatgacatggtctcagctcactgcaacctccgcctcccaggttcaagtgattctcctgcctcagcctactgagtagctgggattacaggcgcctgccaccacacccaactaatttttttttttttttgtatttttagtagagacggggtttcaccatgttggccagactggtctcgaactcctgacctcgtgatccgcccacttcggactcccaaagtgctgggattacaggcatgagccactgggtccggctcttgatgctcttataaatggaattttcttaatttcattttcagattgttcattgctactgtgtagagacaccactgatatttgtatattgattttttattttttggagacggagtctcgctctgtcatctaggctggagtgcagtggtgtgatcttggctcactgcaacctctacctcccagattcatgagattcttctgcctcagcctcccaaatagctgggattacaggcgcccaccgccatgcctagctaattgtcttcttgctgtgttttcacatgggggaaacagagtgagcgagttgtctgggtttcttttattagggcactgattccattcgtgagggttccaccctcatgatctaatcatatctcaaaagccccatctcctaatactatcattttgggagttaagaattcaacatatgaatttttgtttgtttgttttgagatggagtcttgctctgtcggacaggctggagtgcagtggtgcaaactcggctcactgtaagctctgcctcacgggttccaacgattctcctgcctcaggctcctgagtagctgggattacaggcctgggccaccgtgcctggctacttttttttgttttttttttttgagatggagtctcgctctgtcgcccaggctggagtccagtggcacaatctcggctcactgcaacctctgcctcccaggttcaagcaattctctgcctcagcccccgagtagctgggaatacaggcgcctgccaccacccccagctatttttttttttttttttgtatttttagcagagatggggtttcaccatcttggccaggctgggtcttgaattcctgacctcgtgatccacccaccttgtcctcccgaagtgccgggattacaggcctgagccactgcacccggcctgtatataaatcttgtattctgctctgcagaaagtttttacttcactgaggagcagaagagactttggaggtgtttctaacagagccataaaaggtttctattatataccatctggtcaagtagattagtgacaagctaccatttgtcccagcatctaccatgttatttattatacttaaagcctcccgtttctcttacgacaaaaagcaggccagcatccttaacatgacatctcaggccctggttgattgagctattgtctgtctactctacagccccatccctcatcgttctttccctagccttgtgtcctccagccacactggcaattactacttcctctaagtcaccgtgctccttcctgctttataaggacaaacaagatcatggatgtaaagtgcttgggacagtttatccactccctgtattgtgcctcagtcatgtctttatagtctttatagtcttcagttttatagtctttatagtcttcagttttactgtccctcttgcctaattactgccctgtttcacacccagcactaaaaaaggtagttttcttcctataaggtggaatagtattttttcaatgtttacaaatgtttctttcccctgctaataatgtctattattcacatctgtgtcatcagcaccgggagtagcctctggcacatgactgaggcacaatacagggagtggataaactgtgccgagcactttacatccatgatcttgcttgtccttatgataccctttacaaaagcttaatgaggtaaattggcccaaggtcacatagctattaagtggcagtcatggttttagtaagagcagttggatagttttggagtttaaaatatcctctccgagagagaagtgctcatttcttgatttgttttccagtggagacttttcagaaactgcagaaggcaaaggagattctgaccaatgaagagagtcgagcccgctatgaccactggcgaaggagccagatgtcgatgccattccagcagtgggaagctttgaatgactcagtgaagacggtgggtttctcgctgggtgcgacgtgaatttgtgaagctcaggatgcccatggattagactcatgtagtagcttaaagagtcattaggcgataggagggagaaaaccaagaagttagcagagtctggatataattcagtgtccgtaaatcccatgaagagaagctcatcagaataaaggcaatgaatttgtgccagaagagcctgtgactacatttctttcaatctctttggctgtttgtttcagtatacacactccctgttattgcttactattttatgagctctaataaatgtacttctcaagttgctcatgaattgctgagttttaaccattgtaaattcacattctccatctttttagtttatgtcagcttgctctcttttcaaggcttagaattttcattaaaaaggcaggatctgattagtcagagaaagccatgaattattcctattaaacattctggtgaaagaattgttagactttaaaaacattgtgttatctttcttcatgtcattaaaaggcataaatatcaaaatattcactataattactgtcatatatttattttgttcaacattgacctttatatattatagacaaaatgtaattttaaagatttaggcatgatttattacctagattctctccattggaacacttttctatgacatgggacttataatacagaaattacctcataggtaagttttcagggacagttgttagaattagtgtataaaatgattcacatctcttaaattatagcccttcagggttacatttagatttccttcttcatagtttttattttagaagacttgagcaaattgttgataaaagacctcggcctcccaaagtgctgggattgcaggcatgagccatcgcacctggctagattgttaaatctcataaattccctttccttcacaccatcaaccctgtgtttctgctttttgtttaaatagtataatccctctggaacggaaaagcattgtttgggaacattattagtccctatacccacaaggcaggacaaatcacggtgtacttttgtagcatcacacacaggatcatatcttgggaatttcctttgggagaattcctcaaacgagccacagcctcaggggtgccacatttttttaaattaaaaacttcaaaaaattttcaatagcttttggggtacaagtgttgatatggtttggatttgtgtcctgcccaaatctcatgttgaattggatgagggtcctgatgggaggtgattggatcatgggggcagatttcccccttgcttttctcatgatagtgagttctcatgagatctgatggtttaaaagtatgtggcagttctaccttctctctctttcctgccaccatgagaagaaggccctttcttccccttcaccttccgccatgattgtaagtttcctgaggcctcccagtcatgctttctgttaagcctgaggaactgtgagtcaattaaacctcttttcgtcataaattactgagtctcaggtagttctttacagcagtgtgaaatggactaatacaagtggtttttagacacatggatgaattgtatggtggtgaagtctgaaattttagcgcacccatcacctgagtagtatacattgtacccattatgtagttttttatccttcactctccgtcccagcctcccactttgagtctccaaagtccattatattataccactctgtatgcttttgtgtatccgtagcttagctcccatttataatggagaacatacaatatttggttttccattcctaagttacttcacttagaacaatggcctccaggtccatctaagttgctgcaaaagatattattttgctcttttttagggctgagtaatattccatggtgtatatatccaccacatttctatcatccaggagtgatgcaactgaactggtattttttccctacactaagtctgtcactttactacctacttatttatttctttttgttttctagaagttcctcctgctagtttaattggtaaaaatattttaagacctcacccaggtcaatgaatatgttggcgatttaaatttagacatgtagtattggtttgaaaaaaaaggtttggagtgaggattcagtaattcaggcctttgggatcctgggataacctgaagagttatcccaggattccagagaatcttagggaaatgtatctttgtcatgctaaatggttttacccaaagagacccagggtgtggatggctctccctctagcaccaaaatatatggcagcatggatttaggatgcctatgggaaaaagaagccacagcaaaggcacagtcaaaatgaatggctaaaaaaaattctcataagccgttaaaactatcttatgccacttcaattgctgtaaattttataaagagttaatagaaacacatttttggtgaattgatcatttgacaaattgattgcctctgggagggcttgttgggtcagcctcgtgtggacctatttgtctgctgattgtttctgggttcccagctgggcaaggtgtctttggggtgggttcaactggccatagactacctatccagaaagcttcctacactatgcccacatggccacagtttcaccagccagatgggaaacagtatgcaattcaacaccttctgctggttcaaaaggcaatctgtcttaattggatgttatccaaaagcaggtcagaaatcaccctgataagtgaaaaatccactcatggtgatcactgatccaggataataataaccagtcaattttgtatagctattcagctgatctatggctcatctgagtccatggatttaaaaaaatgttgtgccaatgtttactggcatgtaaacaaaattttttatttccctgtgtgtttgtgtgtgtgtgtgtgtgttttaatggaatgcttcgcgaacgtgcctgttgtctttgcacagggaccatgatcattttctttgtatcattccaattttggtatatgtgctgctgagacgagcactatttcctagtattgaccaaggtctagaatgtaagaaaatgacttcctagagaaaaaaaaccaactcgttcaagaaagctagtaaacaagttaattgtgaaggcagaataacaacatagaaatttcacagactgttaagattagtggcctttgcacctaggcttgctgtctgtttagcgttagttccttccatgcatatatagattttctgtcttgtgcattttattatcttgctgtagactctcccctttctagtctctctcttagtctgtatcaattgctgtcatttgatatcttttattgatgctgattctactgaaatgagtagctgcataatagactagttcgcttgatgttaaatgttgttctgtgcaactaatacccttgtggagttgagaaatatgcttgtgaacacagaaatgagtgatttgcagactatctaactgtgtcccagcaaaccaggctgcttagcatcactctgatgttagtcctttgattgaactacaaagcgtgagaagcacttgtatctaaggttagatacagtttggatatttcttctgtatatttctttaatgaggatcagcagatatgggagtctgataacatattttattctgatttactcacaaaggagatggataagactactatttcagaacatcttttcactgaggacctttaaagcatttactgtggattagacattaatcctaacctatctaagacagaccacaggtactttgatttcaagagagaagtactgaggcacagagatcaatacatcacgtacaggccactttgctggcttgtgaagctcacagtttacattttcagctctctgggccctgaattcttgaatgtcttattccttgtttttcactaaccttcctaatatccttttccctctgcagaggaagtcactggcagcctcttttattttgtgcatatgcaaaaaccaaaccaaaacaacaaacctaaaccaaccaaacaaaagtcatttttttttttaataccagctgaggcattgcctcttttaaaaattaacgtttttattttgaaataaaatctacagagaaatgggtaatacttgcatttacaatttagcaaatggttttgaagtgtttactctgtaactattcccttcccacacatattgttggcaccaggaatctcccaccttgtatgtttttgcatcgaaacttcgcctaatttttaaaattgaatattttctttttttttttgagacagaatctcgctctgtcacccaggctggagtgcagtggtgcgataccagctcactgcaacctctgcctcccggattcaagtgattctcgtgcctcagcctcccgggtagctgggattacaggcacacactaccttgcccaactaatttttgtttttttaagtagaggtgaggtttcaccatgttggccaggctggtttggaactcctgaccttgtgatccatccacctaggcctcccagagtgctgggattaaggtgtgagccactgcgcccagcctaaaatacaatgttttctaattgtacatatatataatcttctcatagaaaatttgggaaatacaaaaacaaaagatgtaattctgttacacaggcataactacagttatattttggtgcctttccttcccatttctttttctttttttttttttttgagaccgagtcttgctctgttgcccaggctggagtgcaatggtgcgatctcggctcactgcaacctccacctcctgggttcaagcaattctcccgcctcagcctcctgagtagctgggattacaggtgtgcaccaccacgaccagctaatttttgtatttttagtagagacgtggtttcaccttgttggccaaggatggtctcgaactccttgcctcaaatgatccacccaccttggcttcccaaagtgctgggattacaagcataagccactgtgcccagcctcttttctttttcttgttagggtgagagctggttacatttattggtggcaatgactgctttatggggtggttcttggatcttggggttgattagcctttggactggttatatttggagaagaggattcaggatgacacttctttgtagttgggaagagataggttgaaggtgggaataaatgacttctttgatttgattagggcagagagctagaatatttataattttagggtgttaaaggctatgtttccttctagtcttgagttgtggtaatagaggtagtgtgtcactgtttcttagtacttcaggaatagcttcccacaatatcccgatgaggttttaagaaatagttatgcattattttggttgatggtagggctaatgattccacttgaaatattcttgatacagcaaactcaaaagcgctctttttcactgtattcatttgttagttcatccatccatccctccattcattcatccatctgtccaatttttagatctaataggaaatacatatacagaacagaaaatgaaaaaggtacaaaagggtgtatggtgaaaagtaactattaatagttggattaattaatatctggattaatttatgagtatcttgttaatagtcaagtctaacatgctgttaattagcactacagtagtaggtcaggtgttaccacatatcaaactttaaatatagaaaatcatataatatcaatttaatttttatatctctgctttacattaatttagtcaatgcactgggttgtcagaggtaaaaaagacctgatgctggaagaatctgacaagactcataccaccaagatggaaaatgaggaatgtaatgagcaaagagaaagaaagaaagaggagctggcttcaaccgcagagaaaacggagcagaaagaacccaagcccctagagaagtcagtctccccgcaaaattcagattcttcaggtaagtcacgttatataactgcagaatggagaaggtctgaaattaaagagttttgtttatattgcatttattcttaactttttcaatctgcacagcagtgccaagtttaaagattggtttatcatcttaaaagacacttagcattgacaccgaaactagaaggtattcctcagaagggaaaccttgagacaattctcagtgtctttggctttactgacataatgctagctaacattgattgaatgtttactatgtgcaggaacactctttacatatattagtttacatttattatctcatttaatattaattttatatatattaacttattctcactacaagcttgtgaggctgatatcaatattattctcattttatagatgagaaaaccaaaggccaggaggttgaataatttgcttaaagccatacagcttgtatgggaagggaaaggggtctgaaccaaggcaggttgacttcagtcagtgttccaaggcattgccctatcctatgataatgccttattgaattgaatttaattttttttcttttttgagatggagtctcactctgtcatctaggctggagtgcagtggcataatctcagctcattgcaacctctgcctcctgggttcaagtgattcttgtgcctcagattccccagtagctgggactacaggcgcctgccatgatgcctggctaatttttgtatttttagtagagatggggtttcatcatgttggccaggctggtctcaaactcctgacctcaggtgatcctcctgcctgggcctcccaaagtgctgggattacaggtgtaagccaccatgcccggcccaataatgccttatctgtaaatagctctgtagacattctgaatcatttataaatccactgaagcagagtattatagaagtttacctcctggctaccaagctacactacctgagttcacatcctagctctactacttattatctgtattacttggcaaagttacttaacttctctagacctcagtttctgcatctataaaatagggattataatagtacttgctcatctaggtgcattgttgtgcacctgtagtcctagctactcaagaggctgaggcaggaggctggcttgaggccaggagttcaaagctgctgtgtgtgatgatcactcctgtgattaggtgcttgcattccatcctgggtgacatagtgagactccatctcttaaataaaaaatagtaccttcttatagggttaccatgaggattaaatggggagatacataaaaaatgcttagcacagcggttcacctctaggaagccctaggtaaatgttacctgtttgtatcatttgtctatctggctggctatctatctagccatccaactagtttggatgtgttgtatatacacacattgtatacacacattgtaactgtccttcaaattattatgtgttgattctcagggttgtgatgtagcaccctattagaatttagcctttaagcagaacgttcctgaacaccctagaacacttgtattcaaaagaagatagttagatggcttgtggtggattatagtcttttgagaaatagtcacttcaaatctctctttggggagaacttttacatcttctcttcttgctgggaatgaagatccatagagtttgattcagatgtctctgttggttacccaagagatggctgtggagtctgcacattgattgcatcacccagtaactggaaatggttataatttaacaaactgatcaaaggagaagcctgaagtgtagaaaaacagtgttttaagcaaacacaggagtacaatcactcccctacatgtaaacacgatgaatgttcagttctgtgtttcttgaacccctgggggttccccaagtctttctgtttctgtcagattcagaccaagtctgtgcacaccaaaattaggtgtagtgtgggtgggagacacttcagagactcaggcatgatgctgaggcctcttgagcccctctcataggattctacgaaattttccttctttttaaaaaaatagtaatttagatactgaataaaaacaaaagtagtatagacttgctgttaaaaaattcaaagaatcatatatagccaggttgccaaccttctctgcttctgtttcttgaagtaaccaaggctgacactcaggtgtgtttccttccactattctctatgctaacacaggtgtgtatatgtgcacttatgagagctttaaaagtaaagaatggggttatactgtacacatttctctgtgttacgcagtggttaagaatgtgggctcagcttttcactgatgagttgtatgaccttggacaagctagttaacccctctgcatctatgtcttcttagttatataatggtcaaaatattagtgtctacctcataaaatttttttttttgaggagtaaataacttaattgtccaggcgcagtggctcacacctgtagtcctagcaattagggagggtgaggtgggcggattgcttgaggccgggagtttgagaccagcctgggcaacatggtgaaaccatctctaaaaaaaaatatgaaaattagccaggagtggtggtgcgtgcctgtaatcccgttacttgagcccgggtgtgtgtgtggggggggatgttgaggctgcagtgagctgcgattgcaccactgtactccagcctgggtgacagaatgagatcctgtcacacacacacacacacacacacacacacacacgcacaataacttaatatacgtaaaatatttagaccaataccaggcacattgtaaacactttttttagtgttaacttttattattaagagacttctctttaaatccttacattcagaatgaattcctgctttttaacagctgataacattccacagtgtagatatatgttatgtcaaagtcaaacaaaaatatagattcgaatctctatgtaaaacattttacttgggaaaatatataaaaactacattgcaattcaaggcatacacacagatgggatggtctttggtgtgtctgaagaacaaataaaatgttgggggttttattagaaagagaaatgttacatattgttatgaaagaaaactcattggcactagcaaagttctgggagctagcaagctgtaattggtgagtgatggcaataggtaaaactagccttagaggcaaggcaggtcatttcggcagctggcttgtgatagaattcttgggtaggcatttgtgtcctgagtgcttttcttttcctctccctggttctcggctctaatttacttgggtaataacagataatgccaattcatataatcaattttcacatataatttactcagaacaaattgtgatgccagttttgatgtcttcatattgtgatatgtatgctattgtttaagaatgaagtggagccagctgcagtggcttgggcctgtactcctagaactttgggaggctgagatgggaggatcgcttgagtccaggagttcgagaccagcttgagcaacatagcaagagccctgtctccacaaaattaaaaaaccattagctaggtatgctggcgtgcgcctgtagttccagctacttgggaggctgaggcagaaggattacttgagcctgggagtttgaagctgcagtgagctatgatcctgccactgcactccagcctgggtgatagagcaagaccctgtgtctccgtgtcaaaaaaaaaaaaaaaaaaaaaaaaaaaaaaaaaaagaatgaagtggaggggatgggaatcattgttcttttttttttttttgaaacagagttttgctcttgttgcccaggctggagtgcagtggcactgtctcggctcactgcaacctccacctcctgggttcaagagattctcctgcctcagcctcccaagtagctgggattacaggcacccgccaccacacctggctaattttcatatttttagtagagatggggtttcaccatgttgcccaggctggtttagaactcctgacctcaggtgatctgcccactttggcctcccaaagtgctaagattacagacatgagccattgcatccaactgggaatcattgttctaaaaagctgttgttggagaattatgaaattctgccaaaggttgcatttacaagtattttctttatgctgtttaaaagattattggcttttctgactagtgccttaaagctggagttggatatatcaaagtgctgttgcatgattatttatgatttcattttactgcagcgtaaatttttataatgtcagcatttaagaaatattattcctgtcaactttaccaagccctgagtggcttcttatatattacttttcagcatatttgctaatttcctcaagcagtgctagatattcactttggaatttgccttttgatgtctcttctgtgatgagcagccaccaaatagcccccaccacattctaattctttattgcaaaaagtaaaatatggagcactgcatctgaaaaccactgtgcgagacaatctcatttttactttctttctgcttaaatatgcaataaatatgtcttctgataaatacagttctagaataaaatagttttgtgtaacatcttggagtaaaaaagagaaagaaattttttttttttttagacagaatcttgctttgttgcccaggctggagtgcagtggcaccacctcggctcactgcaacctctgcctcccgggtcaagctattctcctgcctcagcctgccaagtagctgggattacggcacctgccatcatgcccggctaattttttgtgtttttagtagagacggagtttcaccatgttggccaggctggtctcgaactcctgacctcgtgatctgcccacctcggcccaccaaagcactgggattacaggcatgagccgccgcgtcccaccaagaaaaatttaaatgtacgcaatgattttggtgtgctgccgtgtccctgggcactaccttcctaggcattgccaaccttgtggctccagccacaaacattgtgactctgccagagggcttgctctggcaatggagcctacttggcagcaaatcagcaggcagtaagtgtcagggagtaaatgccctttggatgacaataatgagtggaagtgggaagctaaattctccaggtccttcacccctcatgtgagataactctaagaagttttatattatctcccagggttccccagtgggatcatttgcagttacccatggcagtaacttgtttgataatgtaccttttatagctttggttctcattctgctaaggtgccacctgggattacctcccaaattagccactttgtttcaatttttttttttttttttttttttgagatagagtctctctctgtcacccaggctggagtgcagtggtgtgatcacgactcactgcagcctcgacctcctaggctcagatgatcctcccacctccgcccccaaatggctgggactgcaggtgtgcaccaccacatccggctaattttttatagagatggggtttcgccatgttgcccaggctggtctcaaactcctgaggtcaagtgatccattggcctcagcctcccaaagtgctgggattataggtgtgggccactgtgcccaacctgtttcaagttcttgtctgcatgtctatttctacgggaaccctaactagaaactacattttttttttttttttttgacagtctcgctctgtcgcccaggctggagtgcagtggcgtgatcctggctcactgcaacctccgcctcctgggttcaagtgattctcctgcctcagcctcctgagtagctgggattacaggcgtgtgctaccacgcccagcgaatttttgtatttttagtagagacggggtttcaccatgttggtcaggctggtctcgaattcccaaccttgtgatctgcccgccttggcctcccaacgtgctgggatcacaggcgtgagccaccgcacctggccagaaactacatctttttaaacaaaaatgacacttacttactatataaaatgtgagaaaatataatcaagcaaaaggaagaacatataactcataattttatcatttagagaaatatgtattatcgatattttggtatattttcatttgtgttagtatatctaaaaggatcatactgtacatattttgtgagtaagttttaattataggaacaattatagcaatcagaaacaatttcctttttgctttttccccaaatgaaaattcttcagatttgttttctccaataattctttaaaaagtgtcagtgtaatctgtttttctgagataaccattgttaactattctgtatatgctttttctgactacatatttatatactatattaaaatatcaatggaagtgtattttatatattattctgtaacctgctttttcattagcaatattattaacataaaaagacaaaaagcatagatgtttattgcagaaaaataagaaagtacagataaacaaaaaagagtataaaaaatgaaaattggccgggcacggtggctgacgcctgtaatcccagcactttgggaggctgaggcaggcagatcacctgaggtcaggaatttgagaccagcctgaccaacattgagaaaccccgattctactaaaaatacaaaaattagccgggtgtggtggctcatgcctgtaatcccagcactcgggaggctgaggcaggagaatcgcttgaacccgggaggcggaggttgtggtgagctgagatcgcgccattgcactccagcctgggcaacaagagcgaaactccgtttcagaaaaggaaaaaaaaaaaaaaaaaaaggaaaatcacatctattgtaacaatccagggataaatactattaattttggtgtaccttttcttatctgtttgttttttgagagagtgtcactctattacccaggcttgagtgcagtggcaccctctcggctcactgcaacctccccctctggggctcaagtaatcctcttgtcttagtctcctgagtagctgggaccacgggcacataccaccacgcccgcctaattttttgtatttttttgtagagacgggattttgccatgttgcctatgttggtctcgaactcctgagctcaagagaggcacctgcctcggcctcccaaagtgctaggattacaagcgtgagccaccatgctgggccttctttttttagacttaaaaaaatttcacataaatattcatgtaaataatgagtttaggaatgagatcatactatataaacagttttgttaactgtcacttagcaatatgctgtgagcatttttctataatggtaaatattaagatattgttaatgacgatatcaaaaccttttaaccagctttcatttgctaaagtttagaatgtttcttggtttgcaaaaaaaatttataaatggtatcattataaacatccttagagttaaatcgttgggtgcatccattattatttccttaggatacatttcaaggagtaaaattattgggtcaaaggtttatactttttttttttttttttctgagacagaatctcgctctgtcgcccaggcctgagtgcagtggcgctatctcggctcactgcaacctccgcatgccgggttcacgccattctcctgcctcagcctcccgagtagctgggagtacaggcgcccgccaccacgcccggctaattttttgtatttttagtagagacggggtttcaccgtgttagccaggatggtcttgatctcctgacctcgtgatccgcccgccttggcctcccaaagtgctgggattacaggcgtgagccactgcgcctggcaaaggtttatacattttaacgagtttgataaatattgccaaattgcctgccagaggggttttgctaattcatacttctagtagggaaggaaaattaccttcttttcctctggttttcaacaatgttgtttattataactaaaaaaaaatcttattaccatggaattcaattatagtacttgtatttcaagcgatccttttgccattgacttttaacttttgaaaggtttttgaaaactgtgtaatttgtttcaaatttctttgcatgtgaattgtcaaattccccaccaccagaggcatctatgtatttcctcttattaagtatttaagcatgtgaggtcttatcatccatataaattgtaattcgtgttcataagaattccagtctgtttaagttaatccatttctctaagatgttaataattcataccaaagtcttacccttacattgtacctgctgcagtgaaatattatccccaagctgttttactataacaagatcgacttttcctacttctgattttaaatatttactttctttcctttaaaggttttgcagatgtgaatggttggcaccttcgtttccgctggtccaaggatgctccctcagaactcctgaggaagttcagaaactatgaaatatgaaatatctctgcttcaaaaaatgaggaagagcaagactgtcccctatgctgccaacatgcagtctttgtttatgtcttaaaaatgtcatgtttatgtcatgtctgtgaattgctgagtactaattgattcctccatccttgaatcagttctcataatgctttttaaataagaaaaattcagaagatgaatttcttccaatatttgaataaattaaagctcttagatacagagtagattgtattatatgctttttcctattaatactacttatagaaatccattaaaaagcaatctctgtacagtgtatttaaatatttcattgacatactgtgatctctattagtgatggatgtacaaaaaatgttttcttacccttgacttacaatgaaatgtgaaattacttgtctgaaccccgtggggagaaataaataattttcccaaagttcataaatgaatttataattcaattttttttagggtcttgctctgtcacccaggctatgcagtggcataatcatagctcaatacaacctcaaactcctgtgctcaaattatcctcttacctcagcctccctagtagctgggactagaggcacacgccaccatgtctggccaattttttattttctatagaggtgaggtcttgctatgttgcccaagctagtcttgtactcctggcctcaagtgatcctcccatcttggcctcccaaagtgctcagaatacaggcatgagacaccatgcccagccttgatggtattttaaaaataatttgaatagatatttctaacctaattttaaaagttatgatttatttgaggaaaaaaaatatatgtatatatatattttttagatggagtctcactctgtcacccaggctggaatgcagtagcatgatctcagctcactgcaacctctgtcccttgggttcaagtgattctcctgcctcagcctcctaagtagctgggattacaggtgcctgccaccatacctggctaatttttgtatttttagtagagacagggcttcaccatcttggccaggctggtcttgaactcctgacattgtgatccactcgcctcggcctcccaaagtgctgggattacgggtgtgagccactgcgcccaactggaaattatgtttttacaagattttttgtgttatataagcaagtgataattttttttttttgagatggagtcttgctatgtatcccaggctggagttcagtgtcatgatctcagctcactgcaacctccacctcccaggttcaagcgatcctcctgcctcagcctcctgagtagctatgattacaggagtgtgccaccacgcccagttattttttttgtatttttagtagagacggtgtttcaccatgttgaccaggctggtatcaaactcctgacctcaagtgatctgctcacctcagattcccaaagtgctgggattacaggcatgagccactgtgcctggctgcaaatgataaatttataaattacattctaactatgaaaatgaacctgttaggtaatagaacttctttaggttggaattattgatgaaaacatgtagtctatatttactttttagcttgcaaacaagtgaatgaaaaataaagaaaaaaaaggattttagagtagaggttccttagtcagtgacagagttttcactgggctacagcacactgagaaagataagagtatagtaagtgctgtggcctgaatgtttatgttcctcccaaattcacatgttgaaatcctaacacccaaggtgatggtattaggaggtgacgcctttgggaggtgattatgtcatgcgggctcaccctcatgaatgggattagtgctcttatgaaagaggattgagagagagagaccccttgcattccttccaccatgtgaggacacagcaggaagtcaccatctgtaagccagaaagtggggccttaccagataatgaatctgccctgatcttggacttcccggtctccagaaatgtgagaaacaaaatattgttttttataagctacctagtttatggtattttgttaagtagcccagtggactaagacaacaactttgttttccatttttttcccactcccctcccccacaggcagtgtcctttaaaaagctaaatttattcagtataaagggctgtctgttatttagatgtcatgtccttccaatcattgtagcttatttatttatttatttatttttatttttttgagacggagtctctctctgttgcccaggccggagtacagtggcacagtctcggctcactgcaacctccgcctccagggttcaagcaattctccctggctcagcctcctgagtagctaggattgcaggtgctccagagtagctaggattgcaggtgcccgccaccacgactggctaattcttgtatttttagtagttactcagggttttaccatgttgaccagtc

SEQ ID NO: 15837 - DNA, 9471 bp, Human
ttgttgcaaagaaaggttgaggtggattatcctgaataattagtaaactgttttaagtagtttctgacagctttattagagcagattgcttcttcctgtgcccttagagtttttcttgtttttgttttgtaggtaggatttttagttttgaaggggttggtagagtgaggctgtttttattgtatgtgctttgcatacacagtcaccctataaaatagattaagtgttccgagttcggttgggttttccgcaattaaaaattgtgttaacagtttagtgtttcttacagataacactgataacactttttttgttttcattgggtcttatcattggtacagactgatccaaaaatccaattggcttgctagtaattttttcctgtgaattgctaagatttatgggtaaattaatttttctttttcttttctttttttttttttttaagcatttgctccttaaatgcaaatcgtaccactaagatcctctcacaacagattaaggtcgaatttgcagagttcttcaatttttcatgaagcagtgagggtagatctgtaccactttttccgttctgtgtaaatcaccgtttatgggaaacacttgttttttaggttggtgctatttaaaaaaaataaataaaacggtaggcattttcaaaacatctctgaactttttttttttcccaaactggattggggccgcctcctctcagagctactctttagaatagtattaaacttataaaagcctttgctggctttgggaaataaaatttttaataattctcagttcttttcaaggcttgaattgttttctgtccttcagggttcacatattttgtgtatggtatagctcactggcttttgcagggccccttaaaatccagtaacaattgccatcagtaaatgcttaccatgaggcagaccaagcacttgaatagtccagtgaggtacaggtacaactgctatagtttacaattgaagaggctcagaggtaaagtggttcaggtagccagtgagtggcagagtagggattcagacccagaacattcataatatttatttgtgtgcataacaagtagttgtaatgtcagttaaaagtttgtattcccattttggttttctatgtctagagtggcacctagggctgaaggtgattgacactagaggtacttaactacttccagagaatttctacattagcttattttaagtgcatgaattctagggaaaaatattttaccctttgcagatgccacccctaagagatgcaccaacaaatagatgacatgaaattaagcattagtgaatgctgttgatacgaaatatgatcttcaaacataaaggaatcaaatgaacaaactttgtttacaggggaggaggtggtgagggaaaggtttgaaatactcaggtgagtaggattcctacagctgcatagtgagatttgtaaggttctggtaagtttctgcagctgaaggacttctgcattcacctcttttgtaaatattatggaattttaaaaggaaggatggttgcctctggggaagggaactgggaactgaggttattttggaggggaaggggggcttctagatgtaccttttatgctttattaaaaagtatattacctattaaagtttgtttaaatctatttgattaaaaatttgagtaaactggtttctaaacactgtctccagtggcttcaaaaacacaggtactgttggaaggcattcacttttgagtggcctttgacctcagttttaatctgattaattcagtcattttataatcttgctcttggtgagtttaaactagatttggctaaaatagaggtgggagtgttggcccttcaaagacagtttgatgtgttcaaaattgtagtgcatttaaaagggttagacttctgtgatatttgtccaacgtcaatcagtactcattgcatttttttacttaggctcttgatgttagtggatactggtattatatgcaacttctgaataagttttaaagaatttgaataatcagttgaataaaaacctgaaaagtggtgaatgaaaatttgagagataaggaaaggctagagttggcattcaggggacacaaatagtttgaagactctggtagtagaattatgcaagttttcttaaaattaggcaatatataatattgatactacgaaattcagtacttttccgtaggagggggtcaggtctcattgccttttccgtaccccaaaatatgaaaggtggtctacaattttgttgtggcattgtcacagcagttggccccatgttacatttcctcttgtggcacctctgagaggtgtttcttcattacctcttgacaagagtatattttgattgactgctctatgtgcttgtttattttttatagcatttaaatcaaacggtattgagatggattgggttatgaaacataatggtccaaatgacgctagtgatgggacagtacgacttcgtggactaccatttggttgcagcaaagaggaaatagttcagttctttcaaggtacctctagtattagtcaaagtttagtagtattgtaattttatatttgtattgttttactgtttttaatttgtaaaacccatttgattttggaacttttaagtttaactatgatagtcttggttaatgtattaaaataatatgctccagttaatattcaatacagaatgtgtagaatatgtaaaacctaattaatgtgcagtaacatatttgagaattgtgatgaaatgaaccgtgaattagtatatggagcatatatttgattttgtagccttttttcatgtaatataggtgggcttttagagtgtgtaattacacagtgtttttacactggtcgcaaaaaatttatttaatccagtaatatttgaaaaaatctttcatttgtattatggggtgatgggaaactaagcttttttgttttgttttgttttgtttagacttgttttaaatatttgattcagatgggaatgtttcagcctttaacactgttccccttgatggggttatttgtccttgggttaaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtggggatggagagtttgggatggtgttaaatttttatttttgggggttgtgggtcactattgcttaaatgggggggtagccataacatttttctggggtagtttaaaagaattgataattatctaaatttaacttggaaactacagatttgggtggggaattaatgctaatagttaaattaaaattagattgtttccatttctctgtaggatgttgttgataaatgcttttgtataatcacctatttcctttaaaacacctattatgtactaaaagagacaaagtaaaaatatactttatgaattgttttccgtgactaatttctttgtaaaacttaaatatttaattaagtttgtaggtttaaactgttaacttacggtgtatttaggcaatttaaattgggttatgtatctagatatagaaaaacttactgcattttgcccagtatctaatttacactaatacatttatgctgaaacctgtaccttaaaacatttttaaataggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggtatgtgtatctaatgaacaaaggttctgttgtcattttcttaatgttcctgacactttgtcaagaaatacagaaatggcagtaatttcagtacctattaggttttaaaacctgttcatgaaaatacggattcccatggctagctgtgggacttgactgatgcacatattggcacctagaaaacttacacagaaattaaaaataagatgttggcatattttgacctttttttgcctaaggatgaaatttaatttacatgtctgaacttaattaactttctgagattttaaatttccatcacgttgactgcttttttcataggttttaagttgggaattgcaaacttgcaatcaagttacacagactgttaccacaaaatgtttttgtaaactaaattataaaatttatctctggaaagtgtgtagtcatgtgtttctccttaaattacacaggttatggaggttttgatgactatggtggctataataattacggctatgggaatgatggctttgatgacagaatgagagatggaagaggtaaaataaatattaaagacatttttattcataggtaaattttagtatttgctttgcaagctcttagtggtaatataggaaacttgtataaagttaattcagacaaatttcagtgcattcctatatagagctttataccttgtatagtatgtatgtatacttccctacttgtatctgtaatagtttataatcttggcaaattgtgttttccaggtatgggaggacatggctatggtggagctggtgatgcaagttcaggttttcatggtggtcatttcgtacatatgagagggttgccttttcgtgcaactgaaaatgacattgctaatgtgagtaatttttaataactattagtggttttatacttatcctggtgtctaaatctttaagcattcttaatgttctcatgtttatagcttaataccaaaatcccttgaatataaaaatagatctacctttaattctttttttgagatggagtcttgctctgtcccccaggctgagtgcagtggtgtgatctcggctcactgcaagctctgcctcccaggttcacgccattgtcctgcctcagcctcccgagtagctggaactataggtgcccgccaccacgcctggctaattagatctacctttaattctaatcactgatggatatttttgtatccattgtgtgtcaacctacataggattcaaacaagtaaaaagctacattcgtgaagtccagttaagagtataatgaaagactgatcagcatagaatggtgatgactataccattttgtgctggtgtcttttgttgtaccgttttttgttttgttttcttttttgagacagagtcttgctctgtcgcccaggctagagtgcagtggcgcgatctcggctcactgcaacctccacctcccgggttcaagttattcttctgcctcagcctcctgaatagctgggattacaggggcacaccccaccactcctggctaactttttgtatttttagtagagatggggtttcaccatgttgatcgggctggtcctgacctcatgatccgcctgccctggcctcccaaagtgctgggattacaggcgtgagccactgcgcctgacctgtattagggtttgaaagagtgaatatataaatattagtgatttggtttggctttctaggctagatagtgattagaaactgaggagttggaaataacaggaatagatgctgctgttgtcactgatgtgaaactggttggtttcagatttgttaggaggtcagcaaacttcagtccatgggctaaatccggtcacaccattcctctacctgttgagtggttacattagagacccaatggccattcaggccaaaagtactgactctggctttgaaagcaatggtgtgctctagatcttactgggaatcagctggcctgagttccaactgcttttaatgatagtttaaaacctggctaacttgtgattagaaccaaatgatatcttttggggaacaatttcatatagtcttaaataggtggctttattcaaaccgcatagttccaaatcatgatatcccgtatttctctctgtgtgtttgtgtgctttttttttttgacagagtctcccactctgtctctctgaggctggagtgcagtggcgtgatctctgcttactgcagctcccacctcctgcgttcaagcgattctctgtctcagccttctgagtagctgggattacaggcgtgagccactgcgccctgcctatctgcttattttaaaagcagtaaattctttacattatccctaagtgtatactctgatattcacagaacctctgtagttgactaagttattagtctgacagggcagtggaagggtttgttttaattgatgaggaaaaatcaaggtatgtggtaatttactttaatattctcaatagaaaagtaaataagtgtttccttttatttagttcttctcaccactaaatccaatacgagttcatattgatattggagctgatggcagagccacaggagaagcagatgtagagtttgtgacacatgaagatgcagtagctgccatgtctaaagataaaaataacatgcgtaagtggtgtctttggcacacaatcttatttcctaaacgtgaatttataaaataagaggctctaagatctgtaggtaacgcttggcagttgttgggatttaaaaccatttgacctctataatggctttctgtgggctttatatatcgctgtactagtaattaataagcatactttgtttaatattacttaattgatcttttttacaaagcttgtattgatgaattttatccatcattcctttctcccctgttactctttctttttttcttaaagaacatcgatatattgaactcttcttgaattctactcctggaggcggctctggcatgggaggttctggaatgggaggctacggaagagatggaatgggtatgtaaagtttttaaaatatgcagggttagctgcttatcgatgagtctcaattttttttcttttttctttttaaagataatcagggaggctatggatcagttggaagaatgggaatggggaacaattacagtggaggatatggtactcctgatggtttgggtggttatggtaagtatctctagttcagtttgtgttagtccgcatatgtagtgcaaactttaaagtgcaggtattacttttattattttatgcagatatctcctgctgagtgattcttaatatctttttcttaaggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcattgtgggagataatagtatggcgtctgtcctagaatgctttgtgtcagttactaattctaaaatcaaattggtagaaggtggtactacatacgatgtctatgatttaggagagggagccggggcagcctatatatgtggagcctcttgactgaagctatgattcatcttaatgcttgtatccacttcctttaatgagcaatttaaatattagggcatacaccacctgtcttttttgaaagttgtatgtgttttattttcccaggattactctcttaacatcttaaagcagtaaaagtatacagtattaatgaaaccaaaattgcccttttaaagcaggctaattttccaaatatttatttagttcataaaattcacattttattttttaaacattataggttagaagaattacaattgtaattccctggcaccatgatagcattattgtggtagtactgctaggtgagggaatggtatgttaagtctgtttttgaaaagtaaaatgaatacgagttcacaatcacgaaatacagattgttaaaagtcttgtaacagaaaaatccaaagttagtatagtttttaaataagccaaaactacatggagcaagttgctgtcataaaagctgccttaaaaaaaaaaaaaaaaaaaaaaaagcaagtaagtcagtgttgatacatgagttttgaaaagtgagaaacttacttaaaggatgacaaaatcatggtttgttgaatgaaattagccttggaatttaagcaacttaagtcacattttaaaatttgttctaagcacagtaataaaaaagcatatttgaaaatttcattttttgtttattcagtaatcataaaaatgttagcccatcccacctatcaatacaaaatggttcaagaatataatcctctcttgaggacatttctgtcagtattcaagaaagaccatctagaaatctgtgtcacatctgacacctcaaaagctgactggaaatttacgggttttggaaaaaatagatcttcaagtaaaatattcatttcatacttaggctattcagaaaaatttaaatttcatggaagcatatattcatgaagaaaagatcc

SEQ ID NO: 15838 - DNA, 9471 bp, Human; identical to SEQ ID NO: 15837

SEQ ID NO: 15839 - DNA, 8583 bp, Human
  misc_feature (1)...(8583): n = A,T,C or G
ttggcaagattccaatgacctgggccaggcgcgtggctcatgcctgtaatcccaacactttgggaggctgaggctggcggataacgaggtcaagagattgagaccatcctggccaatatggtgaaaacctgtctctactacaaatataagaaaattagctgggcgtggtggcacgcacctgtagttccagctacttgcgaggctgaggcaggagaattgcttgaacccgggaggtggaggttgcattgagtcaagatcgcgccactgcactccagcctggtgacacagcaagactccatctcaaaaaaaaaaaaaagattccaatgatcctataattttatttacctgcttcccaaatatggggactcccctcaacccagggaaggcactccctatcttgtctttcacctcatagtccaatgtacctctggggaccacagggaggaatggaagctaagttggcttgagacaccatcaggtagggacctccctctctgtgccaggcccagctgacttctagtcctccctcccctcccccattataaggcttggggaagctccagggctctggctgggcagtgggtagcagtggctagagtggaaaatcccccaccagctggatgatatcagtgtttacagatctggtcctggccttctgcctggggcctgaggacctgacaaatctgcctggagccctgagtgtggggtacgaggtcgcagagaggctattggcacggggatttttttcccactcactccaaaatggagagctgtcctgggccaggtgagcaggcactgggccagctccaggtcacctcaggcaatgggaagctggtagctgggaagtggggtgggagttgggggaggtgggggagggggtgccgagatgagggatagaggaactaacaaatcagacttgggggctgcacaagggcttgggagtgggtcatgggagacataggcactttaggagaactgaagacagaagcagggacgcagcggggcagaagagagaacgaggaacagcagcagggcgcaggcctgtccctcttcatatgcccctgctccaggcctctgatctaggtcggtacaagaggcacaaccagaagctggtgtggcttactctatgagtgtgtcctgagcatttgctgaattatgacaagcatttctccaaatgtcctgtttgaccttgaaagcctctgaagctgctcaaatagctgtgacttcagccattgtcatcccagccccaccaccagcaccagaactcccgacactgccatcagcaccaccctcaccatcaccatcattgtaaccagcatcctagctactagctactgacctcttgaccccctgacacccctatctcctcccctgagggtttgagggtgctaggagttaggagtggagtcaaagcttcaagtacataacctagagacaagcagttctcaatgattttgcccatccagaagacacttagcagtgcctggagatatatttggttggcacaatgggtggactgctcctggcatcgagtcggtagatgccaggaatgctgttaaacattctatagtacacaggatggggcccacaacaaagaactatttgttccaaaatgtcgacagcactgaggttgcgaaaccctggctatagatcctatctatcccagcactctgcctctacctttttctggccctcgtccctaaatgcacacattatgcctctggtttgggaacaagacgtaatcttcaccactccatcttacggcaactttctctcttatcgcttgcacctcctggcctccgatgcttgaactaaaaagtcaataagatgaaagtctgttgcggccaccctcaagaaggaaaaatacacagaaacgatacacgaagcacagggtacaccctgggttgaggtcatggctgcccagggcagggaggcagcgattagactaatcttgggcgtataaaagaggaaagagtgcccaggtcttcactccactgcgactgcagaactcagagctgctcttcctctgtggccagttggggaccagcatcatgaagtggatggtggtggtcttggtctgcctccagctcttggaggcagcagtggtcaagtgagtctgggatctggctgctggtgcagggagcctggatgggagcctaaagccctgcaaagggcaactgggccaggggacaccctgcctgtctctactctgggacttctgctaggggaagggaagtctccctttgctgatgttagacaggacacatgggtggaaggagacacagcccctgcttcaggaaacttcctatcaaagggaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccattgcactctagcctgggtgacaaaagtgaaactgcgtctcaaaaaaaaaaagtacatatcctgaaaagggtaaagcctaaagtccctcttcctttcctggggaggaatctatgggatatttgacagcaaagggccagggagataggaggacccttgagatgaggtgaggagtgcatgcatggtgaaatgaatggttttctgaatcttagagcaagtgctgagaagagctttgtaagaaagaggggaagaggcaaagggaggaagaaacacgcgcgcgcgcacacacacacacacacacagagacagacagacagagacagagagcaaaaggctgagagagagaaaaagacacacacagacaagggggaacaaacagagtggcagggaggttgaagcatgcagttaagagaaggagagagagaaagagaggagtgggaagagaggaaggagggagggccttgcctcatatgcaacctttctgtagagtgcccctgaagaaatttaagtctatccgtgagaccatgaaggagaagggcttgctgggggagttcctgaggacccacaagtatgatcctgcttggaagtaccgctttggtgacctcagcgtgacctacgagcccatggcctacatggatgtgagtcctgaccctttctggcggtagccttctctctggtgtgggctggagggaaggggcaggtcccttcactcctctgcccatggaggagcctggggcccctggatccctctggaactaacagcttgctccatggcccccaggctgcctactttggtgagatcagcatcgggactccaccccagaacttcctggtcctttttgacaccggctcctccaacttgtgggtgccctctgtctactgccagagccaggcctgcagtgagtgctgggctgggcagagaggggtggttggcagggcaaggcactgataccctctggggagggccaaacttccagagggagctcaggactgaggggagctcagtcctggggaggaccagggacatgtgcagggccacacagcatgcccaagccagaggaaagatgctggtcctgcagctggatggcccctttgccttccctgccaatatgtatccctttgcttatgccagcccctaactccccactcccttttattccactctccccattctgtttactctgggcagtgccattccattccatgtgactaatttccagtccattccatcccactccatcccactccattctactccattctattctgctccacctcagtatttactaagttctcactgagtgtctccaagagacacaacagaacaatataggatgtgggctccgtactatagtggttttgggagacaggcagtgtttgctttcttaaggttgccttggtccctgctgaagccttggtgtttgggtcctgatacctttggcccaaggggtcccttgatgtccccaccctatgttatgactggcttcttgatgagtgaaggtggggagtacttggggatgccctggagggctggggggaatgctgggatgtggtgcaggcccattcacttcttcatctgatgagtaattactcagcactgctgtgagccacgtgctttgctggggaccagggactcagggctgggttctctgcaaacctgtccacagggaggccacagtcctgaggcatcccaagattctgtaagtcagaaggggctttggggacaaggctggccagctcccatgggccttccaatgccaccccttgacttggcaaccaggggtgctgaggtcccaggatgtgagcgcagcctgagcgagaggctgaggtgggaacccggcaggcctgagagctgagcagccctgccccagccggcctgactccccatgccctgactcccctgcagccagtcactcccgcttcaaccccagcgagtcgtccacctactccaccaatgggcagaccttctccctgcagtatggcagtggcagcctcaccggcttctttggctatgacaccctgactgtgagtgggcatggggagtggaggctggggctgtgagctataagctggaggggacagttagatggactctcctgaaacacggtggaatgctagtgttctggtgtgcaggacaggaaggcaggacaagacaggtccattcagtcactcccccaacactcactggtggccaccatgtgctaggcactggggcaccatactgaacaagagggacatggtccttttccttaagaagcataaggcctggggagctcagagaagaaggagacgggtgaggaggtgagctgtggcagtcaaggaaggctacgcaggagaggtggctcctgcaacacctgtcaagaggcagaggtggctggccacggtggctcacgcctgtaatcccagcactttggaaggccaaggcgggcagatcatgaggtcaagagatagagaccatcctggccaacatggtgaaaccctgtctctattaaaagtacaaaaaattagctgagcgtggtggcacgcgcctgcagtcccagctactcgggaggctgaggcaggagaatcgctagaaccaggggagcagaggttgctgtgagctgagattgcgccactgcattccagcctggtgacagggcgagactctgtctcaaacaagcaaacaaacaaacaagaaaaccaaaacaaaaaagaagggggcagaggtgaggaagggatgaacagaggcttgaggagtctctaggggaacctggaggaggtgagtggagtcagactggtcacctcccctcgtttgtgtctccattaggtccagagcatccaggtccccaaccaggagttcggcttgagtgagaatgagcctggtaccaacttcgtctatgcgcagtttgatggcatcatgggcctggcctaccctgctctgtccgtggatgaggccaccacagctatgcagggcatggtgcaggagggcgccctcaccagccccgtcttcagcgtctacctcagcaagtgagcaaccagctggccagtccccacctcccgggatgctcccccggccgccctggacgactgaggctcagtgctcaatgctttggggtttggaggcatcccagcgggcatctggctccagtcagtcttgctccagggccttccttcctgggcttcctctcgaatcctctcccagccacccgaccacaccccatccctgcacctgtccccagtcccctccgacttgtctttgcattccatggccacgatggaatgaatctcttccacagcagctgaactttgccctgagttttgctgctctgattctcagcaccccttggacaggcttcctggtggagaagcgggtggggcagttcgctcacttccttctgaccgaatgttttctacctgtatccctcttttgcatagtaatgtattgcttcatctccttttatctattgttctagcctggtcctggagtcttctggtctaggtccactgctgacccctagcaggttgttatccttgccagtcaacacaagcatgtgcaggcatttagtgagacaggcagtgggtgggggtgagcggcctggggcctgcttttctttgttcttcttcagaattaaccagcaacttgcttttgttttgttttgttttgtttttttgagatggggtctcactctgtcacccggtctggagtgcagtggcgcaatctcggctcactgctacttctgcctcccggattcaagctattttccagcctcagcctcccaagtagctgggattacaggcatgcgccactgtgttcggctaatttttgtgtttttagtagagacggggtttcaccatgttggccaggctggtctcaaactcctgacctcaggtgatccacccgcctcggccttccaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15840 - DNA, 14712 bp, Human
caacacaaaatcacctagcaacacatttctcagaatgtatctgtcattaagtgacacgtgactatttgcactgttgacctcaagtacacaaatagatcagacaagtggagaaagacctcattctacttcattctaatttaaatgcaggtgctgtccgtagttaggaaaatgtgaaggagcaatcagcctccagtgatattcaagtctaattaaaaattcttcttggactgtttagttcaaagctccctcttaatcttccaggagcttaatcctccacacaaagtatatgaagacacaaaaatgtagaaagtatgtgaaatagctattatttaagtgtggaatattaattttgttgtaaggaggggatttattcactgaaataaactttattaatttgactcatcgccacagaagtcacgtaggctcctctctgagtcagaaaatgtcaagagctttctgtctatttttcctctttagggactgcttgagtacagcaaaaggaggggccagcagatttcagttcaagcatgtttgaagcctgttttccgacattatttgtagaacaaaaaataaacatagtaaaatctccactacaaatgatctctataaagtgtaataacatgatttaagtttatgtattattttctatattttataaattgctgcattgaacagctttaataaaaaaaattaaagttagccttgaaaatttttttggttgttgtttgttttaatttacagacatgatagtaccttttagctgttcctatacttgagtagcaatcaatttgggtgtaaaatattagggtcataatgttctttatacctcatcccactctctcatggtatttgttactcagagaagaaatctgagtcctgattatttcaattcctttgaagaaaccaagttacttttttgtttatttagcagtaggaatctttttatttaaatttaaaaattttcacctggaaacttcctattctaggtctcactttgtgaattttttccttgcccatgttgaactctcaacctccaattttagatttcttctcagacctggaaagcatattttttaagataaaatttttaatcttgcttgtgatccaccattccattttatgctttaaggacatctctgatttgtagattggaattctgtgatttgtcctcccttaaatttctgagctcttctaaatgtctttattcatttcacatttgggaatatttctgaagtgaatcctctccattattgatttgattttcacactgtcaaatctgtcttttcttgcttctagtacaaaacctgctggattttttcttcttgcttcagcgtcttgaaccaagtttcctttttaaatctaagtctgttcttgttgggtggtggcagtgtcctctcaaattgtttctggggtccctacacccccgtgagctcccaggccatgtctgtggcaatgctgaaggacaaatgcagggtgtggccctcctggtgatgaagaggaggtgcaccccaggtcaccagaagccaagagaacccacggggctgagcagggcaggatgaagcaacatgttctcacaaaaaccctgaagatgagatacgattgtcgcagcctctccctatgtgggcctgactctcttcactacactaaactggatgtgaatggagagggggcctctggagagcaaagggccctctgttccccttcctaatatgaatgccttactttgatttacattcaagtatcattctcccttagattttgtaaggttgaaaggtaattgtcattattaccacagaaaggaaaactggagttcaaagaaacttaactgagaagtgagtcttggtctctgtattattgtgttgatgtcaggagtcagagcaactggtgatgaaacagaacccaaactcagtgactcccaggaatggcctcatatcctgttgtgcaactttccgaagcctctaggtcattgtggtgccttgtagctgtcccgggagccctcagcagcagttggagctggtgcacaggaaggatgaggaagaccaggctctgggggctgctgtggatgctctttgtctcaggtaagacaaggaagaggactgagcaggggaggcgtttggtccaggatctcggggagcccttttctgttgaagcttcagagcacagggccatccaagatagagccaaccagtagttatggcagaccgtgctgctctacccagaattgggagaacatgcagtgtctgcacacaaaagtaaaagaaggagagagtcagggaaaaaagatgtctgtgcatgtcgatgttgttagagacatgcaaagcctagtatgggaataatgatagagtagatctcatcatggcatgatctacaataagtttatttgatgttgaaatttttttcttatattccatcatgatgtgtttgatgttgacaatctgttaaacccaaaagacagaattgatttaacaaatatttcccaggggtctactatgggacagcaaatatactactgctgaggacacagacgtgaccagaagaggctggtgctcattttggtggaggtgatcatcccagctctccatggcacgctggggttggagggcacagttgctgaggctcagcagagccggcgcatgccccagctctttcttgtgtctcctcttacgatccgcacagctcacatctgcacccaaaccagaagcatgcgggctttattcactcctcctcctaatccttatgaataacaggaggaaagtgtcaatatgagttaaaagcgaggcttgccttgggaaggcatgaaaaatcagggagaggtatcctcctgggctctctactttgagcaaagtcatggacaactgccttgaagagcctgtgctcagacattgctctgggtcttcttggagctggggtgataatctagatgggcagaagggagttagctcctcatggacaagtgcatttccttgtgtttgattcatgtttttctgaaggagaactgggagatggcagagggctgaaggttatgtacctgtgtgagagaaaaccagtggtatatatttcattgtgccctgtggggataggttaggggttaacctcaatgctccttgcaactggatacttattcacacttgggccaggacttctctaatccctatcagactgtgttggaccatgtagctcagtgctttaggtggaaccagagtccttgggtttgaatcctggctctagtacttaactatggtgagactttgggcaaatcacttaatctgtctgtgcctcagtttccttatctataaaatggggagaataatggtgtcaactttttactttataaagattaaataagatagtctttaaaaacccttagcacataatacttaataggtagtatttgctacccttttaattaacatattcaaaggaattcccttcttgcaattgtgcacagacagctcagcagccttcatttcttattgtctccttccttctgtgagagacaggcaagtttgcaaactcagtcacctgtaactcccaccttccctggggagctggcaaataaaagagatttatctgtaacattaacttcagaggttagggcttcagtggtggcaacttgaggatggagtctgtgtgtcttccaaagagcccagcacagtgcctatgatagagaagtctcccagccagtctgatgagtgagtgaacaaatgagggaaccaggcttggtttcagacaacactcagcctctggtcaacagtctcttggaggcacattcctgactggagtgtgtgggagttgcccaagaggtctgtttccgaggtttccctagaaactggagtctgctcccagaagaactggctttcaagactgatttcacctttaaactccttgtgagtccctgagttgagtcttcctaaggtcaggcagatctgttggcctatcctggggtgggcatgccagggggctccatgaaagggtaagcacttgtcatttttcaccaggcctgcaaggacctaagtgtgtggtattaataacagcagtactagtgttaccgtgacccacacagtagacccagcagcactgtctagcctgttatttggtgctccatgggggaaggtaccccaggcctgagtgggtaagctacagtctctcagcaaacttagagagccctgtgtgtccagctgaaaacacggaccttggtcttctcacttccgctctgcttggcctcccatcagcaaggctcccttggacaaggccagatgagcatccccaattctagatggttaacccagttcggactccaagaatgtgatggaaactattgtcactgtaacccaggggttctcaaacatggcactattgacatttggggtgggatgattctttgttgtgggggctgtcctgtgcactgtagattgcttagcctggtatccattagatgttagtagcatccacccctctccctggttataacaaccaaaaatgtctagatattgtccagtgtttcagggagagttgtggcggggagcaaaaattgctccccagtggagaaccactgctgtgactccgtgacatcaaaaataggagggggcatttcttggctcaggtaactgggaagtacaaggggtgctcctttggagcacagctgagtccatgactcagataacgtgggtttttttctctctttctttctctcccctccactatccccctcttccttcctcccactcactttctgcctgtttagccattctcgggcagcctattcctacgtggtagaaagtttcacataataaagtttcacatctcattgacctgtgaatcccagcaagaagcatttccattaatggctacagcagtctcagggaggactctgattggtccagctcagccatgtgctccttcctaaaccaatcagcctggcagggagatggggtactttgtgtatgtgtgtgtgtgtgtgtgtgtgtttttttttaacagagtcttgccctgtggcccaggctggagtgcagtgttgtgatcttggctcactgtaacctccacctcccgggttcaagtgattctcccacctcagcctcccatgtatctgggactacaggtgtgcaccaccatgcctggctaatttttttgtatttttagtagaggcaaggtttcaccatgttggccaggctggtctcgaactcccgacctcaggtgatctgacctcctcatcctcccaaagtgtgggattacatgcgtgagccactgtgcctggccccgagatggggtacttggattggcaaatcctgtgtcctgtgcccatccttgagaatgtgggctgccccaacagtagagccacacaggatcgttcccttggaaaggggtgctctgctacccaaggaagggaaaaaggagtgccaggcagtcagatatccatgcccatcatgccctccagacggcttcctcactgtttgtccaaaggtcttttgagctgatctccttgccctgacttagatgaagttcctcaaggtgtccttggagccactctctgctagcaccgtgtctttgcgttcactttttatgtcatacgcccttgtaatcgatccctcccaccatgctgcagccactcgtggtcttagtacaatatcccatgttctgtctccaggcaggcagtttcttcctctcaaagtcagtcttcctcttctgatcatttatgaaatttgatcctcatgcaccatatgcagtctcttatagtaaaaaacctactcacagtggaaagatctgaggtctagtgctggcttgcagggcaagttgtattttctctggaggcctcaagaacctcatctgaaatatgggtggttggacaagaaaaacagggggctcctctcctttttccccactcagagagagaaaaataattcctcacagaacccattctctttccctgcttatagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtgagtggcctgggacttggggggaaagaagggccaggtgaggaaaggggcagtggtggtagcatcagcagagctggggttcaggattcccagcagtctgtcttcctcccaggacctctttatctctcatctaaggtccagtagtaagtagaaccttccatgcatgagattctccttggatagcacagcctaattttgggtgctgtggtaggaattggggtacaattaaggtgagtggtagatttgggataatttagtcccattctttgttctccacttagaagtcatgtcctgactccccctcccaaggatgcgtttggtggcatgcctgtgtgcttctgaagcagcccctctcacatctttctgtgggcacagaccacctggggatcttatttcaaatgcacactccaactgaatgggtacaggggtctgcatctctattgatctcccaggtgatgccaatgctgatggtccatggctcccattttgggggagcaagtctccagagctcattttgtgtccccttgtacacaactctactcactggataggagaggggggtttacttatctgtaccctattcatttcagaactgcttgagggaagcacctgtgccttcctgggctctgcacccctagcaaataatgtagtttctgacacaaagtaggccctcaggagatgttgcattaaggaatgaattatggaagacagaggaaagggaagcaggctcaagttcccagcacctggggaattctaagcctgaggaagacaaggtgcacacacaatatattaataaaagataacttttaaagcaatatgccataagccaggtgaacgaaaggcagagtgaatcaagtaagcctggaattattcttggagaaggttggggcacaagaattggtgaagaacagaaggcaagttcatttccaacagtacgaatgacaaaaaattcctttcttcttctctctttctgctctccctcacttcctgccctttttttcttctttccttttttcgatttctgactcaggttgactccacagtatttctttggctttagcaaaggaaaactttgcatttgggccatgctcatttccctcctcagcttcatttaccgtaccacctacccgtccatcaactcatccacattttcatccatacatccatacatccattcacccacccatccacccattcatcatccatctgtccatccatccatccaatgtgtcttcttgcaggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcaggtatagtttccaggtccctgggcccctggtttggacactgagccctttgtttcccagtctgtgtgctgagaggatgtgaaagtgagggaaaggggagggtggggcaggagaagacttgagtcacattagtctgggtagaaatgtccaggggaagaaggaagtggtgatggagaataggggaggctctcagccaggctgtccttctccccagttcaccttctttgtttccttgcaacctgagtattaaagagagggaaatggcatcttccccaagttccagtggagctcatccaaccccaggggcctgatgggcagtgggaaagcactctgagtgaggggccctggatctagtgttggcctgactaactgaatgtgactttgggtgagtcaggaaccctctctggctttagcttctttgacaattcagtaggcatggtagaaacccaaagctggaagacattgtccacctaataactctcagcaggagctggagctggggctaaatgcagtattggtttttgccttattgttttttaaataacattgttgcatgtgcccaattatagataaatagaatcagaatttttgcagatgaggtccctctcagtatttttaataagatgtttaggagatttctaatgtgtaggcaaacttaagaaccactaacttagcaatttcacacctctttacagttattaaatgttgatttatattagaatgtgtttatcattaaatactgaattatcaggatggaaatacttttccacatcaccactagtctaacatgtcttttttctcatattctcttctagtctttattcatgtttatacatattttaatatggcagtaagtctaattatacatgtttttattcttttccttgctgaaattattctttgatgctgctacctaaatttcataaatataatttcaatgagtgcatatttttctatcaattgggaaagccataacttacataaccattggcctgttcttagacattgatatagtgttgataactctgagataaacatattcttgcagatatatttttcttcttttaaataattaactcgaaatttccatgagataatttaaacactgatatcattttgtatacaaatagcatctaccaatggtcttccaaaagattggaaacaatttgcagtgtgatccattaagcataaataaagcagtgtcatggcaggcttacagacacggatttagtcttttaaatcattaaatagtgtgagttaaatcacattcctgctaaaacaaatgtgaactggtgcctgctctaatttctctatgagtgtagactccacctccatatgggtagtggcagtgcctttttccccattatgttgtttggggaacaaagtgctcattaaacttctgtggaataaatcaaacgaatgatctactaagagtcaatttttttttttcctctactttcattttgcaatacataagttaagagaacataatctttgcccatattcttacttttaccggaaggagggccttaagtgtaagctgtccaggttctgggccttttaatcaaagtattggagaagacgcacaaagtaacaaaggaatgaagcagtgaaagcaggaatttatttaagcgagaaagcgctccccagggtagaagtggccccacgcaagtggctcaagggccaagttacaaagttttctgggttttaagtactccacgtgaagttcctcccagttaccccttatctggatgaagcatttggtttgtggctaactaaaggctaaggtgaattggcgccctctgtgggtaaagggatggtcgtctctgcttggctcagggccaatctaagacactctccctttccagctgagacgtggtggaagggggagggctgtagggagagtagcctttgattctttgctgctggggcatggggagatggggtttttccttttgttttagctttagaaagtttatgttaattggccttaggttccctgaccccagccccaggagttttccttttgatccagctatgggaagtcagcacgaatccatcctagatttcttgcccctagaccttggtgttgctccatgattcagcatgaattggtcttacgttcctgcctccagaccctattctcctgccttgctgctagagactgcatctctcttttatctgttaactttatctatcatctaatatgaactatcctttcagccaaagtccagtctggaaagtggaatccacactagctgtttgaaaagaagaagctttttttctttttcttttctttttttttttgagacacggtctcactctgtcaatcaggctggagtggagtggcacgatcatggctcactgtagcctcaacctcctcccacctttgcctcccaagtagctgggaccacaggtgcataccaccaggacagctaatactttttattatttttgtagagatgggggtctccctgtgttgcccaggctgatctcgaattcttgggatcaagtgatcctcccacctcggcctcccaaagtgctgggattacaagtgtgagccaccacatccagccatgaaacgaaggaatttaatgcagggaattgtttgcccaggtgatggaagagctgagacgctatcctggggatggagaggcactgcagaggtagccactatcaccctatctctaggtagtttccccagaagcaagctgtaaagtcttgttaaaatgttttaggactaggtgttgtggctcacacatataatcccagcactttggcaggctgaggtgggagaatcacttgagcccaggaatttgagattagcttgggcaacatagcaagactccgtctttacaaaaaaataataaaaaaattagcagggcatggtggcatgcacccatggtcccagctactcgggaggctgaggcaggaggatcacttgagcctgggagatcaaggcttcagtgagctgtgatcaagccactgtactccagcctgggcaacagagcaagatcctgctctctttctctctaaaaaaaaaaaaaaaaaaaaaagacaaaaagaaaaatgttttaggaagtgatttctggcaaagccattgaggaagtgggaccaggaagggaaggaagccaagcaagcgtgtcataaccaaggggtatctcacaggataactctggctcagtcttgttaaggagctctggggactcctgggtcacatttggagttgtccctataaggggcagtaactgagcaagggcagctctaaccaaggccaagcacatgaattcctggcccttcagggggttggtagcttgtgtgcagcctcgaaaaaaatgcagatggtggcctgttgggagtggacatgccccaggagttcagcataggaaaatggtaaagcactcagagtggataatgcagagcactggcaggagagacttggggaggaggtgcagtgagcagagcccggaagccaggacattcaggttgcagcactggaatcggggcagatgctgaggatgctgagtgcaccaccatgtgaggggtgagagagatgctggctccctgccccttgctgcctgtctctctgccccatccctgcccccgtctctgccccctgtcccccaccagttgctgaactcgaccagtcaggcttgggaatgtagtcccctgtgctacaagtcagggcccttgaatgggggtggatttcaggcaaataggcagttttctgctttctagctcctttacgccgtttccctctttgctagtttgtgcatgtggttttaagttttgtataggtgggtgtgttgattttaaatcaattgctttgctttattccttaatgtgtttgattctatttcctggtgacttttcttggattgttttttttttattttatttaaatgtttagtccgggggaagatttattctgctacatgctataaactgtagaaaagcctacaccgttaccatgttgctgtccagatactgcaagactatttactaaatgatcctcctgcctctccaagtagctgggaccatgggtgcatgctaccacgtccggcttatccactggacctctgatttccttagacattatgttcctgcatagcactggctctgcatctggcctttgtgttccattgccatctgtctgtccctgtgtcttaccatgccacatccttgtgctctcatctgcttgcatgtctgctgatggaactggccaagtgccctcactcctttgcatctttttattatgatacctattgatgtttacccagaaaccttagaatcatttcgccaaaatctataaaattcatgatgagattttcactacgggtggattcttctcggtttataggtgaggaaaccgagctaaagaggtgagatgaccatcccagtaggcagggtacggtactgagaatagagagcgggtttcctggccagagtcctctctccctaccacatcacagggaggaggatgggctgatcagcccgactgtctccctccagtgcctctcctggacagggacctatactctccactgaattgtttctaatcagtagtttttggcaatgagacagactgaaaagcacagggtcaggcagtgcgggaaaggtggagcaaggatctaagcagaggagagtgggacatgaaggcattttctagagggaacatgtgcgtgtgggagagactttgccagcagtagcgttcagcctcttgtctcccgcagggttccggtgttcaacattgtcattctcctggctggtggattcctgagtaagagcctggtcttctctgtcctgtttgctgtcacgctgaggtcatttgtaccctaggcccacgaacccacgagaatgtcctctgacttccagccacatccatctggcagttgtgccaagggaggagggaggaggtaaaaggcagggagttaataacatgaattaaatctgtaatcaccggctatttctaaagtcagcgtctcaccttcctgcccactgccctcgttcctctaataatcttgggtgggcatttgtgcctcagaaaagaagttacagccccaaacatgcttggtccttcattccaccagccacttggggttggcatgaaatacagacagctcaatgcttttcaccgtaattctcttgtgggggctgtgacatgcagaaggcacacctgatacttctcctgctcagttttgccctggaccatacaattttggcctgacctggacagagctcccactacagaagcatcctgctcgccccatgctgggacttcctctttctagcatcagacacttgggtttcatgcttatgtgtggttctttccaacactcccagaaaagggtgttgaagattgtggaacctggagaaataagacatcgtggtgagaaagtgcatccttctcagagaaaagagttaaactgagtatcttcttctggggaaatactggcaggccgagatgggatccataggagagcaacaacagaccatgtcagacatcctgtgtgcatttatcgctggatcctgaaaatagccccgtgaaggcagaaatgtatgtgactagaacgaggccacatgaataagccactgcccactggcaggagtgaaaactgaagcgctccttacctgaaggaccccaaaaccatatagaatagaataaccaggagttccgcctgtgtctaaatgcctcttttcctgtatcacacaagggtcagggatggtggagtaaaagctctccccctgggaggcttctggaggctgtccccatgtgcttgcctagttccccactctgccctcctcctcttctctcagtctgctcctggaacacctgcctcagtttccatgctctctccagtgccctccccggtgaagcaggtaggtgttcaggccaccacagagacaatctctgtgggagattgtcttgcaatctcccacagatttcaatcaggattttgttatttcctactttgagctttaaagggaaatgggcctcatgggtggggaaaggatggtgggtccttccagcccaatttagtgatgcccagggcagatattatcctcagttcccaagagcaatcatacttttccacacataccgtgtgtctcatgttaggtaaatgtatttttacaatgagcaccacttctgtggaaaaagttccctgcacggggaggtccagcttccagactgctccatcgcataaggacttccccattcccctaaatgctgctctgtcagaacctgcccaggtaatggtaatgaccctagagagatgatttctgaaccgcaattttgagcccattagaaggtgtgtggtgggcatttatttcatcctgatgctctggtgagaatctttgcagacgcactagatccagaagctgttaatcttggtgcatttattttcctacctaaaagaaccaagcagctcagaggcagtgactgtacaggatgcagtgtttataataatgctgagcttgctggtctggaaccccacacttcagcaatcccagcattgttcctgtttatgaagttgacaaagtgaccagggcaagggggtattatcattaaatacactctaggagaggcagaacacatgagggcaatgtttttcagaggtctttaggccaccgcatcagattctcctggagcataaagcaaatgctttatgagtccagggcccctgcagacctactgtatactagtatacagctccctcttagtggatctcaagcttgtttccaaaaagtcattacactccttaccaaagcccatgacacattcatacagattcatccagacataacccactgcatggtccagtgcatgcttgtgtgcttaacttattatagatcaagtgttatttaagtccaacatattaaacgtgactgaaatattatatgcactaaatcggaagacaaatggccgtgctggatactctcccatttgcacttacaggccacgccatgctccatcctccccatcctgcct
